(12) United States Patent
Alexandrov et al.

(10) Patent No.: US 8,344,211 B2
(45) Date of Patent: Jan. 1, 2013

(54) PLANT NUCLEOTIDE SEQUENCES AND CORRESPONDING POLYPEPTIDES

(75) Inventors: Nickolai Alexandrov, Thousand Oaks, CA (US); Vyacheslav Brover, Simi Valley, CA (US); Maxim Troukhan, Agoura Hills, CA (US)

(73) Assignee: Ceres, Inc., Thousand Oaks, CA (US)

( * ) Notice: Subject to any disclaimer, the term of this patent is extended or adjusted under 35 U.S.C. 154(b) by 236 days.

(21) Appl. No.: 12/583,039

(22) Filed: Aug. 12, 2009

(65) Prior Publication Data
US 2011/0177228 A1     Jul. 21, 2011

Related U.S. Application Data

(60) Provisional application No. 61/188,944, filed on Aug. 13, 2008.

(51) Int. Cl.
*A01H 5/00* (2006.01)
*A01H 5/10* (2006.01)
*C12N 15/11* (2006.01)
*C12N 15/82* (2006.01)

(52) U.S. Cl. ... 800/298; 536/23.2; 435/91.1; 435/320.1; 435/419

(58) Field of Classification Search ......................... None
See application file for complete search history.

(56) References Cited

U.S. PATENT DOCUMENTS
2006/0075522 A1* 4/2006 Cleveland et al. ............ 800/289

OTHER PUBLICATIONS
Guo et al (PNAS 2004 (101)25,9205-9210).*
Davletona et al (Plant Physiology, Oct. 2005, vol. 139, pp. 847-856).*
Mittler (TRENDS in Plant Science, vol. 11(1) 2006 pp. 15-19).*
Friedberg (Brief. Bioinformatics (2006) 7: 225-242).*

* cited by examiner

*Primary Examiner* — Brent T Page
*Assistant Examiner* — Lee A Visone
(74) *Attorney, Agent, or Firm* — Birch, Stewart, Kolasch & Birch, LLP

(57) ABSTRACT

The present invention relates to isolated nucleic acid molecules and their corresponding encoded polypeptides. The present invention further relates to the uses of these nucleic acid molecules and polypeptides. For example, the nucleic acid molecules and polypeptides could be used in making enzymes or used to make plants, plant cells, plant materials or seeds of a plant having such modulated growth or phenotype characteristics that are altered with respect to wild type plants grown under similar conditions.

13 Claims, No Drawings

PLANT NUCLEOTIDE SEQUENCES AND CORRESPONDING POLYPEPTIDES

This Non-Provisional application claims priority under 35 U.S.C. §119(e) on U.S. Provisional Application No. 61/188,944 filed on Aug. 13, 2008, the entire contents of which are hereby incorporated by reference.

FIELD OF THE INVENTION

The present invention relates to isolated nucleic acid molecules and their corresponding encoded polypeptides. The present invention further relates in part to using the nucleic acid molecules and polypeptides to make plants, plant cells, plant materials or seeds of a plant having modulated phenotypic and growth characteristics as compared to wild-type plants grown under similar conditions.

BACKGROUND OF THE INVENTION

*Zea mays* (corn) is a graminoid, monoecious, annual plant that was domesticated in Mexico over 7,000 years ago. It was bred from wild corn and/or teosinte to become a staple food in many regions of the world, including the United States. Corn is by far the largest component of global coarse-grain trade, accounting for about three-quarters of total volume in recent years (coarse grains make up a common trade category that includes corn, sorghum, barley, oats, and rye). Because corn is sensitive to cold, in the temperate zones, corn is typically planted in the spring. As a C4 plant, corn is a typically more water-efficient than C3 plants like the small grains, alfalfa and soybeans. Nevertheless, corn is dependent on soil moisture because of its shallow root system. The importance of soil moisture is apparent in many parts of Africa, where periodic drought regularly causes corn crop to fail. Corn is most sensitive to drought at the time of silk emergence, when the flowers are ready for pollination. Once established, corn can grow well over ten feet in height, capturing a significant amount of solar energy in the form of cellulose.

Corn can be used in a variety of ways. Corn can be used as forage, silage or feed for livestock. Feed corn is used to generate heat by burning corn in stoves (similar to wood stoves). Sugars in corn are exploited to produce syrups, particularly high fructose corn syrup, and can be fermented and distilled to produce grain alcohol. It is processed into a multitude of food and industrial products including starch, corn oil, and fuel ethanol. Increasingly, corn is being used to produce ethanol as a way to reduce fuel costs. More efficient methods of converting cellulose into ethanol are being developed.

Despite the many advantages afforded by corn, there is a vital need to create better plants if we are to meet the ever increasing demand for energy and nutrition around the globe. Crop plants that will increase hardiness and yield, reduce need for nitrogen and other chemical fertilizers, and allow propagation under a wide variety of growing conditions can help alleviate the problem.

Crop plants with improved characteristics can be obtained through breeding. Breeding programs can be designed to modify plant characteristics suited to particular growing conditions. Breeding programs are greatly aided by molecular markers that may be associated with specific traits of interest. Alternatively, molecular genetics approaches also allow production of plants tailored to grow more efficiently and produce more product in unique geographic and/or climatic environments. To this end, there is an ongoing need for genetic sequences and materials to advantageously manipulate plant characteristics such as architecture, biomass, development, composition, conversion efficiency, energy output, confinement, nitrogen use, nutrient uptake, phosphate use, photosynthetic capacity, shade avoidance, cold tolerance, drought tolerance, water use efficiency, stress tolerance, vigor, flowering time and yield to maximize the benefits of energy crops and other economically important crops depending on the benefit sought and the particular environment in which the crop must grow. Such advantageous manipulation of plants can be achieved with molecules from corn as described herein, which may simply be expressed or expressed at a higher or lower level in corn or other species.

SUMMARY OF THE INVENTION

The present invention, therefore, relates to isolated nucleic acid molecules and polypeptides and their use in making plants, plant cells, plant materials or seeds of plants having modulated plant characteristics, with respect to wild-type plants grown under similar or identical conditions, in traits such as size (in whole or in part), vegetative growth, increased organ number and/or increased biomass (sometimes hereinafter collectively referred to as increased biomass), lethality, sterility, stress tolerance, or compositional characteristics as compared to a wild-type plant cultivated under identical conditions (sometimes hereinafter collectively referred to as "modulated growth and phenotype characteristics").

Unless otherwise defined, all technical and scientific terms used herein have the same meaning as commonly understood by one of ordinary skill in the art to which this invention belongs.

DETAILED DESCRIPTION OF THE INVENTION

1. The Invention

The invention of the present application may be described by, but not necessarily limited to, the following exemplary embodiments.

The present invention discloses novel isolated nucleic acid molecules, nucleic acid molecules that interfere with these novel isolated nucleic acid molecules, nucleic acid molecules that hybridize to these novel isolated nucleic acid molecules, and nucleic acid molecules that encode the same polypeptides as the novel isolated nucleic acid molecules due to the degeneracy of the DNA code. Additional embodiments of the present application further include polypeptides encoded by isolated nucleic acid molecules of the present invention.

More particularly, the nucleic acid molecules of the present invention comprise a nucleotide sequence encoding an amino acid sequence that is at least 85% identical to any one of the polypeptides from *Zea mays* in the sequence listing, a nucleotide sequence encoding any one of the polypeptide sequences from *Zea mays* in the Sequence Listing, a nucleotide sequence that is at least 85% identical to any one of the nucleotide sequences from *Zea mays* in the Sequence Listing, a nucleotide sequence according to any one of the nucleotide sequences from *Zea mays* in the Sequence Listing, a nucleotide sequence comprising a coding region that is at least 85% identical to any one of the coding regions nucleotide sequences from *Zea mays* in the Sequence Listing, a nucleotide sequence comprising a coding region of any one of the nucleotide sequences from *Zea mays* in the Sequence Listing, a nucleotide sequence that is complementary to any one of the nucleotide sequences mentioned above, (e) a nucleotide sequence able to inhibit the nucleotide sequences mentioned above, or a nucleotide sequence able to form a hybridized nucleic acid duplex with the nucleic acid according to any one of paragraphs (a)-(d) at a temperature from about 40° C. to about 48° C. below a melting temperature of the hybridized nucleic acid duplex. Preferably, the nucleotide sequence encoding an amino acid sequence is at least 86% identical or at least 87%, 88%, 89%, 90%, 91%, 92%, 93%, 94%, 95%, 96%, 97%, 98% or 99% identical to any one of the polypeptides from *Zea mays* in the Sequence Listing. Likewise, the nucleotide sequence is at least 86% identical or at least 87%, 88%, 89%, 90%, 91%, 92%, 93%, 94%, 95%, 96%, 97%, 98% or 99% identical to any one of the nucleotide sequences from *Zea mays* in the Sequence Listing. Similarly the nucleotide sequence comprising a coding region is at least 86% identical or at least 87%, 88%, 89%, 90%, 91%, 92%, 93%, 94%, 95%, 96%, 97%, 98% or 99% identical to any one of the nucleotide sequences comprising a coding region of any one of the nucleotide sequences from *Zea mays* in the Sequence Listing.

The present invention further embodies a vector comprising a first nucleic acid having a nucleotide sequence encoding a plant transcription and/or translation signal, and a second nucleic acid having a nucleotide sequence according to the isolated nucleic acid molecules of the present invention. More particularly, the first and second nucleic acids may be operably linked. Even more particularly, the second nucleic acid may be endogenous to a first organism, and any other nucleic acid in the vector may be endogenous to a second organism. Most particularly, the first and second organisms may be different species.

In a further embodiment of the present invention, a host cell may comprise an isolated nucleic acid molecule according to the present invention. More particularly, the isolated nucleic acid molecule of the present invention found in the host cell of the present invention may be endogenous to a first organism and may be flanked by nucleotide sequences endogenous to a second organism. Further, the first and second organisms may be different species. Even more particularly, the host cell of the present invention may comprise a vector according to the present invention, which itself comprises nucleic acid molecules according to those of the present invention.

In another embodiment of the present invention, the isolated polypeptides of the present invention may additionally comprise amino acid sequences that are at least 85% identical to any one of the polypeptides in the Sequence Listing.

Other embodiments of the present invention include methods of introducing an isolated nucleic acid of the present invention into a host cell. More particularly, an isolated nucleic acid molecule of the present invention may be contacted to a host cell under conditions allowing transport of the isolated nucleic acid into the host cell. Even more particularly, a vector as described in a previous embodiment of the present invention, may be introduced into a host cell by the same method.

Methods of detection are also available as embodiments of the present invention. Particularly, methods for detecting a nucleic acid molecule according to the present invention in a sample are embodiments of the present invention. More particularly, the isolated nucleic acid molecule according to the present invention may be contacted with a sample under conditions that permit a comparison of the nucleotide sequence of the isolated nucleic acid molecule with a nucleotide sequence of nucleic acid in the sample. The results of such an analysis may then be considered to determine whether the isolated nucleic acid molecule of the present invention is detectable and therefore present within the sample.

A further embodiment of the present invention comprises a plant, plant cell, plant material or seeds of plants comprising an isolated nucleic acid molecule and/or vector of the present invention. More particularly, the isolated nucleic acid molecule of the present invention may be exogenous to the plant, plant cell, plant material or seed of a plant.

A further embodiment of the present invention includes a plant regenerated from a plant cell or seed according to the present invention. More particularly, the plant, or plants derived from the plant, plant cell, plant material or seeds of a plant of the present invention preferably has increased size (in whole or in part), increased vegetative growth, increased organ number and/or increased biomass (sometimes hereinafter collectively referred to as increased biomass), lethality, sterility, improved stress tolerance, or compositional characteristics as compared to a wild-type plant cultivated under identical conditions. Furthermore, the transgenic plant may comprise a first isolated nucleic acid molecule of the present invention, which encodes a protein involved in modulating growth and phenotype characteristics, and a second isolated nucleic acid molecule which encodes a promoter capable of driving expression in plants, wherein the growth and phenotype modulating component and the promoter are operably linked. More preferably, the first isolated nucleic acid may be mis-expressed in the transgenic plant of the present invention, and the transgenic plant exhibits modulated characteristics as compared to a progenitor plant devoid of the nucleic acid, when the transgenic plant and the progenitor plant are cultivated under identical environmental conditions. In another embodiment of the present invention the modulated growth and phenotype characteristics may be due to the inactivation of a particular sequence, using for example an interfering RNA.

A further embodiment relates to a plant, plant cell, plant material or seed of a plant according to the present invention which comprises an isolated nucleic acid molecule of the present invention, wherein the plant, or plants derived from the plant, plant cell, plant material or seed of a plant, has the modulated growth and phenotype characteristics as compared to a wild-type plant cultivated under identical conditions.

Another embodiment of the present invention includes methods of modulating growth and phenotype characteristics in plants. More particularly, these methods comprise transforming a plant with an isolated nucleic acid molecule according to the present invention.

In yet another embodiment, lethality or sterility genes of the invention can be used to control transmission and expression of transgenic traits, thereby facilitating the cultivation of transgenic plants without the undesired transmission of transgenic traits to other plants. Such lethality genes can also be utilized for selective lethality, by combining the lethal gene with appropriate promoter elements for selective expression, to thereby cause lethality of only certain cells or only under certain conditions.

In another aspect, methods of identifying a trait associated polymorphism are provided. The methods include providing a population of corn plants, and determining whether one or more polymorphisms in the population are present within a nucleic acid corresponding to a corn polynucleotide provided in the Sequence Listing. The correlation between variation in the trait in a tissue in plants of the population and the presence of the one or more polymorphisms in plants of the population is measured, thereby permitting identification of the trait associated polymorphism. The trait may be selected from a feature noted in the Sequence Listing for a polypeptide encoded by the corresponding corn polynucleotide.

2. Definitions

The following terms are utilized throughout this application:

Biomass: As used herein, "biomass" refers to useful biological material including a product of interest, which material is to be collected and is intended for further processing to isolate or concentrate the product of interest. "Biomass" may comprise the fruit, or parts of it, or seeds, leaves, or stems or roots where these are the parts of the plant that are of particular interest for the industrial purpose. "Biomass", as it refers to plant material, includes any structure or structures of a plant that contain or represent the product of interest.

Transformation: Examples of means by which this can be accomplished are described below and include *Agrobacterium*-mediated transformation (of dicots (Reference Section 9-10), of monocots (Reference Section 11-13), and biolistic methods (Reference Section 14)), electroporation, in planta techniques, and the like. Such a plant containing the exogenous nucleic acid is referred to here as a $T_o$ for the primary transgenic plant and $T_1$ for the first generation.

Functionally Comparable Proteins or Polynucleotide: This phrase describes a set of proteins that perform similar functions within an organism. By definition, perturbation of an individual protein within that set (through misexpression or mutation, for example) is expected to confer a similar phenotype as compared to perturbation of any other individual protein. Such proteins or polynucleotides typically share sequence similarity resulting in similar biochemical activity. Within this definition, homologs, orthologs and paralogs are considered to be functionally comparable.

Functionally comparable proteins will give rise to the same characteristic to a similar, but not necessarily the same, degree. Typically, comparable proteins give the same characteristics where the quantitative measurement due to one of the comparables is at least 20% of the other; more typically, between 30 to 40%; even more typically, between 50-60%; even more typically between 70 to 80%; even more typically between 90 to 100% of the other.

In some embodiments, the amino acid sequence of a functionally comparable polypeptide has greater than 40% sequence identity (e.g., >40%, >50%, >60%, >70% or >80%, >90%, 91%, >92%, >93%, >94%, >95%, >96%, >97%, >98%, or >99%) to the amino acid sequence of a provided polypeptide. In other embodiments, the nucleotide sequence of a suitable polynucleotide has greater than 40% sequence identity (e.g., >45%, >50%, >55%, >60%, >65%, >70%, >75%, >80%, >90%, >91%, >92%, >93%, >94%, >95%, >96%, >97%, >98%, or >99%) to that of a provided nucleic acid.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence, are considered heterologous to said coding sequence. Elements operatively linked in nature and contiguous to each other are not heterologous to each other. On the other hand, these same elements remain operatively linked but become heterologous if another filler sequence is placed between them. Thus, the promoter and coding sequences of a corn gene expressing an amino acid transporter are not heterologous to each other, but the promoter and coding sequence of a corn gene operatively linked in a novel manner are heterologous.

Misexpression: The term "misexpression" refers to an increase or a decrease in the transcription of a coding region into a complementary RNA sequence as compared to the wild-type. This term also encompasses expression and/or translation of a gene or coding region or inhibition of such transcription and/or translation for a different time period as compared to the wild-type and/or from a non-natural location within the plant genome, including a gene coding region from a different plant species or from a non-plant organism.

Percentage of sequence identity: As used herein, the term "percent sequence identity" refers to the degree of identity between any given query sequence and a subject sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chema et al. (2003) *Nucleic Acids Res.* 31(13): 3497-500.

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For an alignment of multiple nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher website and at the European Bioinformatics Institute website on the World Wide Web.

To determine a percent identity for polypeptide or nucleic acid sequences between a query and a subject sequence, the sequences are aligned using Clustal W and the number of identical matches in the alignment is divided by the query length, and the result is multiplied by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Regulatory Regions: The term "regulatory region" refers to nucleotide sequences that, when operably linked to a sequence, influence transcription initiation or translation initiation or transcription termination of said sequence and the rate of said processes, and/or stability and/or mobility of a transcription or translation product. As used herein, the term "operably linked" refers to positioning of a regulatory region and said sequence to enable said influence. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns. Regulatory regions can be classified in two categories, promoters and other regulatory regions.

Stringency: "Stringency," as used herein is a function of nucleic acid molecule probe length, nucleic acid molecule probe composition (G+C content), salt concentration, organic solvent concentration and temperature of hybridization and/or wash conditions. Stringency is typically measured by the parameter $T_m$, which is the temperature at which 50% of the complementary nucleic acid molecules in the hybridization assay are hybridized, in terms of a temperature differential from $T_m$. High stringency conditions are those providing a condition of $T_m$-5° C. to $T_m$-10° C. Medium or moderate stringency conditions are those providing $T_m$-20° C. to $T_m$-29° C. Low stringency conditions are those providing a condition of $T_m$-40° C. to $T_m$-48° C. The relationship between hybridization conditions and $T_m$ (in ° C.) is expressed in the mathematical equation:

$$T_m = 81.5 - 16.6(\log_{10}[Na^+]) + 0.41(\% \text{ G+C}) - (600/N) \quad (I)$$

where N is the number of nucleotides of the nucleic acid molecule probe. This equation works well for probes 14 to 70 nucleotides in length that are identical to the target sequence. The equation below, for $T_m$ of DNA-DNA hybrids, is useful for probes having lengths in the range of 50 to greater than 500 nucleotides, and for conditions that include an organic solvent (formamide):

$$T_m = 81.5 + 16.6 \log \{[Na^+]/(1+0.7[Na^+])\} + 0.41(\% \text{ G+C}) - 500/L \cdot 0.63(\% \text{ formamide}) \quad (II)$$

where L represents the number of nucleotides in the probe in the hybrid (Bonner et al. (1973) *J. Mol. Biol.* 81:123). The $T_m$ of Equation II is affected by the nature of the hybrid: for DNA-RNA hybrids, $T_m$ is 10-15° C. higher than calculated; for RNA-RNA hybrids, $T_m$ is 20-25° C. higher. Because the $T_m$ decreases about 1° C. for each 1% decrease in homology when a long probe is used (Frischauf et al. (1983) *J. Mol. Biol,* 170: 827-842), stringency conditions can be adjusted to favor detection of identical genes or related family members.

Equation II is derived assuming the reaction is at equilibrium. Therefore, hybridizations according to the present invention are most preferably performed under conditions of probe excess and allowing sufficient time to achieve equilibrium. The time required to reach equilibrium can be shortened by using a hybridization buffer that includes a hybridization accelerator such as dextran sulfate or another high volume polymer.

Stringency can be controlled during the hybridization reaction, or after hybridization has occurred, by altering the salt and temperature conditions of the wash solutions. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

$T_0$: The term "$T_0$" refers to the whole plant, explant or callus tissue, inoculated with the transformation medium.

$T_1$: The term $T_1$ refers to either the progeny of the $T_0$ plant, in the case of whole-plant transformation, or the regenerated seedling in, the case of explant or callous tissue transformation.

$T_2$: The term $T_2$ refers to the progeny of the $T_1$ plant. $T_2$ progeny are the result of self-fertilization or cross-pollination of a $T_1$ plant.

$T_3$: The term $T_3$ refers to second generation progeny of the plant that is the direct result of a transformation experiment. $T_3$ progeny are the result of self-fertilization or cross-pollination of a $T_2$ plant.

3. Important Characteristics of the Polynucleotides and Polypeptides of the Invention The nucleic acid molecules and polypeptides of the present invention are of interest for a number of reasons. For example, in many cases when the nucleic acid molecules are mis-expressed (i.e., when expressed at a non-natural location or in an increased or decreased amount relative to wild-type) they produce plants that exhibit modulated growth and phenotype characteristics as compared to wild-type plants. This trait can be used to exploit or maximize plant products. For example, the nucleic acid molecules and polypeptides of the present invention can be used to increase the expression of genes that cause the plant to have modulated growth and phenotype characteristics.

For many of the provided sequences, one of skill in the art would find them useful in a modified format, such as with substitutions, insertions, or deletions of specific residues, which could be guided by analysis of similar sequences that are readily available from public sources.

Because some of the disclosed sequences and methods increase vegetative growth, the disclosed methods can be used to enhance biomass production. For example, plants that grow vegetatively have an increase in biomass production, compared to a plant of the same species that is not genetically modified for substantial vegetative growth. Examples of increases in biomass production include increases of at least 5%, at least 10%, at least 20%, at least 50%, or even at least 75%, when compared to an amount of biomass production by a plant of the same species not genetically modified.

The life cycle of flowering plants in general can be divided into three growth phases: vegetative, inflorescence, and floral (late inflorescence phase). In the vegetative phase, the shoot apical meristem (SAM) generates leaves that later will ensure the resources necessary to produce fertile offspring. Upon receiving the appropriate environmental and developmental signals the plant switches to floral, or reproductive, growth and the SAM enters the inflorescence phase (I) and gives rise to an inflorescence with flower primordia. During this phase the fate of the SAM and the secondary shoots that arise in the axils of the leaves is determined by a set of meristem identity genes, some of which prevent and some of which promote the development of floral meristems. Once established, the plant enters the late inflorescence phase (Reference Section 12) where the floral organs are produced. If the appropriate environmental and developmental signals for floral, or reproductive, growth are disrupted, the plant will not be able to enter reproductive growth, therefore maintaining vegetative growth and increasing overall biomass.

As more and more transgenic plants are developed and introduced into the environment, it can be important to control the undesired spread of the transgenic triat(s) from transgenic plants to other traditional and transgenic cultivars, plant species and breeding lines, thereby preventing cross-contamination. Such genetic confinement systems (also called biocontainment applications) can be designed using a number of different technical strategies. The use of a conditionally lethal gene, i.e. one which results in plant cell death under certain conditions, has been suggested as a means to selectively kill plant cells containing a recombinant DNA (see e.g., WO 94/03619 and US patent publication 20050044596A1). The use of genes to control transmission and expression of transgenic traits is also described in US patent publication 20050257293A1, which is hereby incorporated by reference.

Some of the nucleotides of the invention are lethal genes, and can therefore be used as conditionally lethal genes, namely lethal genes to be expressed in response to specific conditions, or in specific plant cells. For example, a gene that encodes a lethal trait can be placed under the control of a tissue specific promoter, or under the control of a promoter that is induced in response to specific conditions, for example, a specific chemical trigger, or specific environmental conditions. In some embodiments, biocontainment can be achieved by modulating the expression of genes that affect, for example, inflorescence development, flowering time, plant architecture, rhizome development, gamete development, embryo development, or seed viability.

Male or female sterility genes can also be used to control the spread of certain germplasm, such as by selective destruction of tissue, such as of the tapetum, by fusing such a gene to a tapetum-specific promoter such as TA29. Further examples of such promoters are described below.

The sequences of the invention can be used to advantageously manipulate plant characteristics in traits such as size (in whole or in part), vegetative growth, increased organ number and/or increased biomass (sometimes hereinafter collectively referred to as increased biomass), lethality, sterility, apomixix, cleistogamy, stress tolerance, or compositional characteristics as compared to a wild-type plant cultivated under identical conditions. Furthermore, the sequences of the invention can be used to advantageously manipulate plant characteristics such as architecture, biomass, development, composition, conversion efficiency, energy output, confinement, nitrogen use, nutrient uptake, phosphate use, photosynthetic capacity, shade avoidance, cold tolerance, drought tolerance, water use efficiency, stress tolerance, vigor, flowering time and yield to maximize the benefits of energy crops and other economically important crops depending on the benefit sought and the particular environment in which the crop must grow. These molecules may be from the plant itself, and simply expressed at a higher or lower level, or the molecules may be from different plant species or synthetic.

The sequences of the invention can be applied to substrates for use in array applications such as, but not limited to, assays of global gene expression, under varying conditions of development, and growth conditions. The arrays are also used in diagnostic or forensic methods.

The polynucleotides of the invention are also used to create various types of genetic and physical maps of the genome of corn plants. Some are absolutely associated with particular phenotypic traits, allowing construction of gross genetic maps. Creation of such maps is based on differences or variants, generally referred to as polymorphisms, between different parents used in crosses. Common methods of detecting polymorphisms that can be used are restriction fragment length polymorphisms (RFLPs, single nucleotide polymorphisms (SNPs) or simple sequence repeats [(SSRs), also called microsatellites].

The sequence information disclosed herein can be useful in breeding of corn plants. Based on the information in the Sequence Listing, one can search for and identify polymorphisms linked to genetic loci for such polypeptides. As those of skill in the art appreciate, polymorphisms can be identified based on characterization of libraries, such as genomic or expression libraries, and/or characterization of nucleic acids extracted from individual plants, and possibly amplified and/or otherwise processed. For example, the nucleotide sequences provided in the Sequence Listing can serve for design of primers for amplification of nucleic acids and polymorphism characterization. As such, polymorphisms may be found in coding regions or untranslated regions of polynucleotides presented in the Sequence Listing, or they may be found within the locus for a disclosed sequence. Polymorphisms that can be identified include simple sequence repeats (SSRs), rapid amplification of polymorphic DNA (RAPDs), amplified fragment length polymorphisms (AFLPs) and restriction fragment length polymorphisms (RFLPs), as described below. If a polymorphism is identified, its presence and frequency in populations is analyzed to determine if it is statistically significantly correlated to a trait, such as the trait noted in the Sequence Listing. Those polymorphisms that are correlated with a trait can be incorporated into a marker assisted breeding program to facilitate the development of lines that have a desired alteration the respective trait. Typically, a polymorphism identified in such a manner is used with polymorphisms at other loci that are correlated with the same trait.

The use of RFLPs and of recombinant inbred lines for such genetic mapping is described for *Arabidopsis* by Alonso-Blanco et al. (*Methods in Molecular Biology*, vol. 82, "*Arabidopsis Protocols*", pp. 137-146, J. M. Martinez-Zapater and J. Salinas, eds., c. 1998 by Humana Press, Totowa, N.J.) and for corn by Burr ("Mapping Genes with Recombinant Inbreds", pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) Genetics 134: 917). This procedure, however, is not limited to plants and is used for other organisms (such as yeast) or for individual cells.

The polynucleotides of the present invention are also used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping is achieved using various methods. In one instance, polymorphisms are identified when sequence specific probes contained within a polynucleotide flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms are identified by using the PCR fragment produced from the SSR-flanking sequence specific primer reaction as a probe against Southern blots representing different individuals (U. H. Refseth et al., (1997) *Electrophoresis* 18: 1519).

The polynucleotides of the invention can further be used to identify certain genes or genetic traits using, for example, known AFLP technologies, such as in EP0534858 and U.S. Pat. No. 5,878,215.

The polynucleotides of the present invention are also used for single nucleotide polymorphism (SNP) mapping.

The polynucleotides of the invention can be used with the various types of maps discussed above to identify Quantitative Trait Loci (QTLs). Many important crop traits, such as the solids content of tomatoes, are quantitative traits and result from the combined interactions of several genes. These genes reside at different loci in the genome, often times on different chromosomes, and generally exhibit multiple alleles at each locus. The polynucleotides of the invention are used to identify QTLs and isolate specific alleles as described by de Vicente and Tanksley (*Genetics* (1993) 134:585). Once a desired allele combination is identified, crop improvement is accomplished either through biotechnological means or by directed conventional breeding programs (for review see Tanksley and McCouch (1997) *Science* 277:1063). In addition to isolating QTL alleles in present crop species, the polynucleotides of the invention are also used to isolate alleles from the corresponding QTL of wild relatives.

In addition, the polynucleotides of the present invention can be used for marker assisted breeding. Marker assisted breeding uses genetic fingerprinting techniques to assist plant breeders in matching a molecular profile to the physical properties of a variety. This allows plant breeders to significantly accelerate the speed of natural plant breeding programs. Marker assisted breeding also allows better retention of sequences that participate in QTLs.

Following the procedures described above and using a plurality of the polynucleotides of the present invention, any individual can be genotyped. These individual genotypes are used for the identification of particular cultivars, varieties, lines, ecotypes and genetically modified plants or can serve as tools for subsequent genetic studies directed towards the improvement of multiple phenotypic traits.

4. The Sequences of the Invention

Polynucleotides of the present invention and proteins expressed via translation of these polynucleotides are set forth in the Sequence Listing, specifically the polynucleotides from *Zea mays* (SEQ ID NOs: 1 to 96,846). The Sequence Listing also provides annotations which are indicative of use(s) for which the sequences can be utilized; for example, to make transgenic plants with modulated growth and phenotype characteristics, including ornamental, biomass and seed yield, confinement, stress tolerance, ornamental and/or compositional characteristics.

5. Use of the Sequences to Make Transgenic Plants

To use the sequences of the present invention or a combination of them or parts and/or mutants and/or fusions and/or variants of them, recombinant DNA constructs are prepared that comprise the polynucleotide sequences of the invention inserted into a vector and that are suitable for transformation of plant cells. The construct can be made using standard recombinant DNA techniques (see, Sambrook et al., Molecular Cloning: A Laboratory Manual, Second Edition, Cold Spring Harbor Laboratory Press (1989) New York) and can be introduced into the plant species of interest by, for example, *Agrobacterium*-mediated transformation, or by other means of transformation, for example, as disclosed below.

The vector backbone may be any of those typically used in the field such as plasmids, viruses, artificial chromosomes, BACs, YACs, PACs and vectors such as, for instance, bacteria-yeast shuttle vectors, lamda phage vectors, T-DNA fusion vectors and plasmid vectors (see References section 17-24).

Typically, the construct comprises a vector containing a nucleic acid molecule of the present invention with any desired transcriptional and/or translational regulatory sequences such as, for example, promoters, UTRs, and 3' end termination sequences. Vectors may also include, for example, origins of replication, scaffold attachment regions (SARs), markers, homologous sequences, and introns. The vector may also comprise a marker gene that confers a selectable phenotype on plant cells. The marker may preferably encode a biocide resistance trait, particularly antibiotic resistance, such as resistance to, for example, kanamycin, bleomycin, or hygromycin, or herbicide resistance, such as resistance to, for example, glyphosate, chlorsulfuron or phosphinothricin.

It will be understood that more than one regulatory region may be present in a recombinant polynucleotide, e.g., introns, enhancers, upstream activation regions, transcription termi-nators, and inducible elements. Thus, more than one regulatory region can be operably linked to said sequence.

To "operably link" a promoter sequence to a sequence, the translation initiation site of the translational reading frame of said sequence is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene (Fromm et al. (1989) *Plant Cell* 1:977-984).

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

The choice of promoters to be included depends upon several factors, including, but not limited to, efficiency, selectability, inducibility, desired expression level, and cell- or tissue-preferential expression. It is a routine matter for one of skill in the art to modulate the expression of a sequence by appropriately selecting and positioning promoters and other regulatory regions relative to said sequence.

Some suitable promoters initiate transcription only in, or predominantly in, certain cell types. For example, a promoter that is active predominantly in a reproductive tissue (e.g., fruit, ovule, pollen, pistils, female gametophyte, egg cell, central cell, nucellus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano, et al. (1989) *Plant Cell* 1:855-866; Bustos et al. (1989) *Plant Cell* 1:839-854; Green et al. (1988) *EMBO J.* 7: 4035-4044; Meier et al. (1991) *Plant Cell* 3: 309-316; and Zhang et al. (1996) *Plant Physiology* 110: 1069-1079.

Examples of various classes of regulatory regions are described below. Some properties of the regulatory regions indicated below, as well as additional regulatory regions, are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/034308; and PCT/US05/23639. Specifically, the sequences of regulatory regions p326, YP0144, YP0190, p13879, YP0050, p32449, 21876, YP0158, YP0214, YP0380, PT0848, PT0633 YP0128, YP0275, PT0660, PT0683, PT0758, PT0613, PT0672, PT0837, YP0092, PT0676, PT0708, YP0396, YP0007, YP0111, YP0103, YP0028, YP0121, YP0008, YP0039, YP0115, YP0119, YP0120, YP0374, YP0039, YP0101, YP0102, YP0110, YP0117, YP0119, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, YP0374, PT0710, YP0356, YP0385, YP0396, YP0384, PT0688, YP0286, YP0377, PD1367, PT0863, PT0829, PT0665, PT0678, YP0086, YP0188, YP0263, PT0758, PT0743, PT0829, YP0119, and YP0096 are set forth in the Sequence Listing of PCT/US06/040572; the sequence of regulatory region PT0625 is set forth in the Sequence Listing of PCT/US05/034343; the sequences of regulatory regions PT0623, YP0388, YP0087, YP0093, YP0108, YP0022, and YP0080 are set forth in the Sequence Listing of U.S. patent application Ser. No. 11/172,703; the sequence of regulatory region PR0924 is set forth in the Sequence Listing of PCT/US07/62762; and the sequences of regulatory regions p530c10, pOsFIE2-2, pOsMEA, pOsYp102, and pOsYp285 are set forth in the Sequence Listing of PCT/US06/038236. It will be appreciated that a regulatory region may meet criteria for one classification based on its activity in one plant species, and yet meet criteria for a different classification based on its activity in another plant species.

Broadly Expressing Promoters: A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort Mosaic virus 34S promoter, actin promoters such as the rice actin promoter, and ubiquitin promoters such as the maize ubiquitin-1 promoter. In some cases known to those of skill in the art, the CaMV 35S promoter is excluded from the category of broadly expressing promoters.

Root Promoters: Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters: In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.*, 13:5829-5842 (1993)), the beta-amylase promoter, and the barley hordein promoter. Other maturing endosperm promoters include the YP0092, PT0676, and PT0708 promoters.

Ovary Tissue Promoters: Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

Embryo Sac/Early Endosperm Promoters: To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters. Promoters that may be suitable include those derived from the following genes: *Arabidopsis* viviparous-1 (see, GenBank No. U93215); *Arabidopsis* atmycl (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

Embryo Promoters: Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1)

promoter (*Plant Cell Rep* (2001) 20:647-654), YP0097, YP0107, YP0088, YP0143, YP0156, PT0650, PT0695, PT0723, PT0838, PT0879, and PT0740.

Photosynthetic Tissue Promoters: Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

Vascular Tissue Promoters: Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

Inducible Promoters: Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, and PD1367. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

Basal Promoters: A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters: Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

Other Regulatory Regions: A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence. It will be understood that more than one regulatory region may be present in a recombinant polynucleotide, e.g., introns, enhancers, upstream activation regions, transcription terminators, and inducible elements.

Alternatively, misexpression can be accomplished using a two component system, whereby the first component consists of a transgenic plant comprising a transcriptional activator operatively linked to a promoter and the second component consists of a transgenic plant that comprises a nucleic acid molecule of the invention operatively linked to the target-binding sequence/region of the transcriptional activator. The two transgenic plants are crossed and the nucleic acid molecule of the invention is expressed in the progeny of the plant (US patent publication 20050257293A1). In another alternative embodiment of the present invention, the misexpression can be accomplished by having the sequences of the two component system transformed in one transgenic plant line.

Another alternative consists of inhibiting expression of a growth or phenotype-modulating polypeptide in a plant species of interest. The term "expression" refers to the process of converting genetic information encoded in a polynucleotide into RNA through transcription of the polynucleotide (i.e., via the enzymatic action of an RNA polymerase), and into protein, through translation of mRNA. "Up-regulation" or "activation" refers to regulation that increases the production of expression products relative to basal or native states, while "down-regulation" or "repression" refers to regulation that decreases production relative to basal or native states. Thus, in some embodiments, the isolated nucleic acids are inhibitory to the expression of sequences provided in the Sequence Listing.

A number of nucleic-acid based methods, including antisense RNA, ribozyme directed RNA cleavage, and interfering RNA (RNAi) can be used to inhibit expression in plants. Antisense technology is one well-known method. In this method, a nucleic acid segment from the endogenous gene is cloned and operably linked to a promoter so that the antisense strand of RNA is transcribed. The recombinant vector is then transformed into plants, as described above, and the antisense strand of RNA is produced. The nucleic acid segment need not complement the entire sequence of the endogenous gene to be repressed, but typically will be substantially identical to at least a portion of the endogenous gene to be repressed. Generally, higher homology can be used to compensate for the use of a shorter sequence. Typically, a sequence of at least 30 nucleotides is used (e.g., at least 40, 50, 80, 100, 200, 500 nucleotides or more).

Thus, for example, an isolated nucleic acid provided herein can be an antisense nucleic acid to one of the aforementioned nucleic acids encoding a growth or phenotype-modulating polypeptide. A nucleic acid that decreases the level of a transcription or translation product of a gene encoding a growth or phenotype-modulating polypeptide is transcribed into an antisense nucleic acid, or complementary to the coding sequence of the growth or phenotype-modulating polypeptide in the Sequence Listing. Alternatively, the transcription product of an isolated nucleic acid can be similar or complementary to the coding sequence of a growth or phenotype-modulating polypeptide in the Sequence Listing, but is an RNA that is unpolyadenylated, lacks a 5' cap structure, or contains an unsplicable intron.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman, et al. (1995) *Proc. Natl. Acad. Sci. USA*, 92(13):6175-6179; de Feyter and Gaudron, *Methods in Molecular Biology*, Vol. 74, Chapter 43, "Expressing Ribozymes in Plants", Edited by Turner, P. C, Humana Press Inc., Totowa, N.J. RNA endoribonucleases such as the one that occurs naturally in *Tetrahymena thermophila*, and which have been described extensively by Cech and collaborators can be useful. See, for example, U.S. Pat. No. 4,987,071.

Methods based on RNA interference (RNAi) can be used. RNA interference is a cellular mechanism to regulate the expression of genes and the replication of viruses. This mechanism is thought to be mediated by double-stranded small interfering RNA molecules. A cell responds to such a double-stranded RNA by destroying endogenous mRNA having the same sequence as the double-stranded RNA. Methods for designing and preparing interfering RNAs are known to those of skill in the art; see, e.g., WO 99/32619 and WO 01/75164. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of the growth or phenotype-modulating polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller (1997) *Antisense Nucleic Acid Drug Dev.*, 7:187-195; Hyrup et al. (1996) *Bioorgan. Med. Chem.*, 4: 5-23. In addition, the deoxyphosphate backbone can be replaced with, for example, a phosphorothioate or phosphorodithioate backbone, a phosphoroamidite, or an alkyl phosphotriester backbone.

In some cases, expression of a polypeptide of the invention inhibits one or more functions of an endogenous polypeptide. For example, a nucleic acid that encodes a dominant negative polypeptide can be used to inhibit gene function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation Transformation Nucleic acid molecules of the present invention may be introduced into the genome or the cell of the appropriate host plant by a variety of techniques. These techniques, able to transform a wide variety of higher plant species, are well known and described in the technical and scientific literature (see, e.g., Reference Section 28-29).

A variety of techniques known in the art are available for the introduction of DNA into a plant host cell. These techniques include transformation of plant cells by injection (Reference Section 30), microinjection (Reference Section 31), electroporation of DNA (Reference Section 32), PEG (Reference Section 33), use of biolistics (Reference Section 34), fusion of cells or protoplasts (Reference Section 35), and via T-DNA using *Agrobacterium tumefaciens* (Reference Section 36-37) or *Agrobacterium rhizogenes* (Reference Section 38) or other bacterial hosts (Reference Section 39), for example.

In addition, a number of non-stable transformation methods that are well known to those skilled in the art may be desirable for the present invention. Such methods include, but are not limited to, transient expression (Reference Section 40) and viral transfection (Reference Section 41).

Seeds are obtained from the transformed plants and used for testing stability and inheritance. Generally, two or more generations are cultivated to ensure that the phenotypic feature is stably maintained and transmitted.

A person of ordinary skill in the art recognizes that after the expression cassette is stably incorporated in transgenic plants and confirmed to be operable, it can be introduced into other plants by sexual crossing. Any of a number of standard breeding techniques can be used, depending upon the species to be crossed.

Some of the methods according to the present invention can be applied to any plant, preferably higher plants, pertaining to the classes of *Angiospermae* and *Gymnospermae*. Plants of the subclasses of the *Dicotylodenae* and the *Monocotyledonae* are particularly suitable. Suitable species may come from the family Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caiyophyll aceae, Cephalotaxaceae, Chenopodiaceae, Colchicaceae, Cucurbitaceae, Dioscoreaceae, Ephedraceae, Erythroxyl aceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, and Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis*, and *Zea*.

The methods of the present invention are preferably used in plants that are important or interesting for agriculture, horticulture, biomass for the production of liquid fuel molecules and other chemicals, and/or forestry. Non-limiting examples include, for instance, *Zea mays* (corn), *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Arundo donax* (giant reed), *Secale cereale* (rye), *Salix* spp. (willow), *Eucalyptus* spp. (eucalyptus), *Triticosecale* spp. (triticum—wheat X rye), Bamboo, *Carthamus tinctorius* (safflower), *Jatropha curcas* (jatropha), *Ricinus communis* (castor), *Elaeis guineensis* (palm), *Linum usitatissimum* (flax), *Brassica juncea, Manihot esculenta* (cassava), *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (petunia), *Poinsettia pulcherrima* (poinsettia), *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass), *Phleum pratense* (timothy), and conifers. Of interest are plants grown for energy production, so called energy crops, such as cellulose-based energy crops like *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (triticum—wheat X rye), and Bamboo; and starch-based energy crops like *Zea mays* (corn) and *Manihot esculenta* (cassaya); and sucrose-based energy crops like *Saccharum* sp. (sugarcane) and *Beta vulgaris* (sugarbeet); and biodiesel-producing energy crops like *Glycine max* (soybean), *Brassica napus* (canola), *Helianthus annuus* (sunflower), *Carthamus tinctorius* (safflower), *Jatropha curcas* (jatropha), *Ricinus communis* (castor), Elaeis guineensis (palm), *Linum usitatissimum* (flax), and *Brassica juncea*. Thus, the described materials and methods are useful for modifying biomass characteristics, such as characteristics of biomass renewable energy source plants. A biomass renewable energy source plant is a plant having or producing material (either raw or processed) that comprises stored solar energy that can be converted to electrical energy, liquid fuels, and other useful chemicals. In general terms, such plants comprise dedicated energy crops as well as agricultural and woody plants. Examples of biomass renewable energy source plants include: *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (triticum—wheat X rye), Bamboo, *Zea mays* (corn), *Manihot esculenta* (cassaya), *Saccharum* sp. (sugarcane), *Beta vulgaris* (sugarbeet), *Glycine max* (soybean), *Brassica napus* (canola), *Helianthus annuus* (sunflower), *Carthamus tinctorius* (safflower), Jatropha curcas (jatropha), *Ricinus communis* (castor), Elaeis guineensis (palm), *Linum usitatissimum* (flax), and *Brassica juncea*.

Homologues Encompassed by the Invention

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Nucleic acid molecules of the present invention can comprise sequences that differ from those encoding a protein or fragment thereof selected from the group consisting of the nucleotide sequences in the Sequence Listing due to the fact that the different nucleic acid sequence encodes a protein having one or more conservative amino acid changes.

Biologically functional equivalents of the polypeptides, or fragments thereof, of the present invention can have about 10 or fewer conservative amino acid changes, more preferably about 7 or fewer conservative amino acid changes, and most preferably about 5 or fewer conservative amino acid changes. In a preferred embodiment of the present invention, the polypeptide has between about 5 and about 500 conservative changes, more preferably between about 10 and about 300 conservative changes, even more preferably between about 25 and about 150 conservative changes, and most preferably between about 5 and about 25 conservative changes or between 1 and about 5 conservative changes.

Identification of Useful Nucleic Acid Molecules and Their Corresponding Nucleotide Sequences Some of the nucleic acid molecules and nucleotide sequences thereof of the present invention were identified as functional homologs of other sequences of established function and utility. The other sequences and their established function come from public and/or proprietary sources. For example, in some cases the properties of these sequences were established by use of a variety of screens that are predictive of nucleotide sequences that provide plants with altered size, vegetative growth, organ number, plant architecture, biomass, and/or enhanced resistance to various abiotic or biotic stresses. In other cases, characteristics of similar sequences are known from scientific and technical literature readily accessible to those of skill in the art.

Functional homologs/orthologs from *Zea mays* may be found for a gene of interest, which in many cases may be capable of modulating growth and phenotype characteristic when transformed in plants. The "Determination of Functional Homolog/Ortholog Sequences" process described below can be used to identify functional homologs/orthologs. Functional homologs/orthologs of a sequence of interest are understood to affect similar phenotype(s) as observed for the respective sequence of interest when their expression is modulated in plants.

Determination of Functional Homolog/Ortholog Sequences

A subject sequence is considered a functional homolog or ortholog of a query sequence if the subject and query sequences encode proteins having a similar function and/or activity. A process known as Reciprocal BLAST (Rivera et al., *Proc. Natl. Acad. Sci. USA*, 95:6239-6244 (1998)) can be used, for many of the sequences provided, to identify potential functional homolog and/or ortholog sequences from a database consisting of peptide sequences from *Zea mays*.

Before starting a Reciprocal BLAST process, a specific query polypeptide is searched against all peptides from its source species using BLAST in order to identify polypeptides having BLAST sequence identity of 80% or greater to the query polypeptide and an alignment length of 85% or greater along the shorter sequence in the alignment. The query polypeptide and any of the aforementioned identified polypeptides are designated as a cluster.

The BLASTP version 2.0 program from Washington University at Saint Louis, Mo., USA is used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity is calculated based on the alignment of the first BLAST HSP (High-scoring Segment Pairs) of the identified potential functional homolog and/or ortholog sequence with a specific query polypeptide. The number of identically matched residues in the BLAST HSP alignment is divided by the HSP length, and then multiplied by 100 to get the BLAST sequence identity. The HSP length typically includes gaps in the alignment, but in some cases gaps can be excluded.

The main Reciprocal BLAST process consists of two rounds of BLAST searches; forward search and reverse search. In the forward search step, a query polypeptide sequence, "polypeptide A," from source species SA (such as *Arabidopsis*) is BLASTed against all Ceres-Inc. proprietary peptide sequences from *Zea mays*. Top hits are determined using an E-value cutoff of $10^{-5}$ and a sequence identity cutoff of 35%. Among the top hits, the sequence having the lowest E-value is designated as the best hit, and considered a potential functional homolog or ortholog. Any other top hit that has a high BLAST sequence identity to the best hit or to the original query polypeptide is considered a potential functional homolog or ortholog as well.

In the reverse search round, the top hits identified in the forward search from *Zea mays* are BLASTed against all protein sequences from the source species SA. A top hit from the forward search that returns a polypeptide from the aforementioned cluster as its best hit is also considered as a potential functional homolog or ortholog.

Functional homologs and/or orthologs are identified by manual inspection of potential functional homolog and/or ortholog sequences. In some cases identification is based on known correlations between sequence domains and functions for specific classes of biomolecules. Furthermore, functional homologs can also be identified using known orthology detection methods. See Li L, Stoeckert C J Jr., Roos D S (2003) OrthoMCL: identification of ortholog groups for eukaryotic genomes. Genome Res 13: 2178-2189; Chen F, Mackey A J, Vermunt J K, Roos DS (2007) Assessing Performance of Orthology Detection Strategies Applied to Eukaryotic Genomes. PLos ONE 2(4): e383.

Information in the Sequence Listing

Many of the corn sequences provided in the Sequence Listing are annotated to indicate one or several potential applications of the respective sequences. Some sequences are enzymes, i.e. catalysts of specific chemical or biochemical reactions, and their activity is indicated by enzyme classification (EC) numbers. The EC numbers used in the Sequence Listing correspond to the swissprot enzyme classification system, as found for example at www.expasy.ch. Some sequences contain "pfam" domains which are indicative of particular applications. The specific pfam domains are described in more detail by various sources, such as http://www.sanger.ac.uk/ or http://pfam.janelia.org.

Some corn sequences in the Sequence Listing are annotated in the "miscellaneous features" section as functional homologs of known sequences, and associated traits that could be modulated by the respective sequences in transgenic plants. Known sequence-function associations are sometimes based at least in part on literature documentation. In some cases, the known query sequences are not reproduced in the Sequence Listing, but are identified by literature reference, such as by reference to specific sequences in patent publications or *Arabidopsis* locus numbers. If desired, sequence information for these designations may be obtained from various sources, such as the EMBL sequence databse or http://www.arabidopsis.org. In some cases, query sequences such as SEQ ID NOs: 96847-96889 are provided in the Sequence Listing, along with information pertinent to observed transgenic plant traits. When a listed query sequence is a truncation of a known coding region, those of skill in the art could design if necessary an equivalent truncation of the corresponding corn functional homologs to obtain the indicated phenotype.

Modulated growth and phenotype characteristics for some of the sequences of the invention are noted by entries in the "miscellaneous feature" section for the respective nucleic acid and/or polypeptide sequence in the Sequence Listing. Valuable applications of the respective sequences are also sometimes noted in the Sequence Listing. In many cases, traits were originally associated with known sequences by misexpression or other transgenic or genetic interference with specific gene functions. For some sequences, plants were transformed with the genes of interest and screened for modulated morphological characteristics, as described, for example in PCT/US2005/023326 or PCT/US2005/047099. When applicable, phenotypic observations for transformants are noted in the Sequence Listing. For some sequences, transgenic trait associations were suggested by results of screening transgenic plants for tolerance to specific stress conditions. Screening procedures and some results are exemplified in PCT/US2005/018950, PCT/US2005/018912, PCT/US2005/014197, or PCT/US2006/040572. Other methods are exemplified by references cited in the Sequence Listing or below.

From the disclosure of the Sequence Listing, it can be seen that the nucleotides and polypeptides of the inventions are often useful, depending upon the respective individual sequence, to make plants with one or more altered characteristics in traits. For example, the sequences can be used, as noted in the Sequence Listing for the respective sequences, for biocontainment applications, for making plants with modified alkaloid content, amino acid content, carbohydrate content, carbon content, carotene content, cell wall content and/or composition, glycerol content, nitrogen content, oil content, protein content, tocopherol content, enhanced nutritional value, aluminum sensitivity, abiotic stress sensitivity, abscission, biomass, biotic stress sensitivity, carbon-nitrogen partitioning, cold sensitivity, drought sensitivity, flowering time, growth rate, heat sensitivity, herbicide sensitivity, high pH sensitivity, light quality response, light quality sensitivity, light response, light sensitivity, low iron sensitivity, low light sensitivity, nitrogen use efficiency, oxidative stress sensitivity, phosphate use efficiency, plant growth and development, root development, salt sensitivity, seed content, seed number, seedling growth, silicon content, time to senescence, UV sensitivity, water use efficiency, and yield.

Nucleotides and polypeptides that are useful for modulating plant characteristics in traits such as sterility, lethality and/or viability have been noted as "useful for biocontainment applications" or "useful for making plants with modulated asexual embryo production" in the Sequence Listing. Nucleotides and polypeptides with this designation include those that are able to confer one or more of the following phenotypes, relative to wild-type control, when mis-expressed in plants: increase or decrease number of floral organs; alter floral organ type; reduce fertility; sterility, including female-sterility and/or male-sterility; alter how leaves emerge from the meristem; cause low/no seed germination; and reduce plant viability (e.g. albino plants and plants with vitrified leaves). The ability to modulate sterility, lethality, and/or viability is important in developing a genetic confinement system designed to reduce or prevent gene flow from transgenic pants to commercial crops and wild-type counterparts; making ornamental plants; and for other agricultural and/or horticultural purposes. Nucleotides and polynucleotides useful for developing a genetic confinement system can be utilized by procedures known to those skilled in the art, such as in US2005/0257293 A1, hereby incorporated by reference.

Some nucleotides and polypeptides are noted as being "useful for making plants with modulated biomass", "useful for making plants with modulated yield", "useful for making plants with modulated flowering time", "useful for making plants with modulated seed size", "useful for making plants with modulated time to senescence", "useful for making plants with modulated endosperm cell number", "useful for making plants with modulated endosperm cell size", "useful for making plants with modulated endosperm size", "useful for making plants with modulated growth rate", "useful for making plants with modulated seed content", "useful for making plants with modulated seed number", "useful for making plants with modulated seed quality", "useful for making plants with modulated plant growth and development" or "useful for making plants with modulated seedling growth" in the Sequence Listing. Nucleotides and polypeptides that have been given these designations include those that are able to confer one or more of the following phenotypes, relative to wild-type control, when mis-expressed in plants: increased or decreased plant size; increased or decreased plant height; increased or decreased leaf size; altered leaf shape; altered leaf structure; increased or decreased number of leaves; increased or decreased organ size; altered organ shape; increased or decreased organ number; increased or decreased branching length; increased or decreased branch number; increased or decreased petal abscission; increased or decreased leaf abscission; increased or decreased apical dominance; and increased or decreased hypocotyl length. Altering plant biomass is valuable for increasing plant biomass produced per acre of arable land, increasing crop yield per acre of arable land, utilizing plants as chemical factories to produce valuable pharmaceutical compounds, developing a genetic confinement system designed to reduce or prevent gene flow from transgenic plants to commercial crops and wild-type counterparts, making ornamental plants; and for other agricultural and/or horticultural purposes.

Some nucleotides and polypeptides that are useful for modulating plant characteristics in traits such as the composition of a plant, plant material, plant tissue, plant cell and seed from a plant include those that have been given the designations "useful for making plants with altered alkaloid content", "useful for making plants with altered carbon content", "useful for making plants with modulated carbon-nitrogen partitioning", "useful for making plants with altered carotene content", "useful for making plants with modulated carbohydrate content", "useful for making plants with altered carbohydrate content", "useful for making plants with altered cell wall content and/or composition", "useful for making plants with altered glycerol content", "useful for making plants with altered lignin content", "useful for making plants with altered lutein content", "useful for making plants with altered lycopene content", "useful for making plants with altered nitrogen content", "useful for making plants with altered oil content", "useful for making plants with altered protein content", "useful for making plants with altered amino acid content", "useful for making plants with altered sterol content", "useful for making plants with altered terpenoid content", "useful for making plants with altered tocopherol content", "useful for making plants with modulated silicon content", or "useful for making plants with enhanced nutritional value" in the Sequence Listing. Nucleotides and polypeptides that have been given these designations include those that are able to confer one or more of the following phenotypes, relative to wild-type control, when mis-expressed in plants: increased or decreased carbon content; increased or decreased plant nitrogen content; altered color (indicative of change(s) to the chemical composition); altered metabolic profile, increased or decreased starch content, increased or decreased fiber content; increased or decreased amount of a valuable compound (e.g. increased alkaloids and/or terpenoids); increased or decreased number of trichomes; increased or decreased cotyledon size; increased or decreased cotyledon number; altered cotyledon shape; increased or decreased fruit size; increased or decreased fruit length; altered fruit shape; increased or decreased seed size; altered seed shape; altered seed color (indicative of altered chemical composition); and having activated expression of a gene operably linked to an alkaloid or terpenoid related regulatory region or promoter. Altering characteristics such as the composition of a plant, plant organ, plant tissue and plant cell is valuable for improving the nutritional value of crops, improving the composition of plants to be used as bio-fuels, utilizing plants as chemical factories by increasing the content of valuable pharmaceutical compounds, producing plants with increased tolerance to abiotic or biotic stress, developing a genetic confinement system designed to reduce or prevent gene flow from transgenic plants to commercial crops and wild-type counterparts, making ornamental plants, and for other agricultural and/or horticultural purposes. Nucleotides and polynucleotides useful for developing plants with modified compositions can be utilized by procedures known to those skilled in the art, such as in PCT/US2006/014161, PCT/U52005/032680, PCT/U52006/0022851, PCT/US2005/44112, PCT/US2005/043562, PCT/US2006/41516, U.S. Ser. No. 60/838,646, U.S. Ser. No. 60/855,108, U.S. Ser. No. 60/854,825 PCT/US2006/360,459, PCT/US2007/061052, and PCT/US2007/002214, hereby incorporated by reference.

Some nucleotides and polypeptides that are useful for modulating plant characteristics in traits such as phosphate use include those that have been given the designation "useful for making plants with modulated phosphate use efficiency", "useful for making plants with modulated high pH sensitivity", or "useful for making plants with high aluminum sensitivity", in the Sequence Listing. Nucleotides and polypeptides that have been given these designations include those that are able to confer one or more of the following phenotypes, relative to wild-type control, when mis-expressed in plants: increased or decreased tolerance to low phosphate conditions; increased or decreased tolerance to no phosphate conditions; and increased or decreased tolerance to high pH conditions. Altering characteristics such as phosphate use through genetic technologies is valuable for producing crop plants with increased tolerance to phosphate limiting conditions, using traditionally un-amble land to grow crop plants with increased tolerance to phosphate limiting conditions, developing a genetic confinement system designed to reduce or prevent gene flow from transgenic plants to commercial crops and wild-type counterparts, and for other agricultural and/or horticultural purposes. Nucleotides and polynucleotides useful for developing plants with modulated phosphate use efficiency can be utilized by procedures known to those skilled in the art, such as in PCT/US2005/018912, hereby incorporated by reference.

Nucleotides and polypeptides that are useful for modulating plant characteristics in traits such as light responses include those that have been given the designations "useful for making plants with modulated light quality response", "useful for making plants with modulated light quality sensitivity", "useful for making plants with modulated light response", "useful for making plants with modulated light sensitivity", "useful for making plants with modulated UV sensitivity", "useful for making plants with modulated low light sensitivity" in the Sequence Listing. Nucleotides and polypeptides that have been given these designations include those that are able to confer one or more of the following phenotypes, relative to wild-type control, when mis-expressed in plants: increased or decreased vigor in the dark; increased or decreased seedling vigor under low light conditions; increased or decreased plant vigor under low light conditions; increased or decreased leaf length; altered leaf shape; altered leaf structure, and increased or decreased cotyledon length. Altering characteristics such as shade avoidance and shade tolerance through genetic technologies is valuable for producing plants with tolerance to light limiting conditions, increasing plant biomass produced per acre of arable land, increasing crop production per acre of arable land, developing a genetic confinement system designed to reduce or prevent gene flow from transgenic plants to commercial crops and wild-type counterparts, making ornamental plants, and for other agricultural and/or horticultural purposes. Nucleotides and polynucleotides useful for developing plants with light responses can be utilized by procedures known to those skilled in the art, such as in U.S. Ser. No. 60/799,404, U.S. Ser. No. 60/813,533, and U.S. Ser. No. 60/818,569, hereby incorporated by reference.

Nucleotides and polypeptides that are useful for modulating plant characteristics in traits such as nitrogen use include those that have been given the designation "Useful for making plants with modulated nitrogen use efficiency" in the Sequence Listing. Nucleotides and polypeptides that have been given the "Nitrogen use" designation include those that are able to confer one or more of the following phenotypes, relative to wild-type control, when mis-expressed in plants: increased or decreased tolerance to low nitrogen conditions and surrogate low nitrogen conditions (e.g. exposure to an effective amount of MSX); increased or decreased tolerance to no nitrogen conditions; and increased tolerance to high nitrogen conditions. Altering nitrogen use through genetic technologies is valuable for producing plants with increased tolerance to high or low nitrogen conditions, decreasing the amount of fertilizers used in crop production, using traditionally un-amble land to grow crop plants with increased tolerance to high or low nitrogen conditions, developing a genetic confinement system designed to reduce or prevent gene flow from transgenic plants to commercial crops and wild-type counterparts, and for other agricultural and/or horticultural purposes. Nucleotides and polynucleotides useful for developing plants with improved nitrogen use efficiency can be utilized by procedures known to those skilled in the art, such as in PCT/US2005/014197, hereby incorporated by reference.

Nucleotides and polypeptides that are useful for modulating plant characteristics in traits such as stress tolerance include those that have been given the designations "useful for making plants with modulated cold sensitivity", "useful for making plants with modulated drought sensitivity", "useful for making plants with modulated heat sensitivity", "useful for making plants with modulated low iron sensitivity", "useful for making plants with modulated oxidative stress sensitivity", "useful for making plants with modulated root development", "useful for making plants with modulated water use efficiency", "useful for making plants with modulated salt sensitivity", "useful for making plants with modulated abiotic stress sensitivity", or "useful for making plants with modulated biotic stress sensitivity" in the Sequence Listing. Nucleotides and polypeptides that have been given these designations include those that are able to confer one or more of the following phenotypes, relative to wild-type control, when mis-expressed in plants: increased or decreased tolerance to drought and/or surrogate drought conditions (e.g. exposure to effective amounts of ABA, PEG, mannitol or sucrose); increased or decreased tolerance to low temperature conditions; increased or decreased tolerance to high temperature conditions; increased or decreased salt tolerance; increased or decreased tolerance to oxidative stressors and/or surrogate oxidative stressors (e.g. exposure to an effective amount of arginine, ozone, or salicylic acid); having leaves with shiny or dull appearance (indicative of altered wax composition and/or content); and increase or decrease pest resistance. Altering abiotic stress tolerance through genetic technologies is valuable for farmers seeking to minimize economic losses due to drought, cold, heat, flooding and oxidative stressors; producing crop plants with increased tolerance to abiotic stressors; using traditionally un-arable land to grow crop plants with increased tolerance to abiotic stressors; developing a genetic confinement system designed to reduce or prevent gene flow from transgenic plants to commercial crops and wild-type counterparts; making ornamental plants; and for other agricultural and/or horticultural purposes. Nucleotides and polynucleotides useful for developing plants with improved abiotic stress tolerance can be utilized by procedures known to those skilled in the art, such as in PCT/US2005/018950, U.S. Ser. No. 11/248,547, U.S. Ser. No. 60/837,434, U.S. Ser. No. 60/860,296, or U.S. Ser. No. 60/851,585, hereby incorporated by reference.

The phenotypes mentioned in the Sequence Listing can be modulated by controlling the expression of nucleic acid sequences and polypeptide sequences that confer phenotype(s) when mis-expressed in plants. Modulation of a phenotype can also be achieved by inhibiting the expression of nucleic acid sequences and polypeptide sequences that confer phenotype(s) when mis-expressed in plants. A phenotype resulting from the expression of a nucleic acid sequence and/or polypeptide sequence can be modulated (e.g. increase or decrease of an observable/measurable phenotypic change in relation to wild-type control) using recombinant-DNA methods, as discussed in previous paragraphs.

According to another aspect, the nucleotide sequences of the invention encode polypeptides that can be utilized as herbicide targets, those useful in the screening of new herbicide compounds. Thus, the proteins encoded by the nucleotide sequences provide the bases for assays designed to easily and rapidly identify novel herbicides.

According to yet another aspect, the present invention provides a method of identifying a herbicidal compound, comprising: (a) combining a polypeptide comprising an amino acid sequence at least 85% identical to an amino acid sequence selected from the group consisting of the polypeptides described in the Sequence Listing with a compound to be tested for the ability to inhibit the activity of said polypeptide, under conditions conducive to inhibition; (b) selecting a compound identified in (a) that inhibits the activity of said polypeptide; (c) applying a compound selected in (b) to a plant to test for herbicidal activity; and (d) selecting a compound identified in (c) that has herbicidal activity. The polypeptide can alternatively comprise an amino acid sequence at least 90%, or at least 95%, or at least 99% identical to an amino acid sequence selected from the group consisting of the polypeptides in the Sequence Listing. The present invention also provides a method for killing or inhibiting the growth or viability of a plant, comprising applying to the plant a herbicidal compound identified according to this method.

The Sequence Listing sets forth the polypeptide and polynucleotide sequences of the invention, including, in many cases, functional homologs of specific query sequences. The Sequence Listing indicates which of the functional homologs are associated with each query sequence.

Generally, independent sequencing reads or results from the same clone are designated by identical same clone id numbers. For some sequences "R," "F," or number designations follow the clone id number. The "R" designation indicates that the sequence is from a 3' read of the clone. The "F" designation indicates that the sequence is a 5' read of the clone. Multiple 5' reads or 3' reads of the same clone are distinguished by a number designation immediately after the "R" or "F" designation. A number designation after the clone id indicates that the sequence presented is a distinct sequencing read of the clone.

In some cases, the sequences provided are variants or alleles of known sequences and/or fragments thereof, readily ascertainable as such by those of skill in the art. The provided sequences may be used in marker assisted breeding or as alternative choices for transgenes or protein engineering applications. As those of skill in the art would appreciate, in many cases fragments of the provided sequences, either noted in the Sequence Listing or identified by routine similarity searches, such as coding regions or polymorphic sites, can be employed in specific applications. In many cases, the sequences provided could be used by those of skill in the art for isolating biomolecules with adjacent regions which may be of interest for various applications.

The present invention further encompasses nucleotides that encode the above described polypeptides, such as those included in the Sequence Listing, as well as the complements and/or fragments thereof, and including alternatives thereof based upon the degeneracy of the genetic code.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

REFERENCES (1) Zhang et al. (2004) *Plant Physiol.* 135:615.
(2) Salomon et al. (1984) *EMBO J.* 3:141.
(3) Herrera-Estrella et al. (1983) *EMBO J.* 2:987.
(4) Escudero et al. (1996) *Plant J.* 10:355.
(5) Ishida et al. (1996) *Nature Biotechnology* 14:745.
(6) May et al. (1995) *Bio/Technology* 13:486)
(7) Armaleo et al. (1990) *Current Genetics* 17:97.
(8) Smith. T. F. and Waterman, M. S. (1981) *Adv. App. Math.* 2:482.
(9) Needleman and Wunsch (1970) *J. Mol. Biol.* 48:443.
(10) Pearson and Lipman (1988) *Proc. Natl. Acad. Sci.* (USA) 85: 2444.
(11) Yamauchi et al. (1996) *Plant Mol. Biol.* 30:321-9.
(12) Xu et al. (1995) *Plant Mol. Biol.* 27:237.
(13) Yamamoto et al. (1991) *Plant Cell* 3:371.
(14) P. Tijessen, "Hybridization with Nucleic Acid Probes" In Laboratory Techniques in Biochemistry and Molecular Biology, P. C. vand der Vliet, ed., c. 1993 by Elsevier, Amsterdam.
(15) Bonner et al., (1973) *J. Mol. Biol.* 81:123.
(16) Sambrook et al., Molecular Cloning: A Laboratory Manual, Second Edition, Cold Spring Harbor Laboratory Press, 1989, New York.
(17) Shizuya et al. (1992) *Proc. Natl. Acad. Sci. USA*, 89: 8794-8797.
(18) Hamilton et al. (1996) *Proc. Natl. Acad. Sci. USA*, 93: 9975-9979.
(19) Burke et al. (1987) *Science*, 236:806-812.
(20) Sternberg N. et al. (1990) *Proc Natl Acad Sci U S A.*, 87:103-7.
(21) Bradshaw et al. (1995) *Nucl Acids Res*, 23: 4850-4856.
(22) Frischauf et al. (1983) *J. Mol. Biol*, 170: 827-842.
(23) Huynh et al., Glover N M (ed) DNA Cloning: A practical Approach, Vol. 1 Oxford: IRL Press (1985).
(24) Walden et al. (1990) *Mol Cell Biol* 1: 175-194.
(25) Vissenberg et al. (2005) *Plant Cell Physiol* 46:192.
(26) Husebye et al. (2002) *Plant Physiol* 128:1180.
(27) Plesch et al. (2001) *Plant J* 28:455.
(28) Weising et al. (1988) *Ann. Rev. Genet.*, 22:421.
(29) Christou (1995) *Euphytica*, v. 85, n.1-3:13-27.
(30) Newell (2000)
(31) Griesbach (1987) *Plant Sci.* 50:69-77.
(32) Fromm et al. (1985) *Proc. Natl. Acad. Sci. USA* 82:5824.
(33) Paszkowski et al. (1984) *EMBO J.* 3:2717.
(34) Klein et al. (1987) *Nature* 327:773.
(35) Willmitzer, L. (1993) Transgenic Plants. In: iotechnology, A Multi-Volume Comprehensive treatise (H. J. Rehm, G. Reed, A. Püller, P. Stadler, eds., Vol. 2, 627-659, VCH Weinheim-New York-Basel-Cambridge).
(36) *Crit. Rev. Plant. Sci.* 4:1-46.
(37) Fromm et al. (1990) *Biotechnology* 8:833-844.
(38) Cho et al. (2000) *Planta* 210:195-204.
(39) Brootghaerts et al. (2005) *Nature* 433:629-633.
(40) Lincoln et al. (1998) *Plant Mol. Biol. Rep.* 16:1-4.
(41) Lacomme et al. (2001), "Genetically Engineered Viruses" (C. J. A. Ring and E. D. Blair, Eds). Pp. 59-99, BIOS Scientific Publishers, Ltd. Oxford, UK.
(42) Li et al. (2003) OrthoMCL: identification of ortholog groups for eukaryotic genomes. Genome Res 13: 2178-2189.
(43) Chen et al. (2007) Assessing Performance of Orthology Detection Strategies Applied to Eukaryotic Genomes. PLos ONE 2(4): e383.

SEQUENCE LISTING (96889 sequences)

SEQ ID NO: 1 - DNA, 810 bp, Zea mays
  misc_feature: Ceres CLONE 207843
  misc_feature: Encodes the peptide sequence at SEQ ID NO. 2
actgcgccgcggcttccagcgctcagcctccagctcccacgcgcactccacctcgtccatggccgccgatcgagtccctccccatctcctacaaccggccgccctgctcgttctccctagctgcgatgtggagctcgccctggacgatcgtccctgcccctcctctctgatctgcgtgcaggggtttccctcccatggcgcctggtcctcttcccttgactccatgccgagcgccccagccgagctcgtcctggctccagcttcttccttggacggcggagccctcccattcctgcagcaggctggcgtccctctctccatcatcttctctgcttggttcctggcgagctccccctgctcttctgctcgccctggccctgtgccatttttccattcctgcggcaagcaccagcccctccccacgccaacatccctttcctacggacgctgcccctctctggtttctggtggccggccacctctgctgctcccatggtgatctataaatccttctgttgttttactagtcttgttaataccctgctgatgtgaagttttatgtgtgttgatgtgtgcgatatggagtaaaatccctggagaattaggtggaggagaaggttaagttcaacgctccttaggtgttctatgaagtgcttgaactgaagttcgttgtcgttctgttcactgctgtaacttaattatcatgatgcatatgaaatggcaatgaactctgttatcagttctcgaaaaaaaaaaaaaaaaaaaaaaaaaaaaaaaaaaaaaaaaaaaaaaaataaaaaaaaaaaaaaa

SEQ ID NO: 2 - protein, 146 aa, Zea mays
  misc_feature: Ceres CLONE 207843
MAADRVPPHLLQPAALLVLPSCDVELALDDRPCPSSLICVQGFPSHGAWSSSLDSMPSAPAELVLAPASSLDGGALPFLQQAGVPLSIIFSAWFLASSPCSSARPGPVPFFHSCGKHQPLPTPTSLSYGRCPSLVSGGRPPLLLPW

SEQ ID NO: 3 - DNA, 768 bp, Zea mays
  misc_feature: Ceres CLONE 207973
  misc_feature: Encodes the peptide sequence at SEQ ID NO. 4
agcatcaaaccaactctttcccaaatccaccgccggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcaggaggccgccgaggcctacctcgtggggctcttcgaggacaccaacctctgcgccatccacgccaagcgcgtcaccatcatgcccaaggacatccagctcgcgcgccgcatcagggcgagagggcttgatctcccgttgtcgtcgtccacgttgttgggcctttcctctgtgtctctgcttgtagaatccttgcttctgttcggttccttctgttcgcatgatggtgttcgtagtgttaggagttgcattttctaatctgcttgttcttgcaccggtgcctctgaagtggcgtttccctctatcttaatggaaatggaatgtgctttaaaaaagaaatctgatgtctcgtttgtttccggaattgtaatcttattaacagaataggttatttttttaaaaaaaaaaaaaaaa

SEQ ID NO: 4 - protein, 178 aa, Zea mays
  misc_feature: Ceres CLONE 207973
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRARGLDLPLSSSTLLGLSSVSLLVESLLLFGSFCSHDGVRSVRSCIF

SEQ ID NO: 5 - DNA, 1157 bp, Zea mays
  misc_feature: Ceres CLONE 207992
  misc_feature: Encodes the peptide sequence at SEQ ID NO. 6
aaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcgaccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaaccccaacctggtgcacgcgcagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagacccatccattcgtccgtccgtcgagtgaacagtgtggtcttccctgtactctacttgttcagatcgtaggcgtgtagtagttgcaccagccggcgtatgctcatgatcgatgtgtgtgctcatcaatcaatgtcaatggctgcctgctgtaagcggtcgatgtaaactaagcacagacgcatgtatcgtcatcagtggatgaatcaatctatcgatggcctgtgccattcatttttgaaaaaaaaaaaaaaaa

SEQ ID NO: 6 - protein, 260 aa, Zea mays
  misc_feature: Ceres CLONE 207992
  misc_feature (59)..(227): Pfam Name: Chloroa_b-bind Pfam Description: Chlorophyll A-B binding protein
MAASALHQTTSFLGQALVARAAGVDAGDRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 7 - DNA, 525 bp, Zea mays
  misc_feature: Ceres CLONE 208445
  misc_feature: Encodes the peptide sequence at SEQ ID NO. 8
ctaggactatactcaccgagagcctcgcgggtcatacaccgccgagagtacgagagagagaagcaccggccgccaccgtcgccgcccgcctacaccgccgctcgggagccatatggtggctgaggaagttcgccagtacgtgagggacctgtacgcagagccgctggggtttggggacaacagggacgacggaaattgctcatcggagtttcttctctcgctgttgatycgctccgcgcgtggaccgcccaatcccgtctccatcccgacgagcaagtgaccgaggaacccgaagcaacccaagttggagattcttacaggagctcgcagaaggtgaagagcaggtaccaccagaggaggactactacgacgagttcgacgaaatctaggccgtcgtctcccagtcaactatggcgccgtggagatagtgtttctgatctattttattattatcggttatttttgtaagacattatcattatataataaaatttatgacattcgtctctaaaaaaaaaaaaaaaa

SEQ ID NO: 8 - protein, 55 aa, Zea mays
  misc_feature: Ceres CLONE 208445
  misc_feature (39)..(39): Xaa is any aa, unknown, or other
MVAEEVRQYVRDLYAEPLGFGDNRDDGNCSSEFLLSLLXRSARGPPNPVSIPTSK

SEQ ID NO: 9 - DNA, 619 bp, Zea mays
  misc_feature: Ceres CLONE 208614-R
cgattgggtaccgggccccccctcgaggtcgacggtatcgataagcttttttttttttttttttgaaaagccatctaatcctggcattgtatggatcactgcatacacaagaccatgcaaaaacactagtacaaccaaaaggcaggcaggcagcaacagcggttgatgatggggcacagccagtgtcatctcatacttagatcgcccgcgcgcgccgagaccaaatcggtcgccattagcagaacctgcaagtttacttacgtgcctaatcactcttgcattcctgctaattaagccgatggaacggtggaagaagtactggtgcaagcaagcaagctagctagttgaacacggacagcggcatcaagaacccggccgcgtgcgcctcggcggcggccgccattgccagcgcaatatcatccccagtgccgccacctccgcccgcgggcgggtcgatgggctcggtcgccggcgccaggaaatggccatggaggaagtgcgcgtgcgggatcaagaagtgcggcgccggcggctcggccaccgtgcccggcgcggcgtgcgacgggtgctggtgctggccgtcctgctgctgctgctgcttgggctggcggtgcgccgg

SEQ ID NO: 10 - DNA, 961 bp, Zea mays
  misc_feature: Ceres CLONE 208886
  misc_feature: Encodes the peptide sequence at SEQ ID NO. 11
attcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtaacgggatgcagcaacaaagttccttacgaccctaacctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaaacccaaaaaaaaaaaaaaaa

SEQ ID NO: 11 - protein, 245 aa, Zea mays
  misc_feature: Ceres CLONE 208886
  misc_feature (30)..(208): Pfam Name: Ribonuclease_T2 Pfam Description: Ribonuclease T2 family
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVAMDN

SEQ ID NO: 12 - DNA, 1073 bp, Zea mays
  misc_feature: Ceres CLONE 209496
  misc_feature: Encodes the peptide sequence at SEQ ID NO. 13
attccaaacaggacaccgaatgcacgatcgatcccacaagccgcagccgccggaggctggcgagggcgccggcggcgggaacgtggatcgagtgctcttcaagaacctcgtcgagatggtgccgctcgtcgagtcgctcatggaccggagggtcaactcggcctactcgcgacgcacttcgctagtctacacgccggcgccgcccaagaaggcgagcgaattggaaagtgtcaaattgccacagagcgtatcggccaaaaagcggagagaccctggcgatgtatccaagaagagcacccctgattctaacggcgacaacggcttggttgtgccattgtctctatcgggtgctgaaaataagcccaaggatgatgttgctgggctgcgcgagcaggtcgattacctgcaaaagaaactgctcgagaaggaggaggcgctgaggtccgcggagagcctcgtgactgagatgaacgcggcatatgcaaccatcgatgaactccgacgcctggtgtctgacaaagaagctttgatcagatctaccaattctcagttgcatgatgcaaagattatgcttgcagacaagcaagcatctgtagagaaactggaatgggaggtaaagatgtcaaataaaaaggtcgaagatcttcaaggagatgtgtcaaatatgggattcgagataagctcgttgatggcatttttcgataaaatttcagagaatctttcaggtgactcttatgatgacacagtaccatcatcatatgaattagaggcaattcaatcaacgagtgaaattgacaagatcgaggtcgacaaaatagagcaggagaggattacctatggtgaagctctcgcggcagcgagagagaaccctgacgaggagcacttgaatatagctgccgaggcaaggtcaaggctgcaggtccttgtactatagtggtggcccccttctaattctagtgtatgtatgataatgttgaactgctgatgtaattttaccttgttggcttgagttgaggcgcttgtgaaatcgttccaggggtaatggaacgagcactgcaaaaaaaaaaaaaaaa

SEQ ID NO: 13 - protein, 304 aa, Zea mays
  misc_feature: Ceres CLONE 209496
MHDRSHKPQPPEAGEGAGGGNVDRVLFKNLVEMVPLVESLMDRRVNSAYSRRTSLVYTPAPPKKASELESVKLPQSVSAKKRRDPGDVSKKSTPDSNGDNGLVVPLSLSGAENKPKDDVAGLREQVDYLQKKLLEKEEALRSAESLVTEMNAAYATIDELRRLVSDKEALIRSTNSQLHDAKIMLADKQASVEKLEWEVKMSNKKVEDLQGDVSNMGFEISSLMAFFDKISENLSGDSYDDTVPSSYELEAIQSTSEIDKIEVDKIEQERITYGEALAAARENPDEEHLNIAAEARSRLQVLVL

SEQ ID NO: 14 - DNA, 1687 bp, Zea mays
  misc_feature: Ceres CLONE 210401
  misc_feature: Encodes the peptide sequence at SEQ ID NO. 15
gctccacgtcacgacgccgcatctaaccctccggcgactcatcgccggcgagccggtccgccacgccatagcctcgtcctgaagcgcacttaatcctacgtctcgttcctctctcgcccccggtaccctccataggcatgggaatggggtctgcgagagggggcgcagggggatggctccccggcgagcggtggcggcgggtcatcttcctcgctctggcggccgtctcgttcctcatctcactcatactcctcttcctatccgcgccgcgtctccgcctcccaagtgtcgtcctgccttacaccaccgcttccgcttctgccgtccgccgcgggcccggcgagccgccctgcctggtgtacctgctgaccggcgcgcgcggcgacgggcgccgcctcctcaggctcctcctcgcggtttaccacccgcgcaaccggtacgtgctccacctctccgccgacgcgccagacgacgagcgcctgagcctcgccaccggggtcgtcgccgcggcgcccgccgtgggagcattcgagaacgtggttattattggcaatcccaccgccgggacgcccgtggggtcctccggactcgccggcacgctccgcgctgcggccgtgctgctccggctccacgctgactgggactggttcctcaccctcaatgccgccgactaccccctcgtcacacaggatgacctgattcatgtcctttcttctgtcccaagggatcttaacttcattgaccacaccggtgacgttggatcaaaagaacctgagaaagttcaacaaattatagtcgatgctggaatttacttgtcagggaggaccaacttctttcgaggaacacagaaacgagcagctcctgaggcttttaagttctttacaggttctccatgggtcatattaaaccggcaatttatagagtactgcattcttgcttgggagaatctccctaggattcttctcatgtacttcaacaatgtaatacaacctcaggaagggtatttccagacagtcatctgcaactcactggacttccgtaatttcactgtgaacaatgacttgaggttcatggtgcaagatgattccgctcagaaaaagtcccttttcacgagcagggaacattatggtcacatggtggatagtggggcacccttcgcaaggccgtttcaggagaatgatcctctgctggaccagatcgacggcaatatactcaagcgttggagccatggaccagttcctggtgcttggtgcacaggaaggaagaggtggttcagtgatccatgttcccagtggggcgatgtgaatgttttgagaccaggtcctcaagcagtgatgttgcaccaatatgtaaatcggaccttagaagaagcaaagtctagcagcaattcatgcaggcggtagcagcattggcgtctagaacctcatgtcccatggttgaaagctttgagctttttccgcttatccactaagggttctccactctgctgaataaatagctgccacatgtctaagctgaaacaagcactcgtcgcacctggaacaaagccatggagggatgttcttttctgatattttcatgatgactatcatagtcacggatcaggagtttcactttggtctgtgattaatctgtgcaatccccatatttggctcatataacacttccaggcgctgataataggctg

SEQ ID NO: 15 - protein, 421 aa, Zea mays
  misc_feature: Ceres CLONE 210401
  misc_feature (73)..(298): Pfam Name: Branch Pfam Description: Core-2/I-Branching enzyme
  misc_feature: SWISSPROT Homolog: EC 2.4.2.26 Protein xylosyltransferase
  misc_feature: Functional homolog of the protein sequence given in SEQ ID NO 96847
  misc_feature: Useful for making plants with altered carbohydrate content
MGMGSARGGAGGWLPGERWRRVIFLALAAVSFLISLILLFLSAPRLRLPSVVLPYTTASASAVRRGPGEPPCLVYLLTGARGDGRRLLRLLLAVYHPRNRYVLHLSADAPDDERLSLATGVVAAAPAVGAFENVVIIGNPTAGTPVGSSGLAGTLRAAAVLLRLHADWDWFLTLNAADYPLVTQDDLIHVLSSVPRDLNFIDHTGDVGSKEPEKVQQIIVDAGIYLSGRTNFFRGTQKRAAPEAFKFFTGSPWVILNRQFIEYCILAWENLPRILLMYFNNVIQPQEGYFQTVICNSLDFRNFTVNNDLRFMVQDDSAQKKSLFTSREHYGHMVDSGAPFARPFQENDPLLDQIDGNILKRWSHGPVPGAWCTGRKRWFSDPCSQWGDVNVLRPGPQAVMLHQYVNRTLEEAKSSSNSCRR

SEQ ID NO: 16 - DNA, 1825 bp, Zea mays
  misc_feature: Ceres CLONE 210430
  misc_feature: Encodes the peptide sequence at SEQ ID NO. 17
acgtttaaatggctccactcacacttggcctcgttctgctgcagctcgtcccttttgccccaatcttcttctccaaaccacatcctctggcctctgacaggtgacgagtcccatgggtgccgcggcgaggaagcccgccgccgctctgctgccaatctggctctgtctcgtctgcgtgtcaagagcgcagccgtacatcggcgtgaactacggcgaggtagcggacaacctgccgtcgccggacaagacggcgaggctgctcaagtcgacgtccatctccaaggtgcggctgtacggcgtggacgcggggctgatccgcgcgctggcggggtccggcatctccgtggtggtgggtgtggccaacggcgagatccccacgctggccgccgacccggccgcggcgtcgcggtggctggccgccaacgtgctgcccttcgtcccggcgaccaccatctccgccgtggccgtgggcaacgaggtgctggagtccggggacgccgcgctggccgccgcgctcctcccggccatgcagaacctccgcgccgcggcggcggccgcgggggacggcgccgcggggatccggttctccaccgtgaacaccatgggcgtgatggcgcagtcggagccgccgtccgcgggcgcgttccacccggacgtcgcgccgcagctgcagcagatcctgggattcctgagcaagaccggcgcgcccttcatggtcaacccctacccgtggttcgcgtaccagtcggacccgcggccggagacgctggccttctgcctgttccagcccaacgccgggcgcgtggacggcgggtccaaggtcaggtacgccaacatgttcgacgcgcagctggacgccgtgaagtcggcgctggtgcgcgccggatacgggggcgtggacatcgtggtggccgagacggggtggccgaccaggggcgacgccggggagcccggcgccacggtggagaacgccagggcctacgtgtccaacctggtggcgcacctgcggtccggcgccggcacgccgctgatgccggggaggtcggtggacacgtacctgttcgcgctgtacgacgaggacctcaagccggggccgacgtcggagcgctcgttcgggctgtaccacacggacctgaccatggcgtacgacgccgggctgacctccaactccaacgccgggggaggtacaggtactgcggcgccggcgcagcccaaggcgggcgggtggtgcgtggcgcgggacggcgcttcggacgcggagctgcaggcggacctggactacgcgtgctcgcaggtgggcgtcgactgcggcgccatccagcccggcggcgcgtgcttcgagcccaacacggtgcacgcccacgcagcgtacgccatgaaccagctgtaccaggcggccgggcggcaaccgtggaactgcgacttccgggcgtccgccacgctcacctccgagaacccaagctacggcgcatgcgtgtacaccgggggaggccaataatacaccgcgtggcagcgcacgattagttttgcgtgtaccatgcatgatgccgagcgagggaagttgggcccacaggctacagcaaggaggtctggactaccatggatgccaatgcgatccacggaggcgaagcatcctcttgtttggcgcgtcctttccagatgccttgcctgccaggctgggatgtgtttgtaacttcgtgtaaaaagaactgttagatgtttgccagtgtcacgtgatctttgtgcatatagtacgcgtgtcttaatttacaagtggaatgagattgtatgtgtgattaatttttttacaaaaaaaaaaaaaaaa

SEQ ID NO: 17 - protein, 461 aa, Zea mays
  misc_feature: Ceres CLONE 210430
  misc_feature (29)..(349): Pfam Name: Glyco_hydro_17 Pfam Description: Glycosyl hydrolases family 17
  misc_feature (371)..(456): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 96848
  misc_feature: Useful for making plants with altered cell wall content and/or composition
MGAAARKPAAALLPIWLCLVCVSRAQPYIGVNYGEVADNLPSPDKTARLLKSTSISKVRLYGVDAGLIRALAGSGISVVVGVANGEIPTLAADPAAASRWLAANVLPFVPATTISAVAVGNEVLESGDAALAAALLPAMQNLRAAAAAAGDGAAGIRFSTVNTMGVMAQSEPPSAGAFHPDVAPQLQQILGFLSKTGAPFMVNPYPWFAYQSDPRPETLAFCLFQPNAGRVDGGSKVRYANMFDAQLDAVKSALVRAGYGGVDIVVAETGWPTRGDAGEPGATVENARAYVSNLVAHLRSGAGTPLMPGRSVDTYLFALYDEDLKPGPTSERSFGLYHTDLTMAYDAGLTSNSNAGGGTGTAAPAQPKAGGWCVARDGASDAELQADLDYACSQVGVDCGAIQPGGACFEPNTVHAHAAYAMNQLYQAAGRQPWNCDFRASATLTSENPSYGACVYTGGGQ

SEQ ID NO: 18 - DNA, 338 bp, Zea mays
  misc_feature: Ceres CLONE 210657-F
  misc_feature: Encodes the peptide sequence at SEQ ID NO. 19
acgatcacacaccactccacagcagtagcaagagggatagagcaaggccacacacacacacacaccactaggctaggttaaccttttaatcgtsgtcgaraagcaagaagggcgcgcacgcaagcaggcaagcaagaagagagcmgatcgaccgagagmtagcacgcgatsgaragttcttccaagatgatggtggcggcactctgctggaccttggcctggcgtgtcgascgccgaggcgaggmacatcaagaccacgacgacggasaagaaggacgacgcggtggtgcagcgcagaccttcccgcccttcgaccgcctcggcgmggtcgcgtcccc

SEQ ID NO: 19 - protein, 50 aa, Zea mays
  misc_feature: Ceres CLONE 210657-F
  misc_feature (15)..(15): Xaa is any aa, unknown, or other
  misc_feature (20)..(20): Xaa is any aa, unknown, or other
  misc_feature (28)..(28): Xaa is any aa, unknown, or other
  misc_feature (47)..(47): Xaa is any aa, unknown, or other
MMVAALCWTLAWRVXRRGEXHQDHDDGXEGRRGGAAQTFPPFDRLGXVAS

SEQ ID NO: 20 - DNA, 162 bp, Zea mays
  misc_feature: Ceres CLONE 210667-F
tytttttcccccacgtgcgccgccgcgaccttcctcgatcccatctcccaacgcccccgcctcgcctcgggatcccgccgccgctccatctgcstttgctcccccacccgcagcagcgagcgacavgtcggcgagggatggccaaggccaggtcgttggcga

SEQ ID NO: 21 - DNA, 402 bp, Zea mays
  misc_feature: Ceres CLONE 210676-F
  misc_feature: Pfam Name: Histone Pfam Description: Core histone H2A/H2B/H3/H4
  misc_feature (231)..(231): n is a, c, t, g, unknown, or other
atcttgctctgaacgcattcctcccatctcccaagacctcctcagacccgagaagcgcmkgcgggccatggacgccaccggcactggagctggagggaaggcgaagaagggagcggccggtcgcaaggccgcgggccgaggaagaagtcggtgacgaggtccgtgaaggccgggctcmagttccccgtcggccgcatcgggcgctacctcaagaagggccgctacgcgcancgtcggcagcggtgcccccgtctacctcgsggscgtcctggagtacctcgccgctgaggtcctggagctcgccggcaacgctgccaaggacaacaagaagacgcgcatsgtsccgsgcsacgtgctgctggcgatccgcaacgacgaggagctcgggaagctgctgaccgg

SEQ ID NO: 22 - DNA, 267 bp, Zea mays
  misc_feature: Ceres CLONE 210677-F
  misc_feature: Encodes the peptide sequence at SEQ ID NO. 23
  misc_feature (116)..(116): n is a, c, t, g, unknown, or other
  misc_feature (178)..(178): n is a, c, t, g, unknown, or other
gaaacaaagaaagataaaatcgagaggacgccagggccgattctctgcgtgacttggggcgtcgtcgcgagttttctccggccgagggcggcgcgaccggacaaccagcgtgascngaccggcgacatgactcgcggcaaccagcgtgaccgcgaccgtragcgcgcggcggcsraanagcccaacgccaagaactcccaggacgggctcaccccggagcagcgccgcgatgagggacaagaaagctctggaggagaaggcggcsaa

SEQ ID NO: 23 - protein, 46 aa, Zea mays
  misc_feature: Ceres CLONE 210677-F
  misc_feature (12)..(12): Xaa is any aa, unknown, or other
  misc_feature (17)..(17): Xaa is any aa, unknown, or other
  misc_feature (18)..(18): Xaa is any aa, unknown, or other
MTRGNQRDRDRXRAAAXXPNAKNSQDGLTPEQRRDEGQESSGGEGG

SEQ ID NO: 24 - DNA, 365 bp, Zea mays
  misc_feature: Ceres CLONE 210693-F
  misc_feature: Encodes the peptide sequence at SEQ ID NO. 25
atccaattcacaggctcaccacaccaaccaacaagcaaaaattcccsaatcctctsgtctccgcggcgaagatgtcggggcgcggcaagggcggcaagggcctgggcaagggcggcgcgamstcaccggaaggtcttgcgcgacaacatccaggggatcacgaagccggcgatccggaggctggcgcggcggggcggcgtgaacsatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagsscagggccgcaccctctacgg

SEQ ID NO: 25 - protein, 101 aa, Zea mays
  misc_feature: Ceres CLONE 210693-F
  misc_feature (16)..(16): Xaa is any aa, unknown, or other
  misc_feature (19)..(19): Xaa is any aa, unknown, or other
  misc_feature (41)..(41): Xaa is any aa, unknown, or other
  misc_feature (69)..(69): Xaa is any aa, unknown, or other
IQFTGSPHQPTSKNSXILXSPRRRCRGAARAARAWARAARXHRKVLRDNIQGITKPAIRRLARRGGVNXLGAHLRGDPRRAQDLPGERHPRRRHLHRARAP

SEQ ID NO: 26 - DNA, 365 bp, Zea mays; identical to SEQ ID NO: 24
  misc_feature: Ceres CLONE 210693-F2

SEQ ID NO: 27 - DNA, 919 bp, Zea mays
  misc_feature: Ceres CLONE 210700-R
ttcatcctatccgtatgttattttttttatattgtgctttttaatttaaacccacaattgggtaggcccccccccctcgtagtcgagcgcataaataagcttctttttttttttttttgatgtttttttttttttttaacgtggattacccctcctaagtgaaggggaaaataccacgggcgccggtaggtaacttctcactattttctggtggttacagatcgcacgagatttacaattgagatagatatctcctgcggtttacaaagatatttttagaggtgaaaccctaaagatctctgtatcgcggcatacgtgtggatccattattaagtgatctgctagtttggattgtctctgatgcatttattctttgtgtcctatttgttttcatttgtggttgacattattattttttattatccaagatgaacaccttctgttttttctttagtttgtgcgcccctttttgttatcgtacactgggtgtacacttcgtggtctccggagttctaaagataatgtgtaaggtgattcttcttacacatattaacatcttattccttgcatcgtaattgatttcaaatattatagctagtatatccatgccctactggtgggtatattaatttattggattatatttccctcaatgtgtattattatttcttcttccgtttttagttttatcataattacttacgtctcctccttttattaggctacaccaatcttcctctgattgttatttgaggtgattttggttgagttagtattatatgttttttaagttaatccgtttatatgatatctcttcactccttcagcttttgtttgctacaatttgatgtctagcatctcactaccattactctctctattttgaatctttgaactcaccttgttcttcttattatat

SEQ ID NO: 28 - DNA, 485 bp, Zea mays
  misc_feature: Ceres CLONE 210848-F
  misc_feature: Encodes the peptide sequence at SEQ ID NO. 29
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctsgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggsgcaggagctgcccggcgactgcggcctctcgctgtcctacaacatcacccccgacatcgactgcgacaagatcggaatgaagggatactgttcccttaccagaatc

SEQ ID NO: 29 - protein, 129 aa, Zea mays
  misc_feature: Ceres CLONE 210848-F
  misc_feature (28)..(115): Pfam Name: Tryp_alpha_amyl Pfam Description: Protease inhibitor/seed storage/LTP family
  misc_feature (27)..(27): Xaa is any aa, unknown, or other
  misc_feature (94)..(94): Xaa is any aa, unknown, or other
MKTTSSGIAVVLLVAMLAVHSALADIXCSDVLNDLSPCLPFLQGKAAKPSESNNQCCDGVRALYAAADTRPDRQATCRCLKAAYVQVHAVLSAXQELPGDCGLSLSYNITPDIDCDKIGMKGYCSLTRI

SEQ ID NO: 30 - DNA, 489 bp, Zea mays
  misc_feature: Ceres CLONE 210872-F
  misc_feature: Encodes the peptide sequence at SEQ ID NO. 31
  misc_feature (208)..(208): n is a, c, t, g, unknown, or other
  misc_feature (360)..(360): n is a, c, t, g, unknown, or other
accaagagcggaaggagatcgccggaagaggggggaggcgcggagatgagcgggagcgcgttcaacgcgttcaagtcgcgtgtgccggtggcgtggagtccccggctgtacatcacgctggtgcggggcctaccgggcacgcgccgcctccaccgccgcacgstcgaggccatgcgcmtccgccgctgccaccgaaccgtcgagcasngcaccacgccgtckctgctcgggatgctcacccaggtgaagcgcctcgtcgccgtcgagaccgaggagatgtacaacgcgcgcaasaggccgaggcggagaggcgcgcgcccagacccccgctcgtcgtctcccaccaccagccgccgcytncgwagggtgctgctgccactgcgccatagcctctgggcatcagaagactttcattccagttcagcaggataataattaaactgccctgtgttttgggtctgctggtctcsastctccagacgatcgcat

SEQ ID NO: 31 - protein, 128 aa, Zea mays
  misc_feature: Ceres CLONE 210872-F
  misc_feature (40)..(40): Xaa is any aa, unknown, or other
  misc_feature (45)..(45): Xaa is any aa, unknown, or other
  misc_feature (54)..(54): Xaa is any aa, unknown, or other
  misc_feature (55)..(55): Xaa is any aa, unknown, or other
  misc_feature (83)..(83): Xaa is any aa, unknown, or other
  misc_feature (105)..(105): Xaa is any aa, unknown, or other
MSGSAFNAFKSRVPVAWSPRLYITLVRGLPGTRRLHRRTXEAMRXRRCHRTVEXXTTPSLLGMLTQVKRLVAVETEEMYNARXRPRRRGARPDPRSSSPTTSRRXRRVLLPLRHSLWASEDFHSSSAG

SEQ ID NO: 32 - DNA, 537 bp, Zea mays
  misc_feature: Ceres CLONE 210932-F
  misc_feature (384)..(384): n is a, c, t, g, unknown, or other
aacaacaacaacaacccgcacaacggcacgattctcctcctccgtccgcgtmstctcggtttcggcgatgtcggggcgcggcaagggcggcaaggggctgggcaagggcggcgcaagcgcaccgcaaggkcttgcgcgacaacatccaaggcatcacgaagccggcgatccgtagmtggccaggakgggcggcgtcaagcgcatttctgggctcatctacgaggagacccgcggcgtgctcaagatcttcctcgagaacgtcatccgcgasgccgtcacctacaccgagcacgcccgccgcaagaccgtcaccgccatggatgtcgtctacgcgctcaagcgccagggccgcacgctctacggcttcggcggctaggccgcttnccccttctgatgctttratgtgacggccgtggtcggttgtgtgtctagttggccggtctactgtagtttgttctgtatcttcgtttcgaggtgttccagtttctagccatttagtgtaatattttcactgctattatcaatggaaagcctcgg

SEQ ID NO: 33 - DNA, 325 bp, Zea mays
  misc_feature: Ceres CLONE 210996-F
  misc_feature: Encodes the peptide sequence at SEQ ID NO. 34
atcttgctctgaacgcattcctcccatctcccaagacctcctcagacccgagaagcgcmkgcggccatggacgccaccggcactggagctggagggaaggcgaagaagggagcggccggtcgcaaggccgsgggcgaggaagaagtcggtgacgaggtccgtgaaggccgggmtccagttccccgtcggccgcatcgggcgctacctcaagaagcgccgctacgcgcascgtcggcagcggtgcccccgtctacctcgcggccgtcctggagtacctcgccgctgaggtcctggagctcgccggcaacgstgccaaggacaacaa

SEQ ID NO: 34 - protein, 94 aa, Zea mays
  misc_feature: Ceres CLONE 210996-F
  misc_feature (20)..(20): Xaa is any aa, unknown, or other
  misc_feature (44)..(44): Xaa is any aa, unknown, or other
  misc_feature (58)..(58): Xaa is any aa, unknown, or other
  misc_feature (76)..(76): Xaa is any aa, unknown, or other
SCSERIPPISQDLLRPEKRXRPWTPPALELEGRRRRERPVARPXARKKSVTRSVKAGXQFPVGRIGRYLKKRRYAXRRQRCPRLPRGRPGVPRR

SEQ ID NO: 35 - DNA, 263 bp, Zea mays
  misc_feature: Ceres CLONE 211006-F
  misc_feature: Encodes the peptide sequence at SEQ ID NO. 36
  misc_feature (138)..(138): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccggkckcwwggccggcgggcgancgaagaagtcggtgtcgcggtcctccagggccgggctacagttccccgtcagccgcgtcgggcgttacctcaaaaagggccggtacgcgcakgttagggcacgggtgcccccgtctacctcgccg

SEQ ID NO: 36 - protein, 87 aa, Zea mays
  misc_feature: Ceres CLONE 211006-F
  misc_feature (29)..(29): Xaa is any aa, unknown, or other
  misc_feature (40)..(40): Xaa is any aa, unknown, or other
  misc_feature (41)..(41): Xaa is any aa, unknown, or other
  misc_feature (46)..(46): Xaa is any aa, unknown, or other
  misc_feature (76)..(76): Xaa is any aa, unknown, or other
SYISTLNSQGPFFFSIWKRRSSSHGRERXGGKAKKGAAGXXAGGRXKKSVSRSSRAGLQFPVSRVGRYLKKGRYAXVRARVPPSTSP

SEQ ID NO: 37 - DNA, 397 bp, Zea mays
  misc_feature: Ceres CLONE 211026-F
  misc_feature: Encodes the peptide sequence at SEQ ID NO. 38
  misc_feature (137)..(137): n is a, c, t, g, unknown, or other
  misc_feature (229)..(229): n is a, c, t, g, unknown, or other
  misc_feature (380)..(380): n is a, c, t, g, unknown, or other
atcttgctctgaacgcattcctcccatctcccaagacctcctcagacccgagaagcgcmkgcggccatggacscaccgsactggagctggagggaaggcgaagaagggagcggccggtcgcaaggccgcttggcgangggaagaagtcggtgacgaggtccgtgaaggccgggctccagttccccgtcggccgcatcgggcgctacctcaagaagggccgctacgscancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgagganctcgggaagctgcttac

SEQ ID NO: 38 - protein, 131 aa, Zea mays
  misc_feature: Ceres CLONE 211026-F
  misc_feature (52)..(124): Pfam Name: Histone Pfam Description: Core histone H2A/H2B/H3/H4
  misc_feature (20)..(20): Xaa is any aa, unknown, or other
  misc_feature (24)..(24): Xaa is any aa, unknown, or other
  misc_feature (26)..(26): Xaa is any aa, unknown, or other
  misc_feature (45)..(45): Xaa is any aa, unknown, or other
  misc_feature (75)..(75): Xaa is any aa, unknown, or other
  misc_feature (76)..(76): Xaa is any aa, unknown, or other
  misc_feature (126)..(126): Xaa is any aa, unknown, or other
LALNAFLPSPKTSSDPRSAXGHGXTXLELEGRRRRERPVARPLGXGKKSVTRSVKAGLQFPVGRIGRYLKKGRYXXVGSGAPVYLAAVLEYLAAEVLELAGNAAKDNKKTRIVPRHVLLAIRNDEXLGKLL

SEQ ID NO: 39 - DNA, 459 bp, Zea mays
  misc_feature: Ceres CLONE 211099-F
  misc_feature: Encodes the peptide sequence at SEQ ID NO. 40
aaccctcgaggaaggcgaccggagatggcggcgtcgtcggcggtggagaagctcaaggtcctctgggactcgcagcgtcaacgacgaggagcagtgggcgctcaattataagctgctgaaggccgctggtctgtttgcgggatccatcttcctgattgccggaacttccgggtgatctgatggccatttagtaggcttatcagcgttgtttacttggatcctatgagtgttgttttgatgttccaataaattcctgctatgaatatgaaagttattttgctctgaagaggactagatctgtgccgatagtgcttgatcttagactttgtagccatagagattagaccctttaatattcggcgtgtaccgtggatattttggaacgatggtatcagtctgcacccataataattttttgatttgatgggtttattaatattttaagagaagatgttgcgc

SEQ ID NO: 40 - protein, 57 aa, Zea mays
  misc_feature: Ceres CLONE 211099-F
TLEEGDRRWRRRRRWRSSRSSGTRSVNDEEQWALNYKLLKAAGLFAGSIFLIAGTSG

SEQ ID NO: 41 - DNA, 267 bp, Zea mays
  misc_feature: Ceres CLONE 211116-F
  misc_feature (110)..(110): n is a, c, t, g, unknown, or other
aaaagaaagaaaaaatcgagaggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagcgcgcggcggcssaagcccaacgccaagaactcccaggacgggctcaccccggagcagcgccgcgagagggacaagaaagctctggaggagaaggcggccaagaaggcgc

SEQ ID NO: 42 - DNA, 409 bp, Zea mays
  misc_feature: Ceres CLONE 211152-F
  misc_feature (141)..(141): n is a, c, t, g, unknown, or other
  misc_feature (233)..(233): n is a, c, t, g, unknown, or other
ctcatcttgctctgaacgcattcctcccatctcccaagacctcctcagacccgagaagcgcmkgcggccatggacgccaccggcactggagctggagggaaggcgaagaagggagcggccggtcgcaaggccgcgggcganggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgsgccacgtgctgctggcgatccgcaacgacgaggagctcgggaagctgctgaccggcgtka

SEQ ID NO: 43 - DNA, 361 bp, Zea mays
  misc_feature: Ceres CLONE 211168-F
  misc_feature: SWISSPROT Homolog: EC 3.6.3.17 Monosaccharide-transporting ATPase
  misc_feature (294)..(294): n is a, c, t, g, unknown, or other
  misc_feature (295)..(295): n is a, c, t, g, unknown, or other
aggtacacatcatctcttccaaatcccaccagcaaatccccaattcctccgagttcgagcgaccatgtcggggcgtggcaagggcgggaagggtctgggcaaaggcggcgcaagcgtcaccgcaagttctccgcgacaacatccagggcatcacgaagccggcgatccggaggttggcgaggaggggcggcgtgaacsatctcggggctcatctacgaggagacccgcggcgtgctcaagatcttcctcgagaacgtcatccgcgacgccgtaacctacacggagcacgcccwnngcaagaccgtcaccgccatggacgtcgtctacgccctcaagcgccagggtcgcacctctacggatt

SEQ ID NO: 44 - DNA, 267 bp, Zea mays
  misc_feature: Ceres CLONE 211201-F
  misc_feature: Encodes the peptide sequence at SEQ ID NO. 45
  misc_feature (108)..(108): n is a, c, t, g, unknown, or other
  misc_feature (168)..(168): n is a, c, t, g, unknown, or other
gaaagaaaaaatcgagaggacgccagggccgattctctgcgtgacttggggcgtcgtcgcgagttttctccggccgagggcggcgcgaccggacaaccagcgtgascngaccggcgacatgactcgcggcaaccagcgtgaccgcgaccgtgagcgcgcggcggcsgnaagcccaacgccaagaactcccaggacgggctcaccccggagcagctgccgcgagagggacaagaaagctctggaggagaaggcggccaagaaggcgca

SEQ ID NO: 45 - protein, 49 aa, Zea mays
  misc_feature: Ceres CLONE 211201-F
  misc_feature (17)..(17): Xaa is any aa, unknown, or other
MTRGNQRDRDRERAAAXSPTPRTPRTGSPRSSCRERDKKALEEKAAKKA

SEQ ID NO: 46 - DNA, 455 bp, Zea mays
  misc_feature: Ceres CLONE 211239-F
  misc_feature: Encodes the peptide sequence at SEQ ID NO. 47
  misc_feature (214)..(214): n is a, c, t, g, unknown, or other
  misc_feature (335)..(335): n is a, c, t, g, unknown, or other
aagcaaggagcgctacatccaggccagcagtttccatttgcaatccgaccccatcttcatcccgttgtcgcagcagcagcsagccatccaagsagcgatggacggcggcaagaagagccggaacccgcacaaggcctccgcggactaccgcagcgasmgcaagtcagcctcmgggatgagcggcgaccaccaagaagggcggccgcggcggcangttcacctgggagggcgccgacgactacggctacggctacgcsacgaggacctcggcctcatctccaagaaaggcaacagcaacagcggacgcgctascaggcccagggaggcggcgcgcntaagaaggacgacgacgagtaggcctcgcgsstcggstcgcccgtccggtcccgtcgatcgccagcaagacccaacaagcccttctggctgtttaattccagtctsagttcgattctcat

SEQ ID NO: 47 - protein, 119 aa, Zea mays
  misc_feature: Ceres CLONE 211239-F
  misc_feature (20)..(20): Xaa is any aa, unknown, or other
  misc_feature (21)..(21): Xaa is any aa, unknown, or other
  misc_feature (39)..(39): Xaa is any aa, unknown, or other
  misc_feature (54)..(54): Xaa is any aa, unknown, or other
  misc_feature (72)..(72): Xaa is any aa, unknown, or other
  misc_feature (80)..(80): Xaa is any aa, unknown, or other
  misc_feature (90)..(90): Xaa is any aa, unknown, or other
  misc_feature (92)..(92): Xaa is any aa, unknown, or other
  misc_feature (115)..(115): Xaa is any aa, unknown, or other
MDGGKKSRNPHKASADYRSXXKSASGMSGDHQEGRPRRXVHLGGRRRLRLRLRXEDLGLISKKGNSNSGRAXRPREAARXRRTTTSRPRXSXRPSGPVDRQQDPTSPSGCLIPVXVRFS

SEQ ID NO: 48 - DNA, 235 bp, Zea mays
  misc_feature: Ceres CLONE 211273-F
  misc_feature (107)..(107): n is a, c, t, g, unknown, or other
  misc_feature (168)..(168): n is a, c, t, g, unknown, or other
aaagataaaatcgagaggacgccagggccgattctctgcgtgacttggggcgtcgtcgcgagttttctccggccgagggcggcgcgaccggacaaccagcgtgascngaccggcgacatgactcgcggcaaccagcgtgaccgcgaccgtgagcgcgcggcggcsganagcccaacgccaagaactcccaggacgggctcaccccgggagcagcgccgcgaagagggacaagaaa

SEQ ID NO: 49 - DNA, 434 bp, Zea mays
  misc_feature: Ceres CLONE 211293-F
  misc_feature: Encodes the peptide sequence at SEQ ID NO. 50
  misc_feature (138)..(138): n is a, c, t, g, unknown, or other
  misc_feature (420)..(420): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggcckgkckcwwkgycggcgggcgancgaagaagtcggtgtcgcggtcctccagggccgggctgcagttccccgtcagccgcgtcgggcgttacctcaaaaagggccggtacgcgcabgtaggcacgggtgcccccgtstacctcgccgccgtcctggagtacctcgcggccgagctgctcgagctcgccggcaacgcggcaagggacaacaagaagacgcgcatcatcccgcgccacgtgctcctcgccatccgcaacgacgaggagctcggcaagctgctggccggcgtcaccatcgcccacgsgngtcctccccaacat

SEQ ID NO: 50 - protein, 144 aa, Zea mays
  misc_feature: Ceres CLONE 211293-F
  misc_feature (52)..(124): Pfam Name: Histone Pfam Description: Core histone H2A/H2B/H3/H4
  misc_feature (29)..(29): Xaa is any aa, unknown, or other
  misc_feature (39)..(39): Xaa is any aa, unknown, or other
  misc_feature (40)..(40): Xaa is any aa, unknown, or other
  misc_feature (41)..(41): Xaa is any aa, unknown, or other
  misc_feature (42)..(42): Xaa is any aa, unknown, or other
  misc_feature (46)..(46): Xaa is any aa, unknown, or other
  misc_feature (76)..(76): Xaa is any aa, unknown, or other
  misc_feature (139)..(139): Xaa is any aa, unknown, or other
  misc_feature (140)..(140): Xaa is any aa, unknown, or other
SYISTLNSQGPFFFSIWKRRSSSHGRERXGGKAKKGAAXXXXGGRXKKSVSRSSRAGLQFPVSRVGRYLKKGRYAXVGTGAPVYLAAVLEYLAAELLELAGNAARDNKKTRIIPRHVLLAIRNDEELGKLLAGVTIAHXXPPQH

SEQ ID NO: 51 - DNA, 292 bp, Zea mays
  misc_feature: Ceres CLONE 211309-F
  misc_feature: Pfam Name: DUF1210 Pfam Description: Protein of unknown function (DUF1210)
  misc_feature (5)..(5): n is a, c, t, g, unknown, or other
acacncaaacacacaatggcaccagaaatggatgctcctcggcgtctgtgccgtgctdgatgdgtggtcggcgtcatsgaacgcggcggagggccaggtggcgtcggtcgtcgtgggcctggcgaggtgcgccgacagcacgaggaatgaacatgaaggctgaggccggtttcaagggtcttcaggtggcgatcaagttgcaagaacatgcaacggcgagtacgagacaaaggccgtgaktgagatccaaagctwmcggagccttcagcgtcccahtcgccgccgacctcca

SEQ ID NO: 52 - DNA, 354 bp, Zea mays
  misc_feature: Ceres CLONE 211312-F
  misc_feature (198)..(198): n is a, c, t, g, unknown, or other
  misc_feature (221)..(221): n is a, c, t, g, unknown, or other
  misc_feature (320)..(320): n is a, c, t, g, unknown, or other
actcgtctcatctcttccatactaccataccctacctccaaattcccaattgtcaacctctcctcagagttcgagtgaccatgtcggggcgcggaaagggcgggaaggggctgggcaakggcggcgcgamstcaccgcaaggtcctccgcgacaacatccatgggcattacraagccggcgatccggaggctggcganaaggggcggcgtgaagcsatctnggggctcatctacgaggagacccgcggcgtgctcaagatcttcctcgagaatgtcattcgcgacgctgtcacctacacggagcacgcccgccgtaagancgtcaccgccatggacgtcgtctacgcgctcaag

SEQ ID NO: 53 - DNA, 432 bp, Zea mays
  misc_feature: Ceres CLONE 211329-F
  misc_feature: Translation starting site: 67
  misc_feature (55)..(55): n is a, c, t, g, unknown, or other
  misc_feature (391)..(391): n is a, c, t, g, unknown, or other
aagcgccactaatctcgccttccgaggaaactcaccagcccaccacagacccgancggaagaagccatgtscgggcgcggtaagggtggcaaggggctcggcaagggcggcgcgavtcaccggaaggtgctgcgcgacaacatccagggcatcaccaagccggcgatccggcgctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagsscagggccgcaccctctacggcttcggcggctaggctgatgggctccctcgngatgttctccccttctgcagatgcgacgttttctggcsgtg

SEQ ID NO: 54 - DNA, 454 bp, Zea mays
  misc_feature: Ceres CLONE 211343-F
  misc_feature: Translation starting site: 75
aacaacaacagcaacccgcacaagcmctcttcctcgattttmctcctccgtscgcgtagttctcggtttcggcgatgtcggggcgcggcaagggcggcaaggggctgggcaagggcggcgccaagcgcaccgcaaggkcttcgcgcgacaacatccagggcatcacgaagccggcgatccgtagctggccaggaggggcggcgtcaagcgcatttctgggctcatctacgaggaaacccgcggcgtgctcaagatcttcctcgagaacgtcatccgcgacgccgtcacctacaccgagcacgcccgccgcaagactgtcaccgccatggatgtcgtctacgcgctcaagcgccagggccggacgctctacggcttcggcggctaggcsttcccctttctgatgctttgatatgacgggccgtggtcggttgtgtgtctagttggccggtctact

SEQ ID NO: 55 - DNA, 453 bp, Zea mays
  misc_feature: Ceres CLONE 211377-F
  misc_feature: Translation starting site: 71
aatacatttcgactctcaactcccaaggtccctttttttttctcgatctggaagcgccgcagtatcagccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcrbktaggcacgggtgcccccgtctacctcgccgccgtcctggagtacctcgcggccgaggtgctcgagctcgccggcaacgcscaagggacaacaagaagacgcgcatcattccgcgccacgtgctcctcgccatccgcaacgacgaggagctcggcaagctgctggccggcgtcaccatcgcccacggsgcgtcctccccaacatccacactgtggctccctccccaa

SEQ ID NO: 56 - DNA, 499 bp, Zea mays
  misc_feature: Ceres CLONE 211461-F
aatgaagtcgccgaaccacctcctatcggtaccaaactagcagcgccaatggggtcagggtgagaccgccgacgctgttcctcaacttcgccatcggtcggagtctgccaggcggccgggtttgggaacgccaatgccgggagagaaattaagatcgacctgtgtggatcttcctcaagcgcgagatgtagggatggatggcctcggcatggtgttcccttgccggtgcgggtctcgccgcggtgccgcaaccccgacgtggaccgatctcgtctcaaccttgtcgctgacgagcaagctacagaggattctgaggttcagctggtagagactgctgagcaggagctcgttgaaggagaagaataggtggttcaagtggagccaagtatcgaggagttcgattcgatctaggtggcgtctcccagtcagctttctggcgccaaggatagattttagatcctgcgatatttatctcttattttgtaagacttccgctatg

SEQ ID NO: 57 - DNA, 270 bp, Zea mays
  misc_feature: Ceres CLONE 211494-F
  misc_feature: Encodes the peptide sequence at SEQ ID NO. 58
  misc_feature (173)..(173): n is a, c, t, g, unknown, or other
agtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggcwccgaagccgaagcctgccgccgccaagccgaasnccaccgctgaagtgcctcccacccgccttacttcgaggatgatcaaggaggctatccacggcgctcaaggagaggaccggctccaggctcgcaagcg

SEQ ID NO: 58 - protein, 60 aa, Zea mays
  misc_feature: Ceres CLONE 211494-F
  misc_feature (28)..(28): Xaa is any aa, unknown, or other
  misc_feature (29)..(29): Xaa is any aa, unknown, or other
MPALAKPASRTAKPAAAPKPKPAAAKPXXTAEVPPTRLTSRMIKEAIHGAQGEDRLQARK

SEQ ID NO: 59 - DNA, 573 bp, Zea mays
  misc_feature: Ceres CLONE 211511
  misc_feature: Encodes the peptide sequence at SEQ ID NO. 60
cttctcgcccaagccgcgccgccggcgckstcctttgtaaaggcctcgcggcacgggagcggcctgcgctccctctctctggattaggcaaagcatcctcctgtttggatcggcatggagaagacgacgacgacggcgcagycggtctgcgcgcaggagtcgctggctctgctcaactgcgtcgcctcggtcccctacgaccgggataggtgcctcgccctcgtcgacgccctccgtgaatgcatcgtgcgcaagagggtgaagaakttttcgctggcagaaccaagctccaccacaaccaccgaagctctgaagagcgatacgaagccctgagcattctgcaaagaaaactgtatcatctgattgggcgcggttgatgataagtctatgcctgttaatgtagcgttagatttgtacttttgaacccatgccagatgtacttgtgccagaaatcaccaatctgttgaactgaaaacgttacccgatgtccacacaaatgatacagtccatgatgccatttcgataagaaaggcaccatccatccaaggttttctaacaaaaaaaaaaaaaaaa

SEQ ID NO: 60 - protein, 72 aa, Zea mays
  misc_feature: Ceres CLONE 211511
  misc_feature (10)..(10): Xaa is any aa, unknown, or other
  misc_feature (51)..(51): Xaa is any aa, unknown, or other
MEKTTTTAQXVCAQESLALLNCVASVPYDRDRCLALVDALRECIVRKRVKXFSLAEPSSTTTTEALKSDTKP

SEQ ID NO: 61 - DNA, 167 bp, Zea mays
  misc_feature: Ceres CLONE 211534-F
  misc_feature: Encodes the peptide sequence at SEQ ID NO. 62
  misc_feature (96)..(96): n is a, c, t, g, unknown, or other
  misc_feature (117)..(117): n is a, c, t, g, unknown, or other
agaggggagcagcgagatcgtgcgcgcctccgagatctccacgaaktgtggtaacatggggctcaccttcacgaagctcttcaaccggctcttctncaagaaagagatgagratccntatggttggtstcgatgcagctggtaagaccaccatcctctacaagctca

SEQ ID NO: 62 - protein, 37 aa, Zea mays
  misc_feature: Ceres CLONE 211534-F
  misc_feature: Functional homolog of the protein sequence given in SEQ ID NO 96849
  misc_feature: Useful for making plants with altered alkaloid content
  misc_feature: Useful for making plants with altered lignin content
  misc_feature: Functional homolog of the protein sequence given in SEQ ID NO 96850
  misc_feature: Useful for making plants with altered terpenoid content
  misc_feature: Functional homolog of the protein sequence given in SEQ ID NO 96851
  misc_feature: Useful for making plants with modulated nitrogen use efficiency
  misc_feature (14)..(14): Xaa is any aa, unknown, or other
  misc_feature (21)..(21): Xaa is any aa, unknown, or other
  misc_feature (25)..(25): Xaa is any aa, unknown, or other
MGLTFTKLFNRLFXKKEMRIXMVGXDAAGKTTILYKL

SEQ ID NO: 63 - DNA, 530 bp, Zea mays
  misc_feature: Ceres CLONE 211561-F
  misc_feature: Translation starting site: 150
  misc_feature: Pfam Name: Ribosomal_L7Ae Pfam Description: Ribosomal protein L7Ae/L30e/S12e/Gadd45 family
ctctagccaaaaccctagcagccgcccggtgctccctctctgcagatctcccttcgcagccgccgaggaaccccttcacagcgcgaagatggctgaacaggaggccccagtcgtggttgaggcaccaaccccagttcttggggcagcctatggacttgatgactgctctgcrctcartgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacgggtgaagaatctgagggccttaacatagttgcaggagtatgtcwhagtcgcactagatgtgtgacatgtttt

SEQ ID NO: 64 - DNA, 336 bp, Zea mays
  misc_feature: Ceres CLONE 211564-F
  misc_feature: Encodes the peptide sequence at SEQ ID NO. 65
atccaatccagtcgcctgattgcattgggatcccatggccaagctcgccgtcctcctcctcctcctcgccgtggccgcgtcsgccacagtgccggtgcacggccgcgataccccgactgagatcaagctcatcaaaggcacggacgcctccgsygtggcgacgacagcatggartgcgtgtacacggtgttcatccggacggggtcgatcctgaaggccgggacgacgcgaacgtcacgctggagctggccgccgcggacggcaacggcgtgggggatctcgaacctgcccgcctggggcgttccaatggggcagggctactcctacttcgagcgc

SEQ ID NO: 65 - protein, 56 aa, Zea mays
  misc_feature: Ceres CLONE 211564-F
MECVYTVFIRTGSILKAGTTRTSRWSWPPRTATAWGISNLPAWGVPMGQGYSYFER

SEQ ID NO: 66 - DNA, 212 bp, Zea mays
  misc_feature: Ceres CLONE 211601-F
  misc_feature: Encodes the peptide sequence at SEQ ID NO. 67
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggcstggctgcagttccccgtcagccgcgtcgggcgtacctcaaa

SEQ ID NO: 67 - protein, 70 aa, Zea mays
  misc_feature: Ceres CLONE 211601-F
  misc_feature (30)..(30): Xaa is any aa, unknown, or other
  misc_feature (47)..(47): Xaa is any aa, unknown, or other
THTFRLSTPKVPFFFSIWKRRSSSHGRERXGGKAKKGAAGRKAGGRXKKSVSRSSRAWLQFPVSRVGRTS

SEQ ID NO: 68 - DNA, 458 bp, Zea mays
  misc_feature: Ceres CLONE 211655-F
  misc_feature: Encodes the peptide sequence at SEQ ID NO. 69
actcgtctcatctcttccatacgaccataccctacctccaaattcccaattctcaacctctcctccgagttcgagtgaccatgtcggggcgcggaaagggcgggaaggggctgggcaagggcggcgcgavtcaccgcaaggtcctccgcgacaacatccagggcattacgaagccgracgatccggagctggcragaaggggtggcgtgaagcsattctcggggctcatctacgaggagacccgcggcgtgctcaagatcttcctcgagaacgtcattcgcgacgctgtcacctacacggagcacgcccgccgcaagaccgtcaccgccatggacgtcgtctacgcgctcaagcggcagggccgcaccctctacggatttggcggctgaggggtcaggggtgtcccccagctgctgctgggtcgttgccagaagtcttgggtcgcgggtcacgaaatg

SEQ ID NO: 69 - protein, 102 aa, Zea mays
  misc_feature: Ceres CLONE 211655-F
  misc_feature (24)..(93): Pfam Name: Histone Pfam Description: Core histone H2A/H2B/H3/H4
  misc_feature (17)..(17): Xaa is any aa, unknown, or other
  misc_feature (33)..(33): Xaa is any aa, unknown, or other
  misc_feature (45)..(45): Xaa is any aa, unknown, or other
MSGRGKGGKGLGKGGAXHRKVLRDNIQGITKPXDPELARRGGVKXFSGLIYEETRGVLKIFLENVIRDAVTYTEHARRKTVTAMDVVYALKRQGRTLYGFGG

SEQ ID NO: 70 - DNA, 460 bp, Zea mays
  misc_feature: Ceres CLONE 211673-F
  misc_feature: Encodes the peptide sequence at SEQ ID NO. 71
  misc_feature (190)..(190): n is a, c, t, g, unknown, or other
aatcaggcatccaagcttaaagcaagcagatctaagctccaggcagcgtcgcgacagagtgagtgagtagcacgacaacaacaatggcttccctgaaggccgcgamgccagcggagttgcggcgcagggcaaggagccggcgcccaagctcagcgagacggcgacgaagccgtcagccgcgaaragcsgncgttaagaaggctgagcagaagccccgggaaaccaaaaggaaggtgaagagcagcaaaccggcggcggcggccaaaaagtgacgtacagtacgtgtggagtgtaatggagcttccatgcatgcatgtagtggatccatgccatgttatgaatctagtccttcctttcttgtatcttccatgtgacccggcgtgtgcgtcccttcatgtgtgatgatgccagatgaatactacaaataagacgttgtgactgtgccatcgtcgcctcaaaa

SEQ ID NO: 71 - protein, 62 aa, Zea mays
  misc_feature: Ceres CLONE 211673-F
  misc_feature (8)..(8): Xaa is any aa, unknown, or other
  misc_feature (34)..(34): Xaa is any aa, unknown, or other
  misc_feature (36)..(36): Xaa is any aa, unknown, or other
MASLKAAXPAELRRRARSRRPSSARRRRSRQPRXAXVKKAEQKPRETKRKVKSSKPAAAAKK

SEQ ID NO: 72 - DNA, 456 bp, Zea mays
  misc_feature: Ceres CLONE 211715-F
  misc_feature: Translation starting site: 261
  misc_feature: Pfam Name: Tryp_alpha_amyl Pfam Description: Protease inhibitor/seed storage/LTP family
  misc_feature (316)..(316): n is a, c, t, g, unknown, or other
  misc_feature (337)..(337): n is a, c, t, g, unknown, or other
acaacacaacgcttataatacttacaacaaaagataagcccacgaatcagtagatcgaggtcccgcccagtccagcaaaagcacacacggagatgtsscagctgagctctgctggccacatggctgcgacgttcctcctcatcctcctcgcctccgcagcagcaacggtgtcagctagaccaacaagtctctgmctgccagaatgacatagacgcactgtggcgcmstgcaagcagttcgtccagaaggaggggctcaagatgcctccgtccgaggactgctgcaaaaccatcaaggccttagacgcgcacstccntgcatctgcgactacgtcggnctccccggacgccaggaataagctagacctggacaggtgttcttcgttaccaaacagtgcggcgtcaccgtccccaagggctgcggatcgaaagcaggactgaagagcggctgaatctg

SEQ ID NO: 73 - DNA, 380 bp, Zea mays
  misc_feature: Ceres CLONE 211727-F
  misc_feature: Translation starting site: 75
  misc_feature: Pfam Name: DUF538 Pfam Description: Protein of unknown function, DUF538
  misc_feature (37)..(37): n is a, c, t, g, unknown, or other
  misc_feature (40)..(40): n is a, c, t, g, unknown, or other
  misc_feature (211)..(211): n is a, c, t, g, unknown, or other
aagcacaagcacaaccaaaagcaaagaagagacgaangtncgatcgatctcagcaactaagcaggtaggtaggcatggyggccgagaaggagggcgcggtggtgaccaagggccacgacgaggggatgaaggcggcggcggcgctgctggaggagttcgggctcccgccggggctractgccgctggaggacgtgacggaggtggggttcntgcgggccaccggctacttctggctcgcgcmscaagaaggtggagcaccggttccgcaagatcgggcaagcagggtgagctacgaacgtcgagatcgccggctacgtccggcccaggggcatcaggaggctcaaggggatcaaggccaagggagctcgtgcctctggcc

SEQ ID NO: 74 - DNA, 301 bp, Zea mays
  misc_feature: Ceres CLONE 211737-F
  misc_feature: Encodes the peptide sequence at SEQ ID NO. 75
atacatttcgactctcaactcccaaggtccctttttttttctcgatctggaagcgccgcagtagcagccatggacgtgagcggasaggcggtaaggcgaagaagggcgcggcggggcgcaaggccggcgggcgagcgaagaagtcggtgtcgcggtcctccagggccgggctgcagttccccgtcagccgcgtcgggcgtaccccaaaaagggccggtacgcgcabgtatggcacgggtgcccccgtctacctcgccgccgtcctggagtacctcgcggccgaggtgctcgagctcgccgg

SEQ ID NO: 75 - protein, 99 aa, Zea mays
  misc_feature: Ceres CLONE 211737-F
  misc_feature (28)..(28): Xaa is any aa, unknown, or other
  misc_feature (75)..(75): Xaa is any aa, unknown, or other
TFRLSTPKVPFFFSIWKRRSSSHGRERXGGKAKKGAAGRKAGGRAKKSVSRSSRAGLQFPVSRVGRTPKRAGTRXYGTGAPVYLAAVLEYLAAEVLELA

SEQ ID NO: 76 - DNA, 444 bp, Zea mays
  misc_feature: Ceres CLONE 211768-F
  misc_feature (216)..(216): n is a, c, t, g, unknown, or other
  misc_feature (226)..(226): n is a, c, t, g, unknown, or other
aagaacgatctcaatctccctagcaatctctagcagcagatcctcgtgcgavaagcgctasccccttcgtactgtcccgawggcccccacgaagcaracggcgaggaagtccactggsggcaagrcgccaaggaagcagctggccaccaaggcggcgcgcaagtmtgccccggcgamcggacggagtgaagaagrccccaccgtttccgccccggnaccgtcgcdndccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgctgggctcttcgaggacaccaacctctgcgccattcacgccaagcgcgtcaccatcatg

SEQ ID NO: 77 - DNA, 414 bp, Zea mays
  misc_feature: Ceres CLONE 211810-F
  misc_feature: Translation starting site: 76
atccatccaattcacaggctcaccacaccaaccagcaagcaaaaattccccaatcctctcgtctccgcggcgaagatgtcggggcgcggcaagggcggcaagggcctgggcaagggcggcgcgaatcaccggaaggtgctgcgcgacaacatccaggggatcacgaagccggcgatccggagctggcgcggcgggtgcggcgtgaagcgcattctcggggctcatctacgagacccgcggcgtgctcaagatcttcctggagaacgtcatccgcgacgccgtcacctacaccgagcacgcgcgccgtaagaccgtcaccgccatggacgtcgtctacgcccttaagsgccagggccgcaccctctatggcttcggcggctagggtctgccgsggccgcgcctcgcctcgccgtt

SEQ ID NO: 78 - DNA, 358 bp, Zea mays
  misc_feature: Ceres CLONE 211868-F
  misc_feature: Encodes the peptide sequence at SEQ ID NO. 79
aaggcaactcagccaagctcgtgagmagaaggaactctctttcctcacacaccaaagcagcagtggcaaagctgcgctagaggccatcaggcattaatagcccagagagcagacgaggcatggcgacgtccgtggcctgcgccttcttcttcttcgacgsggcggastgctgggamradaccgggcggcggcaagcgctggacgcctgcgcgctctgctccaagccgctggcccgcaacagcgacatcttcatgtacaggggcgacaccccgttctgcagcgaggactgccgctacgagcagatgcaccacgacgcggcggcggcgacggcctacgcgcggcacaggccagcagccgg

SEQ ID NO: 79 - protein, 79 aa, Zea mays
  misc_feature: Ceres CLONE 211868-F
  misc_feature (13)..(69): Pfam Name: DUF581 Pfam Description: Protein of unknown function (DUF581)
  misc_feature (14)..(14): Xaa is any aa, unknown, or other
  misc_feature (16)..(16): Xaa is any aa, unknown, or other
  misc_feature (19)..(19): Xaa is any aa, unknown, or other
  misc_feature (20)..(20): Xaa is any aa, unknown, or other
MATSVACAFFFFDXAXCWXXTGRRQALDACALCSKPLARNSDIFMYRGDTPFCSEDCRYEQMHHDAAAATAYARHRPAA

SEQ ID NO: 80 - DNA, 472 bp, Zea mays
  misc_feature: Ceres CLONE 211896-F
  misc_feature: Encodes the peptide sequence at SEQ ID NO. 81
aacaacaacaacaacccgcacaacggcacgattctcctcctccgtccgcgtmstctcggtttcggcgatgtcggggcgcggcaagggcggcaaggggctgggcaagggcggcgcaagcgcaccgcaaggtctgcgcgacaacatccagggcatcacgaagccggcgatccgtagctggcacaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgcagggccgcacgctctacggsttcggcggctaggctccccttctgatgctttgatgtgacggccgtggtcggttgtgtgtctagttgggcsggtctactgtagtttgttctgtatcttcgtttcgaggtg

SEQ ID NO: 81 - protein, 106 aa, Zea mays
  misc_feature: Ceres CLONE 211896-F
  misc_feature (24)..(93): Pfam Name: Histone Pfam Description: Core histone H2A/H2B/H3/H4
  misc_feature (99)..(99): Xaa is any aa, unknown, or other
MSGRGKGGKGLGKGGASAPQGLRDNIQGITKPAIRSWHRRGGVKRISGLIYEETRGVLKIFLENVIRDAVTYTEHARRKTVTAMDVVYALKRRAARSTXSAARLPF

SEQ ID NO: 82 - DNA, 406 bp, Zea mays
  misc_feature: Ceres CLONE 211907-F
  misc_feature: Encodes the peptide sequence at SEQ ID NO. 83
atcttgctctgaacgcattcctcccatctcccaagacctcctcagacccgagaagcgcmkgcggccatggacgccaccggcactggagctggagggaaggcgaagaagggagcggccggtcgcatgccggcgggccgaggaagaagtcggtgacgaggtccgtgaaggccgggatccagttccccgtcggccgcatcgggcgctacctcaagaagggccgctacgscascgtcggcagcggtgcccccgtctacctcgcggccgtcctggagtacctcgccgctgaggtcctggagctcgccggcaacgctgccaaggacaacaagaagacgcgcatcgtcccgcgcsamgtgctgctggcgatcccgcaacgacgaggagctcgggaagctgctgaccggcgtga

SEQ ID NO: 83 - protein, 134 aa, Zea mays
  misc_feature: Ceres CLONE 211907-F
  misc_feature (52)..(124): Pfam Name: Histone Pfam Description: Core histone H2A/H2B/H3/H4
  misc_feature (20)..(20): Xaa is any aa, unknown, or other
  misc_feature (75)..(75): Xaa is any aa, unknown, or other
  misc_feature (76)..(76): Xaa is any aa, unknown, or other
  misc_feature (116)..(116): Xaa is any aa, unknown, or other
LALNAFLPSPKTSSDPRSAXGHGRHRHWSWREGEEGSGRSHAGGPRKKSVTRSVKAGIQFPVGRIGRYLKKGRYXXVGSGAPVYLAAVLEYLAAEVLELAGNAAKDNKKTRIVPRXVLLAIPQRRGAREAADRR

SEQ ID NO: 84 - DNA, 491 bp, Zea mays
  misc_feature: Ceres CLONE 211975-F
  misc_feature: Encodes the peptide sequence at SEQ ID NO. 85
  misc_feature (450)..(450): n is a, c, t, g, unknown, or other
atagtcgaaggctacgagcactcgccgccactcaccagcaaattcccaagccgcccctttccccatctctttcgcgacccatttgatcgattcctgatggcgcccaaggccgagaagaagcccgcggagaaaaakccggcggaggagtaaggycgagaagaagccaagggcgagaagcgcgtgccgagcaaggagggcggcgagaagaagggaaagaagaaggcgaagaagagcgtcgagacgtacaagatctacatctttaaggtgctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggttcgcctcgtcctccccggcganctcgccaagcsacgccgtatccgaaggaccaaggcggttac

SEQ ID NO: 85 - protein, 60 aa, Zea mays
  misc_feature: Ceres CLONE 211975-F
  misc_feature: Functional homolog of the protein sequence given in SEQ ID NO 96852
  misc_feature: Useful for biocontainment applications
  misc_feature: Useful for making plants with modulated flowering time
  misc_feature (47)..(47): Xaa is any aa, unknown, or other
  misc_feature (51)..(51): Xaa is any aa, unknown, or other
MSIMNSFINDIFEKLAAEAAKLARYNKKPTITSREIQTSVRLVLPGXLAKXRRIRRTKAV

SEQ ID NO: 86 - DNA, 678 bp, Zea mays
  misc_feature: Ceres CLONE 211976-R
cccctcgaggtcgacggtatcgataagcttttttttttttttttttctttttttttttttttttttttttttttttttttttttttttttttttttttttttttttttttttttttttttaaaaaaaataaagggttcttccccttgaactccttgcgaaattcctccatgaacacaaaaaaagcgctgggagccctcttaggtttgttggggtccttgccggccttccctttcttgcccttggggggcttctccccccccttgtttttcaccgccagcttggactcggacttgggggcgcccttggatttggccccctccatggcgcattccacgggcaaccccgagcgcaccgttcaaatccgcgcttggcgaagggaatcccggtttgcgggcggccaaatccgggccgaaatcgagggtaaatattccctccttgaaaccccccctccaagggaagtacgcaaggggaaaacggatccaacggacttttttttctattacaatgcctccacccatggccctcgtgcgaaattcctgccacccggggggaaccccttcctcctaaaaccggtcccacacccccgccgggaaacaccacccttttgtttccctctttggggaggggttaattgtccattctctggccaaaaaaacgtgggacataaattttcttcc

SEQ ID NO: 87 - DNA, 379 bp, Zea mays
  misc_feature: Ceres CLONE 211994-F
  misc_feature (232)..(232): n is a, c, t, g, unknown, or other
  misc_feature (233)..(233): n is a, c, t, g, unknown, or other
atcttgctctgaacgcattcctcccatctcccaagacctcctcagacccgagaagcgcmtgcgggaccatggacgccaccggcactggagctggagggaaggcgaagaagggagcggccggtcgcaaggccgcgggccgaggaagaagtcggtgacgaggtccgtgaaggccgggctccagttssccgtcggccgcatcgggcgctacctcaagaagggccgctacgcgcanngtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacga

SEQ ID NO: 88 - DNA, 506 bp, Zea mays
  misc_feature: Ceres CLONE 212003-F
  misc_feature: Encodes the peptide sequence at SEQ ID NO. 89
gagaaaaagtcagatccgtgttccgtgtccgcgtccagtgtgtccgctactccgctccccctcagtcctcagttcctcacctagcggtasbgcgcgcgggagacgtagatggcggcttcggaggcggcasggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgcaacattcctgttcatgagggagggcgacgtcaaggacagggtcgttggcgcaraagggaagagctagcaaggaagcttgaactacacatgggcctcgtagatccagtgatgcc

SEQ ID NO: 89 - protein, 135 aa, Zea mays
  misc_feature: Ceres CLONE 212003-F
  misc_feature (56)..(132): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (30)..(30): Xaa is any aa, unknown, or other
  misc_feature (43)..(43): Xaa is any aa, unknown, or other
EKVRSVFRVRVQCVRYSAPPQSSVPHLAVXRAGDVDGGFGGGXAAATPVTPTEGTVIAIHSLEEWSIQIEEANSAKKLVVIDFTATWCPPCRAMAPIFADMAKKSPNVVFLKVDVDEMKTIAEQFSVEAMQHSCS

SEQ ID NO: 90 - DNA, 262 bp, Zea mays
  misc_feature: Ceres CLONE 212006-F
  misc_feature: Translation starting site: 43
  misc_feature: Pfam Name: UQ_con Pfam Description: Ubiquitin-conjugating enzyme
  misc_feature: SWISSPROT Homolog: EC 6.3.2.19 Ubiquitin--protein ligase
  misc_feature (101)..(101): n is a, c, t, g, unknown, or other
  misc_feature (103)..(103): n is a, c, t, g, unknown, or other
  misc_feature (138)..(138): n is a, c, t, g, unknown, or other
aagatagaaacgggagggaacacacccattcgatcgtcagccatggcccggggagagaaccaggagtcgcaaaccggtaacgtccccgccgcatccgcscnknyhggggccgaaccggcgttggcggggggcgggaanggcgcggagggccagtcggtggtrcggcggctgcagtcaggagctgatggcgctgatgatgggcggcgacccgggcgtgtcggcgtttcccgagggggacaacatgctccactgggtgggcacc

SEQ ID NO: 91 - DNA, 284 bp, Zea mays
  misc_feature: Ceres CLONE 212056-F
  misc_feature: Encodes the peptide sequence at SEQ ID NO. 92
  misc_feature (136)..(136): n is a, c, t, g, unknown, or other
atacatttcgactctcaactcccaaggtcccttttttttttctcgatctggaagcgccgcagtagcagcsatggacgtgagcggasaggcggtaaggcgaagaagggcgcggcgggkykyawggccggcgggcgancgaagaagtcggtgtcgcggtcctccagggccgggctgcagttccccgtcagccgcgtcgggcggtacctcaaaaagggccggtacgcgcabgtaaggcacgggtgccccgtctacctcgccgccgtcctggagtacctcgcggccga

SEQ ID NO: 92 - protein, 94 aa, Zea mays
  misc_feature: Ceres CLONE 212056-F
  misc_feature (24)..(24): Xaa is any aa, unknown, or other
  misc_feature (29)..(29): Xaa is any aa, unknown, or other
  misc_feature (40)..(40): Xaa is any aa, unknown, or other
  misc_feature (41)..(41): Xaa is any aa, unknown, or other
  misc_feature (46)..(46): Xaa is any aa, unknown, or other
  misc_feature (76)..(76): Xaa is any aa, unknown, or other
IHFDSQLPRSLFFFSIWKRRSSSXGRERXGGKAKKGAAGXXAGGRXKKSVSRSSRAGLQFPVSRVGRYLKKGRYAXVRHGCPVYLAAVLEYLAA

SEQ ID NO: 93 - DNA, 351 bp, Zea mays
  misc_feature: Ceres CLONE 212073-F
  misc_feature: Encodes the peptide sequence at SEQ ID NO. 94
  misc_feature (130)..(130): n is a, c, t, g, unknown, or other
acagctgaaasagccaaaacgcagaagctgcactgcatacatcgagctaactatctgcagcgatgtctcgctcctgctgcgtcgccgtgtcggtgcttctcgctgtcgccgcgacascagcgccaccgcncggcatggctgcacgaggaggccatggccacgggccgctggtcgcagagggtgcaagggtggcgccctccgcgtccacctgggctgccgacaaggcgtcgcgtcgaggccgagcggcggcatggcacgcagggcgacgaccagagctcgtcgggcggvagtggcagcagcggtgagcacggcaaggaggagggcgagaagcagggcaagagctgcctcacc

SEQ ID NO: 94 - protein, 80 aa, Zea mays
  misc_feature: Ceres CLONE 212073-F
  misc_feature (19)..(19): Xaa is any aa, unknown, or other
  misc_feature (23)..(23): Xaa is any aa, unknown, or other
  misc_feature (76)..(76): Xaa is any aa, unknown, or other
MSRSCCVAVSVLLAVAATXAPPXGMAARGGHGHGPLVAEGARVAPSASTWAADKASRRGRAAAWHAGRRPELVGRXWQQR

SEQ ID NO: 95 - DNA, 198 bp, Zea mays
  misc_feature: Ceres CLONE 212075-F
  misc_feature: Encodes the peptide sequence at SEQ ID NO. 96
  misc_feature (126)..(126): n is a, c, t, g, unknown, or other
  misc_feature (133)..(133): n is a, c, t, g, unknown, or other
aaaattcgagacctccaattccctcgtagcagcagcaccagtagagtctccttcctctccggcggcgatgtctgggcgcggcaagggcggcaaggggctgggcaagggcggcgcaagcggcaccsnaacgtcncgcgacaacatccaagggatcacgaagccggcgatccggagcttgcgaggaggggcggcgtgaag

SEQ ID NO: 96 - protein, 42 aa, Zea mays
  misc_feature: Ceres CLONE 212075-F
  misc_feature (20)..(20): Xaa is any aa, unknown, or other
MSGRGKGGKGLGKGGASGTXTSRDNIQGITKPAIRSLRGGAA

SEQ ID NO: 97 - DNA, 380 bp, Zea mays
  misc_feature: Ceres CLONE 212139-F
  misc_feature: Encodes the peptide sequence at SEQ ID NO. 98
attagtcgattccacaatgtatatcttagatagtttaattttgataatggatccaagatatatcaccctatgcatcttcctagtacttgtcttacatggagatacaactttggcagaaacttgcaggcagtttgttaaatgggatccattctgctttagtgcaatatgcaaggcaagttgttttatagagggaaaatcctccgatggttcctatgtaaaggggcacagatgtgaatcaaatggatatcactctgtgtgtgtttgtcttttgtgtaaaaattaggtatccaatgacatgcggatctatcttcttttgttcctctttgtcatctaggagtgttgtctaaataattatatggtaaaatagttaactagcaaaa

SEQ ID NO: 98 - protein, 78 aa, Zea mays
  misc_feature: Ceres CLONE 212139-F
  misc_feature: Functional homolog of the protein sequence given in SEQ ID NO 96853
  misc_feature: Useful for making plants with modulated salt sensitivity
MDPRYITLCIFLVLVLHGDTTLAETCRQFVKWDPFCFSAICKASCFIEGKSSDGSYVKGHRCESNGYHSVCVCLLCKN

SEQ ID NO: 99 - DNA, 343 bp, Zea mays
  misc_feature: Ceres CLONE 212210-F
  misc_feature: Encodes the peptide sequence at SEQ ID NO. 100
  misc_feature (211)..(211): n is a, c, t, g, unknown, or other
  misc_feature (265)..(265): n is a, c, t, g, unknown, or other
  misc_feature (279)..(279): n is a, c, t, g, unknown, or other
  misc_feature (290)..(290): n is a, c, t, g, unknown, or other
aatcaggcatcsaagcttaaagcaagcagatctaagctccaggcagcgtcgcgacagagtgagtgagtagcacgacaacaacaatggcttccctgaaggccgcgasgccagcggagttgcggcgcagggcaaggagccggcgcccaagctcagcgagacggcgacgaagccgtcagccgcgaaragcgsgcgttaagaaggctgagcagangccccgggaaaccaaaaggaaggtgaagagcagcaaaccggcggcggcggccanaaagtgacgtacantacgtgtggantgtaatggagcttccatgcatgcatgagtggatccatgccatgttatgaatct

SEQ ID NO: 100 - protein, 62 aa, Zea mays
  misc_feature: Ceres CLONE 212210-F
  misc_feature (8)..(8): Xaa is any aa, unknown, or other
  misc_feature (34)..(34): Xaa is any aa, unknown, or other
  misc_feature (36)..(36): Xaa is any aa, unknown, or other
  misc_feature (43)..(43): Xaa is any aa, unknown, or other
  misc_feature (61)..(61): Xaa is any aa, unknown, or other
MASLKAAXPAELRRRARSRRPSSARRRRSRQPRXAXVKKAEQXPRETKRKVKSSKPAAAAXK

SEQ ID NO: 101 - DNA, 246 bp, Zea mays
  misc_feature: Ceres CLONE 212223-F
  misc_feature: Translation starting site: 78
  misc_feature: Pfam Name: Profilin Pfam Description: Profilin
  misc_feature (118)..(118): n is a, c, t, g, unknown, or other
  misc_feature (178)..(178): n is a, c, t, g, unknown, or other
aaccgagacacsgsgtgcgaaccaagcagaccacagcaagaagcgtagtcgtcgccggaaggaaaggcgcggasaagatgtmgtggsaggcgtacgtcgatgagcacctgatgtgcrnratcgaaggacaacatctcagcgccgccgccatcgtcggtcacgrgcagsgcttgggcsngtccgagagcttccccgagttaagcctgaggaggttgctggtatcataaaggactttgatgaacctgg

SEQ ID NO: 102 - DNA, 398 bp, Zea mays
  misc_feature: Ceres CLONE 212226-F
  misc_feature: Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (90)..(90): n is a, c, t, g, unknown, or other
  misc_feature (335)..(335): n is a, c, t, g, unknown, or other
  misc_feature (341)..(341): n is a, c, t, g, unknown, or other
  misc_feature (368)..(368): n is a, c, t, g, unknown, or other
gagaaagtcagatccgtgttccgtgtccgcgtccagtgtgtccgctactccgctccccctcagtcctcagttcctcacctagcggtaskngcgcgcgggagacgtagatggcggcttcggaggcggcacggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgnagttgntgtggatgaaatgaagaccattgctgngcaattcagcgtagaggccatgcaccattc

SEQ ID NO: 103 - DNA, 444 bp, Zea mays
  misc_feature: Ceres CLONE 212234-F
  misc_feature: Encodes the peptide sequence at SEQ ID NO. 104
atacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaakgcctggtcagggcccgccgcgcccaggc

SEQ ID NO: 104 - protein, 118 aa, Zea mays
  misc_feature: Ceres CLONE 212234-F
  misc_feature (1)..(114): Pfam Name: Ribosomal_S26e Pfam Description: Ribosomal protein S26e
  misc_feature (109)..(109): Xaa is any aa, unknown, or other
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPXPGQGPPRPG

SEQ ID NO: 105 - DNA, 380 bp, Zea mays; identical to SEQ ID NO: 97
  misc_feature: Ceres CLONE 212243-F
  misc_feature: Encodes the peptide sequence at SEQ ID NO. 106

SEQ ID NO: 106 - protein, 78 aa, Zea mays; identical to SEQ ID NO: 98
  misc_feature: Ceres CLONE 212243-F

SEQ ID NO: 107 - DNA, 458 bp, Zea mays
  misc_feature: Ceres CLONE 212270-F
  misc_feature: Translation starting site: 139
  misc_feature (172)..(172): n is a, c, t, g, unknown, or other
  misc_feature (249)..(249): n is a, c, t, g, unknown, or other
  misc_feature (266)..(266): n is a, c, t, g, unknown, or other
  misc_feature (280)..(280): n is a, c, t, g, unknown, or other
  misc_feature (298)..(298): n is a, c, t, g, unknown, or other
  misc_feature (317)..(317): n is a, c, t, g, unknown, or other
  misc_feature (345)..(345): n is a, c, t, g, unknown, or other
  misc_feature (351)..(351): n is a, c, t, g, unknown, or other
  misc_feature (381)..(381): n is a, c, t, g, unknown, or other
  misc_feature (393)..(393): n is a, c, t, g, unknown, or other
  misc_feature (429)..(429): n is a, c, t, g, unknown, or other
gatgtctcgctgacgtcacctcgtgttcaccagttaccaccggagtccggagtgaagcgcaggtcgggttcgcttttttcctcggcttcttctctctcgtccatcaacccagggggaaggagcgggagggagcgagccatggtagtcagcacgttcaatggacccgggattnggatcgggttcggtgtcggctgcgggttcggcgtcgggtgggggttcggaggaatgcctcttaacatgttcggcttnggtatcggtgggggttntggatttcgtcttngactaggatggggctttngaaatgcttttgttgtcantatcgatcttcaagagttcagttccaangcattnaatttcagaagaaggcggaaggagatgatncaccaaaagttntttcaccggagcttcctcaaaagtctcgtccttatngctagtatgcctgctaccataaaaattca

SEQ ID NO: 108 - DNA, 275 bp, Zea mays
  misc_feature: Ceres CLONE 212274-F
  misc_feature (165)..(165): n is a, c, t, g, unknown, or other
aagaaaaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcggcssnaagccmaacgccaagaactcccaggacgggctcaccccggagcagcgccgcgagagggacaagaaagctctggaggagaaggcggccaagaaggcgcacaggcagcggcc

SEQ ID NO: 109 - DNA, 415 bp, Zea mays
  misc_feature: Ceres CLONE 212301-F
  misc_feature: Translation starting site: 69
  misc_feature (231)..(231): n is a, c, t, g, unknown, or other
  misc_feature (232)..(232): n is a, c, t, g, unknown, or other
atcttgctctgaacgcattcctcccatctcccaagacctcctcagacccgagaagcgcaskgcggcccatggacgccaccggcactggagctggagggaaggcgaagaagggagcggccggtcgcaaggccgcgggcgaggaagaagtcggtgacgaggtccgtgaaggccgggmtccagttccccgtcggccgcatcgggcgctacctcaagaagggccgctacgcgcanngtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaaacgacgaggagctcggggaagctgctgaccggcgtgaccatcg

SEQ ID NO: 110 - DNA, 275 bp, Zea mays
  misc_feature: Ceres CLONE 212348-F
  misc_feature (224)..(224): n is a, c, t, g, unknown, or other
  misc_feature (227)..(227): n is a, c, t, g, unknown, or other
atacatttcgactctcaactcccaaggtcccttttttttctcgatctggaagcgccgcagtagcagccatggacgtgagcggasaggcgggaaggcgaagaagggcgcggccgggcgcaaggccggcgggcgacgaagaagtcggtgtcgcggtcctccagggccgggctgcagttcsccgtcagccgcgtcgggcgtacctcaaaaagggccggtacgcgcangtnaggcacgggtgccccgtctacctcgccgccgtcctggagtacctcgcg

SEQ ID NO: 111 - DNA, 326 bp, Zea mays
  misc_feature: Ceres CLONE 212410-F
  misc_feature: Encodes the peptide sequence at SEQ ID NO. 112
  misc_feature (139)..(139): n is a, c, t, g, unknown, or other
  misc_feature (313)..(313): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagattccccgtcagccgcgtcgggcgtacctcaaaaagggccggtacgcgcrbktaggcacgggtgccccgtctacctcgccgccgtcctggagtacctcgcggccgaggtgctcgagctcgccggcaacgcgcnaagggacaacaag

SEQ ID NO: 112 - protein, 108 aa, Zea mays
  misc_feature: Ceres CLONE 212410-F
  misc_feature (30)..(30): Xaa is any aa, unknown, or other
  misc_feature (47)..(47): Xaa is any aa, unknown, or other
  misc_feature (77)..(77): Xaa is any aa, unknown, or other
  misc_feature (78)..(78): Xaa is any aa, unknown, or other
  misc_feature (105)..(105): Xaa is any aa, unknown, or other
THTFRLSTPKVPFFFSIWKRRSSSHGRERXGGKAKKGAAGRKAGGRXKKSVSRSSRAGLQIPRQPRRAYLKKGRYAXXGTGAPSTSPPSWSTSRPRCSSSPATRXGTT

SEQ ID NO: 113 - DNA, 493 bp, Zea mays
  misc_feature: Ceres CLONE 212463-F
  misc_feature: Translation starting site: 86
acccaagtccaagcaccttcccaaaaaaatcccccattttcttcgaggcgaggagagcgtgaaagacagggcaccggcagcgacgatgtcggggcgcggcaagggcggasaaagcgccaccgtaagtctccgtgacaacatccagggcatcaccaagcccgcgatccgtagctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttacttcgtttagttccttgtctgtgacgtgttggactattgttagtagtattcttcgaagttgtgtttcg

SEQ ID NO: 114 - DNA, 397 bp, Zea mays
  misc_feature: Ceres CLONE 212492-F
  misc_feature (140)..(140): n is a, c, t, g, unknown, or other
  misc_feature (235)..(235): n is a, c, t, g, unknown, or other
aactcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccrggctgcagttccccgtcagccgcgtcgggcgttacctcaaaaagggccggtacgcgcabktnagggcacgggtgccccgtctacctcgccgccgtcctggagtacctcgcggccgaggtgctcgagctcgccggcaacgscaagggacaacaagaagacgcgcatcattcggcgccacgtgctcmtcgccatccgcaacgasgaggagctcggcaagctgctgg

SEQ ID NO: 115 - DNA, 123 bp, Zea mays
  misc_feature: Ceres CLONE 212520-F
aacagcgaacacatctgcttcgcatttcttcccatcccccttcgcaacccaaaccccaacccctccgcatcgatggcgcccaaggccgagaagaagcctcgcggcrtagaagccggcggagga

SEQ ID NO: 116 - DNA, 408 bp, Zea mays
  misc_feature: Ceres CLONE 212627-F
  misc_feature: Translation starting site: 68
  misc_feature (394)..(394): n is a, c, t, g, unknown, or other
atcttgctctgaacgcattcctcccatctcccaagacctcctcagacccgagaagcgcmstgcggccatggacgccaccggcactggagctggagggaaggcgaagaagggagcggccggtcgcaaggccgcggggccgaggaagaagtcggtgacgaggtccgtgaaggccgggctaccagttccccgtcggccgcatcgggcgctacctcaagaagggccgctacgcgcagcgtcggcagcggtgcccccgtctacctcgcggccgtcctggagtacctcgccgctgaggtcctggagctcgccggcaacgctgtccaaggacaacaagaacacgcgcatcgtcccgcgccacgtgctgctggcgatccgcaacgacgaggagctcgggaanctgctgaccggcgt

SEQ ID NO: 117 - DNA, 402 bp, Zea mays
  misc_feature: Ceres CLONE 212747-F
  misc_feature: Encodes the peptide sequence at SEQ ID NO. 118
  misc_feature (134)..(134): n is a, c, t, g, unknown, or other
atacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctgcagttccccgtcagccgcgtcgggcgtacctcaaaaagggccggtacgcgcabgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcacc

SEQ ID NO: 118 - protein, 74 aa, Zea mays
  misc_feature: Ceres CLONE 212747-F
  misc_feature (28)..(28): Xaa is any aa, unknown, or other
  misc_feature (45)..(45): Xaa is any aa, unknown, or other
YISTLNSQGPFFFSIWKRRSSSHGRERXGGKAKKGAAGRKAGGRXKKSVSRSSRAGLQFPVSRVGRTSKRAGTR

SEQ ID NO: 119 - DNA, 402 bp, Zea mays; identical to SEQ ID NO: 117
  misc_feature: Ceres CLONE 212747-F2
  misc_feature (134)..(134): n is a, c, t, g, unknown, or other

SEQ ID NO: 120 - DNA, 146 bp, Zea mays
  misc_feature: Ceres CLONE 212822-F
ccagcaagaccaaccaacccacttctgactgaccactgtgccgcgccgtgctcaccgaacggtcgaccacacagaacgacgatggcctcggcgctgsaccagaccaccagcttcctcgggcaggccctggtcgcccgcgccgccgg

SEQ ID NO: 121 - DNA, 413 bp, Zea mays
  misc_feature: Ceres CLONE 212844-F
  misc_feature: Encodes the peptide sequence at SEQ ID NO. 122
agggtagcagcaggtagcggagggggagagagagagaggggatggattctcaagcgccgcttcgtcctcctctagctttcgcctgcttcatcttcctttgctcatccttctgcgcmraatgagatgtacgacagggttggtgcggcggcgtcagatggggagagcaggaggatrcggctgcacaccgacgggagccgcggcgacgscacgcgtggacctgggtacctctacacccgagcagttgggagatgcacaccccaattctggagcagcggacgcgagccctggcccaacatcgtcccacaggaagcgggcggtggcgaaggtgttcgggtctaggtccgtggagcgctacgggccgcgcctcaccctgctggaactaccatgagtaccggcgatgccggtggcagcgg

SEQ ID NO: 122 - protein, 71 aa, Zea mays
  misc_feature: Ceres CLONE 212844-F
  misc_feature (17)..(17): Xaa is any aa, unknown, or other
  misc_feature (28)..(28): Xaa is any aa, unknown, or other
MYDRVGAAASDGESRRXRLHTDGSRGDXTRGPGYLYTRAVGRCTPQFWSSGREPWPNIVPQEAGGGEGVRV

SEQ ID NO: 123 - DNA, 437 bp, Zea mays
  misc_feature: Ceres CLONE 212910-F
  misc_feature: Encodes the peptide sequence at SEQ ID NO. 124
  misc_feature (33)..(33): n is a, c, t, g, unknown, or other
  misc_feature (34)..(34): n is a, c, t, g, unknown, or other
  misc_feature (184)..(184): n is a, c, t, g, unknown, or other
gaccctagtccaaaccaccgcaccgacaccgannccgagccccgccgcgccgcgctacctccgctcctctcttcgcccctgccggcgtcgaggccgaagcgaaggcgagcatgcatcacgaccccaaccccttcgacgagggcagcgcgaggacaaccccttctcaaatggcaggagmsggasncaagcagcagtacggcttccggccgactgagcccgtcgggttcggcggcgctacaggggcgacgcgtcgttgacgtcccgctcgagaccatgggggactctcggagsaaggtgaaggagctctcgtcgtgggaatcagatctgaagcggcgagaggcggatatcaagaggagggaagaggcgctgaagaatgctggcgtgccaaatggaggagaagaactggccacattcttccccatcatccaccatgatat

SEQ ID NO: 124 - protein, 54 aa, Zea mays
  misc_feature: Ceres CLONE 212910-F
  misc_feature (6)..(6): Xaa is any aa, unknown, or other
MGDSRXKVKELSSWESDLKRREADIKRREEALKNAGVPNGGEELATFFPIIHHD

SEQ ID NO: 125 - DNA, 490 bp, Zea mays
  misc_feature: Ceres CLONE 212921-F
  misc_feature: Encodes the peptide sequence at SEQ ID NO. 126
gaaggcgtccaattcatccaccttgtccgtccctccctgagaaccagaaggccacccaccttccaaggcaggggaggggccatggacgacccgtcgagcgcttgaaggacgggttccacaagttcaagaccgaggtctatgacaagaagccggagctgttcgagcctctcaaggccggccaggccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaag

SEQ ID NO: 126 - protein, 68 aa, Zea mays
  misc_feature: Ceres CLONE 212921-F
  misc_feature (1)..(68): Pfam Name: Pro_CA Pfam Description: Carbonic anhydrase
  misc_feature: SWISSPROT Homolog: EC 4.2.1.1 Carbonate dehydratase
MVPAYDKTKYTGIGSAIEYAVCALKVEVLVVIGHSCCGGIRALLSLQDGAPDNFHFVENWVKIGFPAK

SEQ ID NO: 127 - DNA, 382 bp, Zea mays
  misc_feature: Ceres CLONE 212993-F
  misc_feature: Encodes the peptide sequence at SEQ ID NO. 128
  misc_feature (179)..(179): n is a, c, t, g, unknown, or other
  misc_feature (193)..(193): n is a, c, t, g, unknown, or other
  misc_feature (203)..(203): n is a, c, t, g, unknown, or other
ctagaagccaccctgccgsctcaccgcctctctcactctgagaccgcagatccgttgtccggtgagtggagccgcacgaacccatggcctccggcgagcttgcctgmacctacgccgctctcatcctcagcgacgatggcatcgcatcaccgccgagaagatcgccaygatcgymgahngcggccaacatcanggtcgagtyntactggccggcactcttcgccaagctcctggagaagcgcaacgtcgaggacctcatcctctccgttggatctggtggcggaagctgctccagttgctgctgccgcacctgctggtggtgctgcggctgctgctgccccggctgtcgaggagaagaaggaagaggcctaaggaggagtct

SEQ ID NO: 128 - protein, 99 aa, Zea mays
  misc_feature: Ceres CLONE 212993-F
  misc_feature (8)..(8): Xaa is any aa, unknown, or other
  misc_feature (29)..(29): Xaa is any aa, unknown, or other
  misc_feature (31)..(31): Xaa is any aa, unknown, or other
  misc_feature (32)..(32): Xaa is any aa, unknown, or other
  misc_feature (37)..(37): Xaa is any aa, unknown, or other
  misc_feature (40)..(40): Xaa is any aa, unknown, or other
MASGELAXTYAALILSDDGIASPPRRSPXSXXAANIXVEXYWPALFAKLLEKRNVEDLILSVGSGGGSCSSCCCRTCWWCCGCCCPGCRGEEGRGLRRS

SEQ ID NO: 129 - DNA, 736 bp, Zea mays
  misc_feature: Ceres CLONE 213022
  misc_feature: Encodes the peptide sequence at SEQ ID NO. 130
accgcgaaaccttatccccagaaccacacggataaaccctagctgcgcgagccccccggcgatgtcggtggccatccgctccggcgagctccttgcgtgccccgtcgcactccggcgggcgcccttggctgtgtctgtggtgtcggtgcggatgagggctaggggcgccgtggctgtgcgggcggaggcaacggccgagggggtagggaaagaggggaagaaggcggcggggaagaagaagccggcgagcgggatcaccaagccgaagcccatctctacagagctgcgggagttcgtcggcggcgcggcggagctgccccggactgaggccatcaagctggtatgggcgcacatcaagggcaacaacctccaggatccaaacaacaagaagataataatctgcgatgagaaactgaagaagatattcggagggcgtgaccgcgttgggtttctcgaaatatccgggctgctgaacccccacttccagaaatgatagggctttttgttttgttttgttttgttttgttttgtagatcactctcctctgttgtgctagctgtggctgatgtacgacgagcacatttagctgctaaacctgggctaaaagtggtctctgtctcttgacggcggtttaaggaaggcaaatgcgttccctgaagatgcatgtgcttgtgatattcgccgttaatggtgtactagcagttgcttaatcattcatgcaaaaaaaaaaaaaaaa

SEQ ID NO: 130 - protein, 143 aa, Zea mays
  misc_feature: Ceres CLONE 213022
  misc_feature (65)..(142): Pfam Name: SWIB Pfam Description: SWIB/MDM2 domain
  misc_feature: Functional homolog of the protein sequence given in SEQ ID NO 96854
  misc_feature: Useful for making plants with modulated biomass
MSVAIRSGELLACPVALRRAPLAVSVVSVRMRARGAVAVRAEATAEGVGKEGKKAAGKKKPASGITKPKPISTELREFVGGAAELPRTEAIKLVWAHIKGNNLQDPNNKKIIICDEKLKKIFGGRDRVGFLEISGLLNPHFQK

SEQ ID NO: 131 - DNA, 466 bp, Zea mays
  misc_feature: Ceres CLONE 213036-F
  misc_feature: Encodes the peptide sequence at SEQ ID NO. 132
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaat

SEQ ID NO: 132 - protein, 135 aa, Zea mays
  misc_feature: Ceres CLONE 213036-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYN

SEQ ID NO: 133 - DNA, 281 bp, Zea mays
  misc_feature: Ceres CLONE 213236-F
  misc_feature: Encodes the peptide sequence at SEQ ID NO. 134
  misc_feature (154)..(154): n is a, c, t, g, unknown, or other
  misc_feature (157)..(157): n is a, c, t, g, unknown, or other
acagtcgcctccttcctgcgccgccgccgccgccgccgccgccgctaccaccgcctcgcgccgcctgcggtccgcgtttccgcacggaatgttggtgaaggtwtcttgaggctgagaacatggtgctgaagacggaactttgccgcttcagcgncangaagatttatyctgggaaaggcattagatttatccgtgctgattctcaggtcttccttttwgccaactcgaaatgcaascgctacttccacaaccgcctgaagcctgcaaagcttacctggaca

SEQ ID NO: 134 - protein, 54 aa, Zea mays
  misc_feature: Ceres CLONE 213236-F
  misc_feature (3)..(54): Pfam Name: Ribosomal_L24e Pfam Description: Ribosomal protein L24e
  misc_feature (12)..(12): Xaa is any aa, unknown, or other
  misc_feature (13)..(13): Xaa is any aa, unknown, or other
  misc_feature (17)..(17): Xaa is any aa, unknown, or other
  misc_feature (33)..(33): Xaa is any aa, unknown, or other
  misc_feature (39)..(39): Xaa is any aa, unknown, or other
MVLKTELCRFSXXKIYXGKGIRFIRADSQVFLXANSKCXRYFHNRLKPAKLTWT

SEQ ID NO: 135 - DNA, 465 bp, Zea mays
  misc_feature: Ceres CLONE 213256-F
  misc_feature: Encodes the peptide sequence at SEQ ID NO. 136
  misc_feature (427)..(427): n is a, c, t, g, unknown, or other
aaaaaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatntggttcatcctctaaaggtttctctggaggatttgtac

SEQ ID NO: 136 - protein, 134 aa, Zea mays
  misc_feature: Ceres CLONE 213256-F
  misc_feature (13)..(71): Pfam Name: DnaJ Pfam Description: DnaJ domain
  misc_feature (122)..(122): Xaa is any aa, unknown, or other
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDXVHPLKVSLEDLY

SEQ ID NO: 137 - DNA, 510 bp, Zea mays
  misc_feature: Ceres CLONE 213300-F
  misc_feature: Encodes the peptide sequence at SEQ ID NO. 138
atccttccactcaaacgatcgcaacacgatccaaagaacgacgtggggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcaccggaccgatggagcgctgcccgacctgtgaccgggttccccatcccgtgcctggaagcggacaccgcca

SEQ ID NO: 138 - protein, 128 aa, Zea mays
  misc_feature: Ceres CLONE 213300-F
MADPSYWIGMDIETSVTMLVICLAAAVVSVCLFFIFMCIVQWLDSPRMRVFRLGGVTTLRQNLDYTCTLCQNSMEAGEKVRTLSCDHVFHCGGSVKCEGIDHCLRTGPMERCPTCDRVPHPVPGSGHR

SEQ ID NO: 139 - DNA, 169 bp, Zea mays
  misc_feature: Ceres CLONE 213315-F
  misc_feature: Encodes the peptide sequence at SEQ ID NO. 140
aaacccaccgcggggatgcggatcccctgctccccacctccaccgccgcctcaccgccgccctacctcgacccgcatcccgccgactcctacacctacacggtcttccttgtccccgttcgcctccgccgcggcctctgtcgcgscgttgcatcgtcccctgcctcacc

SEQ ID NO: 140 - protein, 55 aa, Zea mays
  misc_feature: Ceres CLONE 213315-F
  misc_feature (48)..(48): Xaa is any aa, unknown, or other
THRGDADPLLPTSTAASPPPYLDPHPADSYTYTVFLVPVRLRRGLCRXVASSPAS

SEQ ID NO: 141 - DNA, 93 bp, Zea mays
  misc_feature: Ceres CLONE 213368-F
acaaattaccaaaccctaccccttcgccgcgaccggattcccccacatcgttrgsgatgagctcctcctccaacagcgggaagaagccggcgc

SEQ ID NO: 142 - DNA, 309 bp, Zea mays
  misc_feature: Ceres CLONE 213453-F
  misc_feature: Encodes the peptide sequence at SEQ ID NO. 143
  misc_feature (128)..(128): n is a, c, t, g, unknown, or other
  misc_feature (131)..(131): n is a, c, t, g, unknown, or other
  misc_feature (180)..(180): n is a, c, t, g, unknown, or other
  misc_feature (182)..(182): n is a, c, t, g, unknown, or other
accacagaataatggagcggcagactcgattcgtcctgctcgtcttcgccatcggggctctcctcgccagctccgccgccgcgacttgtcggcgctgctggttccctgcacgcgctgccgctgcggcngtncasggacgacgacgcaagcagcttcgtggaggaggcggcgtacccgcgngngagggcgctgtacggggggcgggtccatcagctacggggcgctcaccgcgaacaaggccgtctgctacggctcgtgcgccgctcgtgggcaggcgtwtacccgcggctgcctggccatctacgggtg

SEQ ID NO: 143 - protein, 102 aa, Zea mays
  misc_feature: Ceres CLONE 213453-F
  misc_feature (43)..(43): Xaa is any aa, unknown, or other
  misc_feature (44)..(44): Xaa is any aa, unknown, or other
  misc_feature (45)..(45): Xaa is any aa, unknown, or other
  misc_feature (60)..(60): Xaa is any aa, unknown, or other
  misc_feature (61)..(61): Xaa is any aa, unknown, or other
  misc_feature (93)..(93): Xaa is any aa, unknown, or other
PQNNGAADSIRPARLRHRGSPRQLRRRDLSALLVPCTRCRCGXXXTTTQAASWRRRRTRXXGRCTGGGSISYGALTANKAVCYGSCAARGQAXTRGCLAIYG

SEQ ID NO: 144 - DNA, 504 bp, Zea mays
  misc_feature: Ceres CLONE 213457-F
  misc_feature: Translation starting site: 104
  misc_feature: Pfam Name: KH_2 Pfam Description: KH domain
gtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcagatcagggagcttacctccgtcgtccagaagaggttcaacttccctgagaatggcgtcgagctttacgccgagaaggtcgtcaaccgtgggctctgtgccatcgcgcaggcctagtccctccgttacaagctcctcggaggccttgccgtccgcaggcttgctatggtgttcttcgttatgttatggagagtggtgccaagggttgtg

SEQ ID NO: 145 - DNA, 522 bp, Zea mays
  misc_feature: Ceres CLONE 213458-F
  misc_feature: Encodes the peptide sequence at SEQ ID NO. 146
cttgttcttctggctcctcctgcttcctcatgatcaagcgtgtgtcctctgctccgtccttgtccagatggacgatccaatacaagcaattgggacatacaatatatcggagaagccacgttctggcctttgctagtgcagataggcgccgtcaagcagaagcgatcaacggggcattggcagtgataggactcacggctggattgctagtggaggctcagacaggaaaggacatcttagggcagctagctggatatctgacggctatttctagtttatttgggcaataacactggaccatggttggagatttatttttcacgttccacggccaggagaggtcttatctgaatcttatttgatggatccacccaatttttttgggagctgatcccagatggatgtggaatagcgcacccagacttgtatgttgatcaagcacgatagcatgggctgaacattagtatttctatgtagcacatcaatttctgacgatagcgcctgctaaaagagcagttctat

SEQ ID NO: 146 - protein, 95 aa, Zea mays
  misc_feature: Ceres CLONE 213458-F
CSSGSSCFLMIKRVSSAPSLSRWTIQYKQLGHTIYRRSHVLAFASADRRRQAEAINGALAVIGLTAGLLVEAQTGKDILGQLAGYLTAISSLFGQ

SEQ ID NO: 147 - DNA, 379 bp, Zea mays
  misc_feature: Ceres CLONE 213481-F
  misc_feature: Encodes the peptide sequence at SEQ ID NO. 148
  misc_feature (271)..(271): n is a, c, t, g, unknown, or other
cacgacttctacgcctccaccacgaggcacgcaacaattagaacacatctcgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctscggsgrsgcgcdatcccttccctgaagccttctcstncccgaacaaggcttctcaagatgccgctgaggccggagaggacaacctgagctcgatgtgggaggaagctggcgacgccgacgacatctttgactcccccggyagcgc

SEQ ID NO: 148 - protein, 61 aa, Zea mays
  misc_feature: Ceres CLONE 213481-F
  misc_feature (54)..(54): Xaa is any aa, unknown, or other
  misc_feature (56)..(56): Xaa is any aa, unknown, or other
  misc_feature (58)..(58): Xaa is any aa, unknown, or other
MMWRSRARALLLLRSTITRPPPPPPQPYPTRTLTRVPPPRFLSSSPDPIPDSSXGXAXSLP

SEQ ID NO: 149 - DNA, 391 bp, Zea mays
  misc_feature: Ceres CLONE 213483-F
  misc_feature: Encodes the peptide sequence at SEQ ID NO. 150
atcagaatcggaccaccacacgcccgaggcsmgactgcaagcgcctgagcccaagacccatggccatggccgccgccaccgtcgcagsdtctctgcccgtggcgcaggggctcgggaagcccctctgcgccggaagcaacgcgccgtcgctccgggccgtcgcgggcgcgccccgtcgtcggtcggccaggaccaggatggccgtcgtccgggcgtccgcgcaaaagcagcacccggccaaggastgggcggccgcggctgccgtggcggcggcgctggtgcttccggagtcgcggaggccgcgccgggggatctccccgtcgctcaagaacttsctcctcagcatcgtstccggtggggtcgtgstcgtcgccatcgtcggcgccgtcgt

SEQ ID NO: 150 - protein, 108 aa, Zea mays
  misc_feature: Ceres CLONE 213483-F
  misc_feature (8)..(8): Xaa is any aa, unknown, or other
  misc_feature (60)..(60): Xaa is any aa, unknown, or other
  misc_feature (90)..(90): Xaa is any aa, unknown, or other
  misc_feature (101)..(101): Xaa is any aa, unknown, or other
MAAATVAXSLPVAQGLGKPLCAGSNAPSLRAVAGAPRRRSARTRMAVVRASAQKQHPAKXWAAAAAVAAALVLPESRRPRRGISPSLKNXLLSIVSGGVVXVAIVGAV

SEQ ID NO: 151 - DNA, 492 bp, Zea mays
  misc_feature: Ceres CLONE 213571-F
  misc_feature: Encodes the peptide sequence at SEQ ID NO. 152
  misc_feature (414)..(414): n is a, c, t, g, unknown, or other
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaangggagaggatgtggttcatcctctgaaggtttctctggaggatttgtacaatggcacatcgaagaagctctctctgtc

SEQ ID NO: 152 - protein, 143 aa, Zea mays
  misc_feature: Ceres CLONE 213571-F
  misc_feature (13)..(71): Pfam Name: DnaJ Pfam Description: DnaJ domain
  misc_feature (118)..(118): Xaa is any aa, unknown, or other
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRXGEDVVHPLKVSLEDLYNGTSKKLSL

SEQ ID NO: 153 - DNA, 397 bp, Zea mays
  misc_feature: Ceres CLONE 213580-F
  misc_feature: Encodes the peptide sequence at SEQ ID NO. 154
  misc_feature (127)..(127): n is a, c, t, g, unknown, or other
  misc_feature (130)..(130): n is a, c, t, g, unknown, or other
  misc_feature (131)..(131): n is a, c, t, g, unknown, or other
  misc_feature (133)..(133): n is a, c, t, g, unknown, or other
ataccatccatcgatcgatcaacaatacataggcaatccatctcctcccacatgtacagctcgctttccgatctagcaatgtcaacgggagcaacggagatgatcgtagccaccgsygtrkkgcygntanngnaccaggtgcatgtcgtcgacggcgagagcagaggacgtgatcgtgtccaccgscgtggccaccgsggccggcaccaagtgcacatgttcaagatcgacggctacaagcggatcaaggccatgtacggcaagggcaggagcatcgactcctgcaggttcgaggtggctggccgcgcatggaagatcctcttcttccccaacggcgactgcgggacaccgcgggccacgtctccctcttcctcaagctggacgacgacgacaccgt

SEQ ID NO: 154 - protein, 99 aa, Zea mays
  misc_feature: Ceres CLONE 213580-F
  misc_feature (6)..(6): Xaa is any aa, unknown, or other
  misc_feature (8)..(8): Xaa is any aa, unknown, or other
  misc_feature (9)..(9): Xaa is any aa, unknown, or other
  misc_feature (10)..(10): Xaa is any aa, unknown, or other
  misc_feature (11)..(11): Xaa is any aa, unknown, or other
  misc_feature (12)..(12): Xaa is any aa, unknown, or other
MIVATXVXXXXXQVHVVDGESRGRDRVHRRGHRGRHQVHMFKIDGYKRIKAMYGKGRSIDSCRFEVAGRAWKILFFPNGDCGTPRATSPSSSSWTTTTP

SEQ ID NO: 155 - DNA, 466 bp, Zea mays
  misc_feature: Ceres CLONE 213585-F
  misc_feature: Encodes the peptide sequence at SEQ ID NO. 156
aaaaccctcgcgggcagaaggcaaactcggctgcgagckcggcgcccctctcccactccccagccgccgccagcccgcacacccctccctcgcgcgctcagggtttcggaatggaagycgaggcggcggcsaagaggacgcgggagagcggggaggacgccgccgcggcggggatctccgccrtcatcccgggatggttctccgagatcacccccatgtggcccggtgaggcgcactctttgaaggtggagaaggtgctgttccaagggaagtcagactaccaaaacgttatggtctttcagtcctctacgtacgggaaggtgctcgtccttgatggagttattcaggttacggagagggatgagtgtgcgtaccaagagatgatcactcacctgcccctttgctccatcaaaagatcccaagaaggtgttggttattggagggggtgatagtggtgttctgcgtg

SEQ ID NO: 156 - protein, 112 aa, Zea mays
  misc_feature: Ceres CLONE 213585-F
  misc_feature: SWISSPROT Homolog: EC 2.5.1.16 Spermidine synthase
  misc_feature (3)..(3): Xaa is any aa, unknown, or other
  misc_feature (25)..(25): Xaa is any aa, unknown, or other
MEXEAAAKRTRESGEDAAAAGISAXIPGWFSEITPMWPGEAHSLKVEKVLFQGKSDYQNVMVFQSSTYGKVLVLDGVIQVTERDECAYQEMITHLPLCSIKRSQEGVGYWRG

SEQ ID NO: 157 - DNA, 428 bp, Zea mays
  misc_feature: Ceres CLONE 213589-F
  misc_feature: Encodes the peptide sequence at SEQ ID NO. 158
  misc_feature (19)..(19): n is a, c, t, g, unknown, or other
  misc_feature (350)..(350): n is a, c, t, g, unknown, or other
ctccctcccctcctgcgcnccagctcccctccatcctcggccaaaaattctgcggcgagctccgatccggtccgactactaacccacgccgcagaagccgcgcgacctgatcgcgsgggggtcgaggagaggggaagcgcggcgccgcggttgcstgccaccgtaccgccgcagagaaggaaraggagcccgtatccctmcgcsccgctgcccgscgaccgatggactccgagcactggatctcgcgcctggccgccgcgaagcsttctacgcggcgcagctcggccacagcgatcgggccgggatggatgagctggagatggacgaggaggtggcccgagttcccctgnscctactgctacgaggaccasgacgtcggatccctcttgggcggcacctggaggaggagcacccgttcgaaccccaag

SEQ ID NO: 158 - protein, 41 aa, Zea mays
  misc_feature: Ceres CLONE 213589-F
  misc_feature (16)..(16): Xaa is any aa, unknown, or other
  misc_feature (23)..(23): Xaa is any aa, unknown, or other
MDELEMDEEVARVPLXLLLRGPXRRIPLGRHLEEEHPFEPQ

SEQ ID NO: 159 - DNA, 217 bp, Zea mays
  misc_feature: Ceres CLONE 213639-F
  misc_feature: Encodes the peptide sequence at SEQ ID NO. 160
  misc_feature (19)..(19): n is a, c, t, g, unknown, or other
  misc_feature (118)..(118): n is a, c, t, g, unknown, or other
astcacagctcaaaagcrnscaaaacgctagctagctgcagcgatgatgtctcgctcctgctgcctcgccgtgtcggtccttctcgcggtcgccggacascagcgggccatcgcgggngttgctgcacgaggggcgcctcgaggaggagggactgctggtcgcggagggcgcgagrgtggcgtccacctgggcgggcaacaaggtctcgcgggcgca

SEQ ID NO: 160 - protein, 58 aa, Zea mays
  misc_feature: Ceres CLONE 213639-F
  misc_feature (19)..(19): Xaa is any aa, unknown, or other
  misc_feature (45)..(45): Xaa is any aa, unknown, or other
MMSRSCCLAVSVLLAVAGXQRAIAGVAARGAPRGGGTAGRGGREXGVHLGGQQGLAGA

SEQ ID NO: 161 - DNA, 452 bp, Zea mays
  misc_feature: Ceres CLONE 213642-F
  misc_feature: Encodes the peptide sequence at SEQ ID NO. 162
  misc_feature (397)..(397): n is a, c, t, g, unknown, or other
  misc_feature (404)..(404): n is a, c, t, g, unknown, or other
cactcgtagtcckaggcactttcatctgtggcctctgcgttcgagatcgatctgagctggcaccgtcccacttcgccatggcggaggaccggagccccaagcccatccactgcaaagcggcggtgtgcagagccgccggcgagccactcaccatcgaggagatcgtcgtcgacccgccraaagcgtacgagatccgcatccgggtcgtctgcacctcactctgccacaccgatatcaccttctggaaagctaaggtggcaccggtgtttccaagaatactagggcatgaggcgtacggggtagtggagagcgtgggggagcacgtggagggcttcgcggcgggggacaccgtggtgccgacgttcctggggcagtgcgagcgctgcgccactgcgtncggagcncagcaacgtgtgcgacgcggtgccgttcgtcatcggccccggggatgc

SEQ ID NO: 162 - protein, 125 aa, Zea mays
  misc_feature: Ceres CLONE 213642-F
  misc_feature (36)..(121): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (107)..(107): Xaa is any aa, unknown, or other
MAEDRSPKPIHCKAAVCRAAGEPLTIEEIVVDPPKAYEIRIRVVCTSLCHTDITFWKAKVAPVFPRILGHEAYGVVESVGEHVEGFAAGDTVVPTFLGQCERCATAXGAQQRVRRGAVRHRPRGC

SEQ ID NO: 163 - DNA, 397 bp, Zea mays
  misc_feature: Ceres CLONE 213652-F
  misc_feature: Encodes the peptide sequence at SEQ ID NO. 164
accaacctcagcacaccaaggagagtacgtggaggagcagccatggcttcatcggtggccgccgcggcgagcacattcctgggcaccgcctggcggacccggcgccacagaacgggcgcatcgtggcccggttcgggttcgggttgggcggcaaggcgaastgcttccgaagaaggtggcgaagacatcgacctcctctgaccggccgctgtggttccccggcgccgtggcscgactacctggacggctcgctggtcggcgactacgggttcgacccgttcggtctcgggaagcccgtggagtacctgcagtttgagttggactcgctggaccagaacctggccaagaatgaggccggcggcatcatcgggcacccggtttcgagtcctccgaagtc

SEQ ID NO: 164 - protein, 131 aa, Zea mays
  misc_feature: Ceres CLONE 213652-F
  misc_feature: Functional homolog of the protein sequence given in SEQ ID NO 96855
  misc_feature: Useful for making plants with modulated water use efficiency
  misc_feature: Functional homolog of the protein sequence given in SEQ ID NO 96856
  misc_feature: Useful for making plants with modulated drought sensitivity
  misc_feature: Useful for making plants with modulated phosphate use efficiency
  misc_feature (53)..(53): Xaa is any aa, unknown, or other
  misc_feature (77)..(77): Xaa is any aa, unknown, or other
QPQHTKESTWRSSHGFIGGRRGEHIPGHRLADPAPQNGRIVARFGFGLGGKAXCFRRRWRRHRPPLTGRCGSPAPWXDYLDGSLVGDYGFDPFGLGKPVEYLQFELDSLDQNLAKNEAGGIIGHPVSSPPK

SEQ ID NO: 165 - DNA, 392 bp, Zea mays
  misc_feature: Ceres CLONE 213811-F
  misc_feature: Encodes the peptide sequence at SEQ ID NO. 166
  misc_feature (70)..(70): n is a, c, t, g, unknown, or other
  misc_feature (93)..(93): n is a, c, t, g, unknown, or other
  misc_feature (102)..(102): n is a, c, t, g, unknown, or other
  misc_feature (195)..(195): n is a, c, t, g, unknown, or other
  misc_feature (296)..(296): n is a, c, t, g, unknown, or other
  misc_feature (358)..(358): n is a, c, t, g, unknown, or other
acggatccaccggagagatctggtctgccattccctcgctccttcccgtgaaccacaaacctaacgcggnbcgcgggccggccgccgggcgangtgcgcgtntgccgtcgattgtcgccggatccatccaccatgggcggtggcaacggccagaagtccaagatggcccgcgarcgcaacttggagaagaacaanggggccaaggggagccagctcgagaccaacaagaaggccatgagcatccagtgcaaagtgtgcatgcaaacattcatgtgtaccacgactgaagtkaagtnccgggagcacgccgaggccaagcatcccaggacagacgtgtaccagtgcttcccccatctgnagaagtgaaaggcctgaacttagcraccagtgct

SEQ ID NO: 166 - protein, 77 aa, Zea mays
  misc_feature: Ceres CLONE 213811-F
  misc_feature (4)..(73): Pfam Name: DUF1909 Pfam Description: Domain of unknown function (DUF1909)
  misc_feature (21)..(21): Xaa is any aa, unknown, or other
  misc_feature (55)..(55): Xaa is any aa, unknown, or other
  misc_feature (76)..(76): Xaa is any aa, unknown, or other
MGGGNGQKSKMARERNLEKNXGAKGSQLETNKKAMSIQCKVCMQTFMCTTTEVKXREHAEAKHPRTDVYQCFPHLXK

SEQ ID NO: 167 - DNA, 269 bp, Zea mays
  misc_feature: Ceres CLONE 213923-F
  misc_feature: Translation starting site: 52
  misc_feature: Pfam Name: Lipase_GDSL Pfam Description: GDSL-like Lipase/Acylhydrolase
  misc_feature (125)..(125): n is a, c, t, g, unknown, or other
  misc_feature (198)..(198): n is a, c, t, g, unknown, or other
acttggcaatcctctctagctagctcagcatccgacgacgggacttgcacgatggatgctgctctgctcgtcgtctccctcgtcctctgcctgctggcggctgccctgcggcgwmcvrgcgsggnmttctwcrtcttcggcgactccctcgtcgacaacggcaacaacaactacctgctgaccacggcgcgcgccgancsgtcccctacggcatcgacttccccacgcaccaagccacgggccgcttctccaacgggcttaacatcccc

SEQ ID NO: 168 - DNA, 463 bp, Zea mays
  misc_feature: Ceres CLONE 213925-F
  misc_feature: Translation starting site: 141
  misc_feature: Pfam Name: DnaJ Pfam Description: DnaJ domain
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaggggagaggatgtggttcatcctctgaaggtttctctagaggatttgtacaat

SEQ ID NO: 169 - DNA, 435 bp, Zea mays
  misc_feature: Ceres CLONE 213938-F
  misc_feature: Encodes the peptide sequence at SEQ ID NO. 170
agataagggacggcacgcgacgcaactatcctctagagagagagaggaagcccgtcgttctggaagtttccacgctccgscctccgccccctggtctccgctccaatggcgccctcactcctcgccgccatgtccacctcgcccttcctagccagcagcggcagcagccgagsgcgctagsgctgcccacacccgacggctggactgcgcgtggccgcsttaagtacgaccctgccaagtggcgccgcagaacgaccgggttctcgtccgtcttgagcagatccctgagaaatctgctggcggtgtattgctaccaaaatctgctgttaagtttgagagatatctgatgggtgagattctatcgatcggtgctgaagtcagtgaagttgaggctgggaagaaggttctcttctcagacatcaatgcttatgaggt

SEQ ID NO: 170 - protein, 29 aa, Zea mays
  misc_feature: Ceres CLONE 213938-F
MGEILSIGAEVSEVEAGKKVLFSDINAYE

SEQ ID NO: 171 - DNA, 462 bp, Zea mays
  misc_feature: Ceres CLONE 213939-F
  misc_feature: Encodes the peptide sequence at SEQ ID NO. 172
  misc_feature (33)..(33): n is a, c, t, g, unknown, or other
  misc_feature (34)..(34): n is a, c, t, g, unknown, or other
  misc_feature (109)..(109): n is a, c, t, g, unknown, or other
gaccctagtccaaaccaccgcaccgacaccgannccgagccccgccgcgccgsgctacctccgctcctctcttcgcccctgccggcgtcgaggccgaagcgaaggcgangcatgcatcacgaccccaaccccttcgacgagggcagcgcgaggacaaccccttctcaaatggaggagmacggasstcaagcagcagtacggcttccggccgactgagcccgtcgggttcggcggcgctasaggggcgacgcgtcgttgacgtcccgctcgagaccatgggggactctcggagcaaggtgaaggagctctcgtcgtgggaatcagatctgaagcggcgagaggcggatatcaagaggagggaagaggcgctgaagaatgctggcgtgccaatgggaggagaagaactggccaccattcttccccatcatccaccaatggatattgcccaatgagataccagca

SEQ ID NO: 172 - protein, 58 aa, Zea mays
  misc_feature: Ceres CLONE 213939-F
MGDSRSKVKELSSWESDLKRREADIKRREEALKNAGVPMGGEELATILPHHPPMDIAQ

SEQ ID NO: 173 - DNA, 456 bp, Zea mays
  misc_feature: Ceres CLONE 213943-F
  misc_feature: Encodes the peptide sequence at SEQ ID NO. 174
  misc_feature (33)..(33): n is a, c, t, g, unknown, or other
  misc_feature (34)..(34): n is a, c, t, g, unknown, or other
  misc_feature (184)..(184): n is a, c, t, g, unknown, or other
gaccctagtccaaaccaccgcaccgacaccgannccgagccccgccgcgccgsgctacctccgctcctctcttcgcccctgccggcgtcgaggccgaagcgaaggcgagcatgcatcacgaccccaaccccttcgacgagggcagcgcgaggacaaccccttctcaaatggaggagccggassncaagcagcagtacggcttccggccgactgagcccgtcgggttcggcggcgctasaggggcgacgcgttcgttgacgtcccgctcgagaccatgggggactctcggagcaaggtgaaggagctctcgtcgtgggaatcagatctgaagcggcgagaggcggatatcaagaggagggaagaggcgctgaagaatgctggcgtgccaatggaggagaagaactgggccaccattcttcccatcatccaccatgatattgccaatgagataccagc

SEQ ID NO: 174 - protein, 60 aa, Zea mays
  misc_feature: Ceres CLONE 213943-F
MGDSRSKVKELSSWESDLKRREADIKRREEALKNAGVPMEEKNWATILPIIHHDIANEIP

SEQ ID NO: 175 - DNA, 1349 bp, Zea mays
  misc_feature: Ceres CLONE 213948
  misc_feature: Encodes the peptide sequence at SEQ ID NO. 176
aactcacacaatttcaccgaaatcctccaataccccaccctacgaatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggccctctcccccgacgagcgccacttcatctcccacgtgctcgccttcttcgccgcctccgacggcatcgtgctcgagaacctcgcctcccgcttcatgtccgatgtccaggtcgccgaggcgcgcgccttttacggcttccaaatcgccatcgagaacatccactcggagatgtactcgctgctgctcgagacctacatccgcgatggcaccgagaaggaccgcctcttccgcgccatcgaaaccgtccccgccgtacgccgcaaggccgactgggccatgcgctggatcgacggcggggagcgctttgccgagcgcctcgttgccttcgcctgcgtcgagggcatcttcttctcgggctccttctgcgccatcttctggctcaagaagcgcggcctcatgccgggcctcactttctctaatgagctcatctcccgggacgagggcctccactgcgacttcgcctgcctcctttatgacctccttcggggcaagctcgatgagtcccgcgtccgcgagatcgttgccgacgccgtcgacatcgagcgtgagttcgtttgcgacgcgctccccgtcgcgctggtcggaatgaacggcgggctcatgagccagtacatcgagttcgtcgccgaccgcctgctcatggcgctggggcacaggaagatgtacaacgtcgccaaccccttcgactggatggagctcatttccctgcagggcaagactaacttctttgagaagcgcgtcggggagtaccagaaggcgtccgtaatgtccagcctcaacggcggcgctgctgcaaaccataccttcagcatcgacgaggacttctgagttgacagttgtgatcgcgtgcttaatttattgctccgataatctcataagtcataactcataaccttattgtgctttttcttgcttgctagttgtagtagaggtaattactgatctggatggagcaaggcagtggtttggcagccaccatatgatatatatataggtggatggatggtcttccattcgctagaagtgagctgtattgtcctatctgaattacttgtcttcaatgtgaattttttatcaaaaaaaaaaaaaaaa

SEQ ID NO: 176 - protein, 339 aa, Zea mays
  misc_feature: Ceres CLONE 213948
  misc_feature (15)..(296): Pfam Name: Ribonuc_red_sm Pfam Description: Ribonucleotide reductase, small chain
  misc_feature: SWISSPROT Homolog: EC 1.17.4.1 Ribonucleoside-diphosphate reductase
MPSAPALVPACDMQEPLLAESSDRFSMFPIRYPQIWEFYKKAVASFWTAEEVDLSADARHWDAALSPDERHFISHVLAFFAASDGIVLENLASRFMSDVQVAEARAFYGFQIAIENIHSEMYSLLLETYIRDGTEKDRLFRAIETVPAVRRKADWAMRWIDGGERFAERLVAFACVEGIFFSGSFCAIFWLKKRGLMPGLTFSNELISRDEGLHCDFACLLYDLLRGKLDESRVREIVADAVDIEREFVCDALPVALVGMNGGLMSQYIEFVADRLLMALGHRKMYNVANPFDWMELISLQGKTNFFEKRVGEYQKASVMSSLNGGAAANHTFSIDEDF

SEQ ID NO: 177 - DNA, 254 bp, Zea mays
  misc_feature: Ceres CLONE 213955-F
  misc_feature: Pfam Name: Ribosomal_L24e Pfam Description: Ribosomal protein L24e
  misc_feature (153)..(153): n is a, c, t, g, unknown, or other
aktcgcctccttcctgcgccgccgccgccgccgccgccgccgctaccaccgcctcgsgccgcctgcgtccgcgtttcsgcacggaagttggtgaaggtttcttgaggctgagaacatggtgctgaagacggaactttgccgcttcagcgcgangaagatttatcctgggaaaggaattagatttatccgtgctgattactcaggtcttcctttttgccaactcgaaatgcaagcgctactkccacaaccgcctg

SEQ ID NO: 178 - DNA, 177 bp, Zea mays
  misc_feature: Ceres CLONE 213974-F
  misc_feature: Encodes the peptide sequence at SEQ ID NO. 179
gagtttccgtgccgtagcaacagacaagggagagtgggagactagcgcaacaggacagcgcacggaaagcgaggggaggggaracggagagggcgcatcggacggcggcgagatgctgagcggtgttcgatcccacggtggccaagtgcccggagtcttccgcagccccccggtcgc

SEQ ID NO: 179 - protein, 58 aa, Zea mays
  misc_feature: Ceres CLONE 213974-F
  misc_feature (28)..(28): Xaa is any aa, unknown, or other
SFRAVATDKGEWETSATGQRTESEGRGXGEGASDGGEMLSGVRSHGGQVPGVFRSPPV

SEQ ID NO: 180 - DNA, 417 bp, Zea mays
  misc_feature: Ceres CLONE 213993-F
  misc_feature: Translation starting site: 72
  misc_feature (342)..(342): n is a, c, t, g, unknown, or other
atccaattcacaggctcaccacaccaaccaacaagcaaaaattccccaatcctctcgtctccgcggcgaagatgtcggggcgcggcaagggcggcaagggcctgggcaagggcggcgcgavtcaccggaaggtgctgcgcgacaacatccaggggatcacgaagccggcgatccggagctggcgcggcggggcggcgtgaagcsatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaanscagggccgcaccctctacggcttcggcggctaggcctgccgcgccgsgcttcgccgtcgctgcggttctggtgt

SEQ ID NO: 181 - DNA, 426 bp, Zea mays
  misc_feature: Ceres CLONE 214029-F
  misc_feature: Translation starting site: 83
  misc_feature: Pfam Name: RNA_pol_Rpb6 Pfam Description: RNA polymerase Rpb6
  misc_feature: SWISSPROT Homolog: EC 2.7.7.6 DNA-directed RNA polymerase
  misc_feature (76)..(76): n is a, c, t, g, unknown, or other
aaccttcctctcgtcccagcagccgcaagcsaaaaccctagcaagcaaaccaccggagcagcggcgctcgcgcggngcggacatgggcgacgacgattacaacgaaatcgacatgggctatgaggatgagcctccagaacctgagattgaggaaggggccgaagaagagcttgaraacaacgaagatgcccctgatgatgtcataggtggagagggtgaagataaggaacaggaaaagaccaagcgtgasaaaaacaacaaaatatatgacgaakatgaacgtgcgcgcattcttggtacacgagccttgmagataagcatgaatgctccagtcatggttgagcttgagggagaactgaccctcttgagattgcgatgaaggagcttagagcgcgcaagatacccttcacgatcagacggtaccta

SEQ ID NO: 182 - DNA, 320 bp, Zea mays
  misc_feature: Ceres CLONE 214078-F
  misc_feature: Encodes the peptide sequence at SEQ ID NO. 183
  misc_feature (83)..(83): n is a, c, t, g, unknown, or other
  misc_feature (118)..(118): n is a, c, t, g, unknown, or other
acagctgaaasagccaaaacgcagaagctgcactgcatacatcgagctaactatctgcagcgatstctcgctcctgctgcgtngscgtgtcggtgcttctcgstgtcgccgcgacasnagcgccaccgcscggcatggctgcacgaggaggccatggccamgggccgctggtcgmagagggtgcaagggtagcgccctccgcgtccacctgggctgccgacaaggcgtcgccgtcgaggccgagcggcggcatggccacgcagggcgacgaccagagctcgtcggggcggcagtggcagcagcggtgagcacggcaagga

SEQ ID NO: 183 - protein, 57 aa, Zea mays
  misc_feature: Ceres CLONE 214078-F
  misc_feature (9)..(9): Xaa is any aa, unknown, or other
  misc_feature (14)..(14): Xaa is any aa, unknown, or other
MAARGGHGXGPLVXEGARVAPSASTWAADKASPSRPSGGMATQGDDQSSSGRQWQQR

SEQ ID NO: 184 - DNA, 470 bp, Zea mays
  misc_feature: Ceres CLONE 214089-F
  misc_feature: Encodes the peptide sequence at SEQ ID NO. 185
gaaggcgtccaattcatccaccttgtccgtccctccctgagaaccagaaggccacccaccttccaaggcaggggaggggccatggacgacccgtcgagcgcttgaaggacgggttccacaagttcaagaccgaggtctatgacaagaagccggagctgttcgagcctctcaaggccggccaggccccaagtacgtggtgttcgcctgctccgactcccgcgtgtgcccgtcggtgaccctgggcctgcagccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctcccctccaggacgggcgcacctgacaacttccacttcgttgagaactgggtt

SEQ ID NO: 185 - protein, 110 aa, Zea mays
  misc_feature: Ceres CLONE 214089-F
  misc_feature (14)..(110): Pfam Name: Pro_CA Pfam Description: Carbonic anhydrase
  misc_feature: SWISSPROT Homolog: EC 4.2.1.1 Carbonate dehydratase
MTRSRSCSSLSRPARPQVRGVRLLRLPRVPVGDPGPAAGEAFTVRNIAAMVPAYDKTKYTGIGSAIEYAVCALKVEVLVVIGHSCCGGIRALLSPPGRAHLTTSTSLRTG

SEQ ID NO: 186 - DNA, 411 bp, Zea mays
  misc_feature: Ceres CLONE 214092-F
  misc_feature: Encodes the peptide sequence at SEQ ID NO. 187
acaaattaccaaaccctaccccttcgccgcgaccgcgatcccccacatcgttggcgatgagctcctcctccaacagcgggaagaagccggcgcccgssgccgcggggggcccaccatccgcacgctcgccgacataaaccgtggccctgcggtttcccaggtgccggasggcaagcagcgatgacgacgagccccaggagtactacaccggcggcgagaaagagtggaatgcttttttcaagatccaacaagaagaaatgacgtggatgcaatatttgaacaagcaagacaggcgggcgctatccatggaatgcccccttttcttggtgggcgagtcttccagctctaggagctttactgggactggccgacttcttacaggggagacagtaccatctgctgcacctcagg

SEQ ID NO: 187 - protein, 51 aa, Zea mays
  misc_feature: Ceres CLONE 214092-F
MTWMQYLNKQDRRALSMECPLFLVGESSSSRSFTGTGRLLTGETVPSAAPQ

SEQ ID NO: 188 - DNA, 253 bp, Zea mays
  misc_feature: Ceres CLONE 214174-F
  misc_feature: Encodes the peptide sequence at SEQ ID NO. 189
  misc_feature (186)..(186): n is a, c, t, g, unknown, or other
  misc_feature (187)..(187): n is a, c, t, g, unknown, or other
gataaggagacggtactagtaaactgactaactgctgcccactcgccggagaaccatggccacggcggcggcgtgtgtgcgggtggcgtctccgttcacgggcccacctatctggcatcccagacacgtcatctcaacgaggcggggacccaggagggccgggctggccgtcacggcggcggstgnntagggatcgccgcgcactgtgctcgtcaccggcgcgggcggccgaacaggcaaattgtgtacaaga

SEQ ID NO: 189 - protein, 42 aa, Zea mays
  misc_feature: Ceres CLONE 214174-F
MATAAACVRVASPFTGPPIWHPRHVISTRRGPRRAGLAVTAA

SEQ ID NO: 190 - DNA, 484 bp, Zea mays
  misc_feature: Ceres CLONE 214366-F
  misc_feature: Encodes the peptide sequence at SEQ ID NO. 191
cttgttcttctggctcctcctgcttcctcatgatcaagcgtgtgtcctctgctccgtccttgtccagatggacgatccaatacaagcaattgggacatacaatatatcggagaagccacgttctggsctttgctagtgcagataggcgccgtcaagcagaagcgatcaacggggcatatggcagtgataggactmacggctggattgctagtggaggctcagacaggaaaggacatcttagggcagctagctggatatctgacggctatttctagtttatttgggcaataacactggaccatggttggagatttatttttcacgttccacggccaggagaggtcttatctgaatcttatttgatggatccacccaatttttttgggagctgatcccagatggatgtggaatagcgcacccagacttgtatgttgatcacgcacgatagcatgggctgaacattagtatttctatgtagcacatc

SEQ ID NO: 191 - protein, 90 aa, Zea mays
  misc_feature: Ceres CLONE 214366-F
  misc_feature (42)..(42): Xaa is any aa, unknown, or other
  misc_feature (65)..(65): Xaa is any aa, unknown, or other
CSSGSSCFLMIKRVSSAPSLSRWTIQYKQLGHTIYRRSHVLXFASADRRRQAEAINGAYGSDRTXGWIASGGSDRKGHLRAASWISDGYF

SEQ ID NO: 192 - DNA, 499 bp, Zea mays
  misc_feature: Ceres CLONE 214484-F
  misc_feature: Encodes the peptide sequence at SEQ ID NO. 193
  misc_feature (487)..(487): n is a, c, t, g, unknown, or other
aacaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctnctctgtcccgca

SEQ ID NO: 193 - protein, 145 aa, Zea mays
  misc_feature: Ceres CLONE 214484-F
  misc_feature (13)..(71): Pfam Name: DnaJ Pfam Description: DnaJ domain
  misc_feature (142)..(142): Xaa is any aa, unknown, or other
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLXSVP

SEQ ID NO: 194 - DNA, 516 bp, Zea mays
  misc_feature: Ceres CLONE 214495-F
  misc_feature: Encodes the peptide sequence at SEQ ID NO. 195
  misc_feature (487)..(487): n is a, c, t, g, unknown, or other
ctagctcacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgtttttttgtcttgttgcctatctggagtttatttaactaaaatcatcagttgtgtccttgagaatcgggcacttaatgtatcattttcggttctctgtgacctgntgctgttatctccaatttaactgttgatt

SEQ ID NO: 195 - protein, 60 aa, Zea mays
  misc_feature: Ceres CLONE 214495-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKKSCEAESEE

SEQ ID NO: 196 - DNA, 500 bp, Zea mays
  misc_feature: Ceres CLONE 214507-F
  misc_feature: Encodes the peptide sequence at SEQ ID NO. 197
cttgttcttctggctcctcctgcttcctcatgatcaagcgtgtgtcctctgctccgtccttgtccagatggacgatccaatacaagcaattgggacatacaatatatcggagaagccacgttctggcctttgctagtgcagataggcgccgtcaagcagaagcgatcaacggggcattggcagtgataggactcacggctggattgctagtggaggctcagacaggaaaggacatcttagggcagctagctggatatctgacggctatttctagtttatttgggcaataacactggaccatggttggagatttatttttcacgttccacggccaggagaggtcttatctgaatcttatttgatggatccacccaatttttttgggagctgatcccagatggatgtggaatagcgcacccagacttgtatgttgatcaagcacgatagcatgggctgaacattagtatttctatgtagcacatcaatttctgacgatagcg

SEQ ID NO: 197 - protein, 95 aa, Zea mays; identical to SEQ ID NO: 146
  misc_feature: Ceres CLONE 214507-F

SEQ ID NO: 198 - DNA, 414 bp, Zea mays
  misc_feature: Ceres CLONE 214522-F
  misc_feature: Encodes the peptide sequence at SEQ ID NO. 199
  misc_feature (36)..(36): n is a, c, t, g, unknown, or other
  misc_feature (79)..(79): n is a, c, t, g, unknown, or other
  misc_feature (172)..(172): n is a, c, t, g, unknown, or other
aaatcccattccgtcggccatggcgaccgccacgcngctgggctcctccttcgccatgcccgccgcagcccgtagtacnctcctstgcctccacctccttgggcttcgcacgtcgcagstcgccggcctctccctctccgcgggcgccgcaactccaaccgccgtcgccttnctcccaaagaggcagcagctccagcccattgtcgcgcggcgggtgtgccctttcacgggcaagaagacgaaccgggcgaacaaggtgtccttctccaaccacaagacgaagaagcagcagttcgtgaacstgcagtacaagaagctgtggtgggaggctggcaagcgcttcgtcaagstgcgcstctccaccaaggcgstcaagaccatcgagaagcasggtctcgatgstgtcgcgcgcaa

SEQ ID NO: 199 - protein, 131 aa, Zea mays
  misc_feature: Ceres CLONE 214522-F
  misc_feature (65)..(125): Pfam Name: Ribosomal_L28 Pfam Description: Ribosomal L28 family
  misc_feature (6)..(6): Xaa is any aa, unknown, or other
  misc_feature (34)..(34): Xaa is any aa, unknown, or other
  misc_feature (51)..(51): Xaa is any aa, unknown, or other
  misc_feature (95)..(95): Xaa is any aa, unknown, or other
  misc_feature (111)..(111): Xaa is any aa, unknown, or other
  misc_feature (113)..(113): Xaa is any aa, unknown, or other
  misc_feature (118)..(118): Xaa is any aa, unknown, or other
  misc_feature (124)..(124): Xaa is any aa, unknown, or other
  misc_feature (128)..(128): Xaa is any aa, unknown, or other
MATATXLGSSFAMPAAARSTLLCLHLLGLRTSQXAGLSLSAGAATPTAVAXLPKRQQLQPIVARRVCPFTGKKTNRANKVSFSNHKTKKQQFVNXQYKKLWWEAGKRFVKXRXSTKAXKTIEKXGLDXVAR

SEQ ID NO: 200 - DNA, 412 bp, Zea mays
  misc_feature: Ceres CLONE 214524-F
  misc_feature (200)..(200): n is a, c, t, g, unknown, or other
  misc_feature (231)..(231): n is a, c, t, g, unknown, or other
  misc_feature (292)..(292): n is a, c, t, g, unknown, or other
  misc_feature (307)..(307): n is a, c, t, g, unknown, or other
aactcacacacaggctcaccccaccaacagcaagcgaaaatctcccgatcccctctggtctccgcggcgaagatgtcggggcgcggcaagggcgggaagggcctgggcaagggcggcgcgavrccgggaaggtgctccgcgataacatccaggggatcacgaagccggcgatccggcgactggcgcgcaggggcggcgtnaagcsatctccgggctcatctacgaggaganccgcggcgtcctcaagatcttcctggagaacgtgatccgcgacgccgtcacttacaccgancacgcgcgccgcaanaccgtcacagccatggacgtcgtctacgcgctcaagcscagggccgcaccctctatggcttcggcggctaggctaggccggccgcgcctcgctgtcgtcgctgcg

SEQ ID NO: 201 - DNA, 283 bp, Zea mays
  misc_feature: Ceres CLONE 214680-F
  misc_feature: Encodes the peptide sequence at SEQ ID NO. 202
  misc_feature (126)..(126): n is a, c, t, g, unknown, or other
aagaaaaaaattctcgtgttcttcgaccggtggtggtggtgcgaacgcaaggcgaccaaggggaggcgagatgaggggggcgasggccgctcagcgtggtgacgtcgtgggtgcggcggcagccanaggtgaaggctttcttggccgttgtcaccggcatggccgcgctcgtcgtcatccgcttcatcgtccacgaccatgacaacctcttcgtcgctgccgaggctgcgcacgcgctcggcatagggcgtcctcatctacaagctcacaaaggagaagacat

SEQ ID NO: 202 - protein, 41 aa, Zea mays
  misc_feature: Ceres CLONE 214680-F
MAALVVIRFIVHDHDNLFVAAEAAHALGIGRPHLQAHKGED

SEQ ID NO: 203 - DNA, 239 bp, Zea mays
  misc_feature: Ceres CLONE 214687-F
  misc_feature: Encodes the peptide sequence at SEQ ID NO. 204
  misc_feature (103)..(103): n is a, c, t, g, unknown, or other
ctctaatactgggcaactggtttcgctccgcacttccgccgctatggccgccgcaaccttctccgcsgccggccgccggtcctctccaccgccgcggcasagnaggaaaaccgagctccccgtccctatcgcccgtcttcgccagctcgcccgcgctggcmgcctcgacgacatcaacgcgactctcgcgcccctgttcccttcccaccccgtcgccgcgstctcggccctctccacgg

SEQ ID NO: 204 - protein, 65 aa, Zea mays
  misc_feature: Ceres CLONE 214687-F
  misc_feature (19)..(19): Xaa is any aa, unknown, or other
  misc_feature (20)..(20): Xaa is any aa, unknown, or other
  misc_feature (40)..(40): Xaa is any aa, unknown, or other
  misc_feature (60)..(60): Xaa is any aa, unknown, or other
MAAATFSAAGRRSSPPPRXXRKTELPVPIARLRQLARAGXLDDINATLAPLFPSHPVAAXSALST

SEQ ID NO: 205 - DNA, 174 bp, Zea mays
  misc_feature: Ceres CLONE 214699-F
  misc_feature (128)..(128): n is a, c, t, g, unknown, or other
  misc_feature (131)..(131): n is a, c, t, g, unknown, or other
attcgttcgcgagcstcactgccagttccagcacgaatcctcgtccaatccacgcctgctgctcgcgagccatcgccacagtgctggccatgcctggagccgttgcgcttgcgccacgctcgcggcanagnctccgccgccgcgcctccacgctggctccgaacccgacaagcc

SEQ ID NO: 206 - DNA, 339 bp, Zea mays
  misc_feature: Ceres CLONE 214911-F
  misc_feature: Pfam Name: RS4NT Pfam Description: RS4NT (NUC023) domain
  misc_feature: Pfam Name: S4 Pfam Description: S4 domain
  misc_feature (57)..(57): n is a, c, t, g, unknown, or other
atcacggcggcggtggcggacggaaggcgaaggagtagcagcagcaggcgcgccgangtagcggctccccacctcgagcttgccaccatggctagaggattgaagaagcatttgaagaggctcaatgcgcccaagcattggatgctggacaagcttggcgcasttttgctcccaagccatcttctggacctcacaagtctagggagtgcctgccactgatcctcatcatcaggaacaggctcaagtatgctcttacataccgtgagtcatttccatcctgatgcaacgccatgtacttgttgatgggcaaggtcaggacagacaagacctaaccctgct

SEQ ID NO: 207 - DNA, 337 bp, Zea mays
  misc_feature: Ceres CLONE 214924-F
  misc_feature: Pfam Name: TPR_1 Pfam Description: Tetratricopeptide repeat
  misc_feature (99)..(99): n is a, c, t, g, unknown, or other
gtcagatctcccggcctgaggattcgattattctgttcgststsgcccaagtcatcgtctggtcgtssccgcagaggcgcagagcccaaagccggaagngcgccatggccgsgtcggatctggagagcaaggccaaggaggccttcgtcgacgasacttcgagctggccaccgagctctacagccaggccatcgasgccgggcccgcsascgccgacctctatgccgaccgcgcccaggssacatcaagctcggcaactacactgaggctgtggcggatgctaacaaagcaattgagcttgatcctatgatgcataagcttactaccggaaaggtgc

SEQ ID NO: 208 - DNA, 391 bp, Zea mays
  misc_feature: Ceres CLONE 214940-F
  misc_feature: Translation starting site: 299
  misc_feature: Pfam Name: MIP Pfam Description: Major intrinsic protein
aatccgtgcatacatgctcattgctcaccaaggacaagggaggaggagaggacacacagcagtagcgccgaaatggcggcgatgatgatggatagtaccgcggagaaagacctcgccggcgacgsttgcggtgagcgggcacgggcaggacttggagcggtcttgccatgaccaggagmccgccgctgcagatggtgcgagcagcagaggcctagccatcgggcgttttcgtacgggagctgatggtggagggcgtggcgtcgttcctgctggtgttctggtccgcggtggcgcgctgatgcaggagatgcacggcacgctgacgttccccatggtgtgctcgtcgtcgcgctcaccgtcgtcttcgtgctctgctggctcggcccgcgca

SEQ ID NO: 209 - DNA, 407 bp, Zea mays
  misc_feature: Ceres CLONE 214948-F
  misc_feature: Encodes the peptide sequence at SEQ ID NO. 210
  misc_feature (57)..(57): n is a, c, t, g, unknown, or other
ttccactagattaccaccacctccacctcgtsgtctcccaccaccgccgagcgcgancctagcccgatctagccggcggcaggsaccagatcccgccgcccgcktcccgggacggccccgccgaatccgccgctcctcgcactgcaacacgctcggaccacggtgcatttgatccgtcccggccgcctacacgatgtccaagtcgggagcgctggatcttgcttctggcctcggagggaagatcaacaaggtggaagtcaagtcggccgtcgatgagtataagaaatatcatggatactatggagggaaggaggaagcaaggaagtccaactatactgatatggttaataaatactatgatcttgccactagcttctatgagtatggttggggtgaatcctttccac

SEQ ID NO: 210 - protein, 71 aa, Zea mays
  misc_feature: Ceres CLONE 214948-F
  misc_feature: SWISSPROT Homolog: EC 2.1.1.41 Sterol 24-C-methyltransferase
MSKSGALDLASGLGGKINKVEVKSAVDEYKKYHGYYGGKEEARKSNYTDMVNKYYDLATSFYEYGWGESFP

SEQ ID NO: 211 - DNA, 270 bp, Zea mays
  misc_feature: Ceres CLONE 214964-F
  misc_feature (58)..(58): n is a, c, t, g, unknown, or other
  misc_feature (106)..(106): n is a, c, t, g, unknown, or other
attccactagattaccaccacctccacctcgtcgtctcccaccaccgccgagcgcgancctagcccgatctagccggcgsaggcaccagatcccgccgcccgcgtncccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtccgtc

SEQ ID NO: 212 - DNA, 433 bp, Zea mays
  misc_feature: Ceres CLONE 214989-F
  misc_feature (8)..(8): n is a, c, t, g, unknown, or other
  misc_feature (93)..(93): n is a, c, t, g, unknown, or other
  misc_feature (105)..(105): n is a, c, t, g, unknown, or other
  misc_feature (367)..(367): n is a, c, t, g, unknown, or other
acggaccnagtcggcgagcccccaggagccgactccgcctccggctctgaccggtctttagaccccccctgccccaggcgacgacgaaaccancagcgcgcgcanvccgaccactccgggaacctcacgatccaggggagatgctggtcgccgccgccgcctcgccgtcgcakccgtgaaccggtttccccagggcggagggacttgggctcagattcggcggatcttgggctgggtctcgtgcattcgagccgcggcaggcgtctgggtaaccgcttctcccgaggaaaaggaaaccaaagctgctcggccaacttttggatcaaggatcggcgaaawggaaaagaaaaatgagcggatctttttnggagggtctgtttgagcctwctggggttacgtagcctcgggcaactccgtgctaatggatttcttc

SEQ ID NO: 213 - DNA, 481 bp, Zea mays
  misc_feature: Ceres CLONE 215059-F
  misc_feature: Encodes the peptide sequence at SEQ ID NO. 214
gtcttggcggctgcggcggasacggaggcgaaggaggaggaggagcagcagcagcaggcggcgccgaggagcggcatcccactcagtccttgtaaccatggctaggggattgaagaagcacttgaagaggctcaatgcgcccaagcattggatgctcgacaagcttggcggascttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggacggacaagacctaccctgctgggttcatggatgtcatttccatccctaagacaatggagaactacaggctgctttatgacaccaagggccgcttccgtcttcacccaatcagggatgaggatgccaagttcaagctctgcaaggtgagggcc

SEQ ID NO: 214 - protein, 128 aa, Zea mays
  misc_feature: Ceres CLONE 215059-F
  misc_feature (3)..(40): Pfam Name: RS4NT Pfam Description: RS4NT (NUC023) domain
  misc_feature (26)..(26): Xaa is any aa, unknown, or other
MARGLKKHLKRLNAPKHWMLDKLGGXFAPKPSSGPHKSRECLPLILIIRNRLKYALNYREVISILMQRHVLVDGKVRTDKTYPAGFMDVISIPKTMENYRLLYDTKGRFRLHPIRDEDAKFKLCKVRA

SEQ ID NO: 215 - DNA, 472 bp, Zea mays
  misc_feature: Ceres CLONE 215093-F
  misc_feature: Encodes the peptide sequence at SEQ ID NO. 216
agaaccatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacagcaggccacgtgccgggtgcctcaaggcggcctacgttcaggtccacgctgtgstctccgcggcgcaggagctgcccggcgactgcggcctctcgctgtcctacaaacatcmcccccgacatcgactgcgacaagatcgaatgaagggatactgttc

SEQ ID NO: 216 - protein, 124 aa, Zea mays
  misc_feature: Ceres CLONE 215093-F
  misc_feature (28)..(107): Pfam Name: Tryp_alpha_amyl Pfam Description: Protease inhibitor/seed storage/LTP family
  misc_feature (91)..(91): Xaa is any aa, unknown, or other
  misc_feature (110)..(110): Xaa is any aa, unknown, or other
MKTTSSGIAVVLLVAMLAVHSALADISCSDVLNDLSPCLPFLQGKAAKPSESNNQCCDGVRALYAAADTRPDSRPRAGCLKAAYVQVHAVXSAAQELPGDCGLSLSYKHXPRHRLRQDRMKGYC

SEQ ID NO: 217 - DNA, 238 bp, Zea mays
  misc_feature: Ceres CLONE 215106-F
  misc_feature: Encodes the peptide sequence at SEQ ID NO. 218
  misc_feature (36)..(36): n is a, c, t, g, unknown, or other
  misc_feature (170)..(170): n is a, c, t, g, unknown, or other
tcccatctccatccccatccatagagctgcaggcgncctgcgctgcagccaacaagctcatcagctcaccgtacctaggaggacgaccgagcagctaaggtagtagtagctagctagccagtgatggcgggctacaaagcgcagggcggggcgctcggcgtcgtcctggntgtcgccgcgctcttcgcggcasgattggcgatggcggtggacgacgagcacatgtaccactggaagt

SEQ ID NO: 218 - protein, 38 aa, Zea mays
  misc_feature: Ceres CLONE 215106-F
  misc_feature (16)..(16): Xaa is any aa, unknown, or other
  misc_feature (24)..(24): Xaa is any aa, unknown, or other
MAGYKAQGGALGVVLXVAALFAAXLAMAVDDEHMYHWK

SEQ ID NO: 219 - DNA, 485 bp, Zea mays
  misc_feature: Ceres CLONE 215130-F
  misc_feature: Translation starting site: 99
  misc_feature (425)..(425): n is a, c, t, g, unknown, or other
  misc_feature (438)..(438): n is a, c, t, g, unknown, or other
atcacacactaatcaacaagcaggaccagctagctagctcctcccactgctatcacccgggccccggccagccatctcgctgaaagagaaaagcgcvcatgaagactactagctcgggcattgcagtcgtcctcctggtggcgatgctggcagtccagtccgcggtggccgacatctcgtgctccgacgtgctcaacgacctgtcgccgtgcctgcmcttcctgcagggcaaggcagccaaacccagcgagagcaacaaccagtgctgcgacggcgtgaggaccctgtacgcggcggcggtcaccaggcccgcaggcaggccacgtgccggtgcctcaaggcggcctacgttcaggtccacgctgtgctctccgcggcgcaggtgctgcccggcgamtgcgggctctcgctgtcctacaacatcncccccggcatcgnctgcgacavgttccaaagcgaagaagtcttgcttcaccttcatcaaa

SEQ ID NO: 220 - DNA, 382 bp, Zea mays
  misc_feature: Ceres CLONE 215178-F
  misc_feature: Encodes the peptide sequence at SEQ ID NO. 221
  misc_feature (142)..(142): n is a, c, t, g, unknown, or other
cactcgtagtcctaggcactttcatctgtggcctctgcgttcgagatcgatctgagctggcaccgtcccacttcgccatggcggaggaccggagccccaagcccatccactgcaaagcggcggtgtgcagagccgccggsrngccactcaccatcgaggagatcgtcgtcgacccgmcgaaagcgtacgagatccgcatccgggtcgtctgcacctcactctgccacaccgatatcaccttctgdaaagctaaggtggcaccggtgtttccaagaatactagggcatgaggcgtacggggtagtggagagcgtgggggagcacgtggagggcttcgcggcgggggacaccgtggtgccgacgttcctgggggcagtgcgagc

SEQ ID NO: 221 - protein, 101 aa, Zea mays
  misc_feature: Ceres CLONE 215178-F
  misc_feature (36)..(100): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (22)..(22): Xaa is any aa, unknown, or other
  misc_feature (34)..(34): Xaa is any aa, unknown, or other
  misc_feature (56)..(56): Xaa is any aa, unknown, or other
MAEDRSPKPIHCKAAVCRAAGXPLTIEEIVVDPXKAYEIRIRVVCTSLCHTDITFXKAKVAPVFPRILGHEAYGVVESVGEHVEGFAAGDTVVPTFLGAVR

SEQ ID NO: 222 - DNA, 371 bp, Zea mays
  misc_feature: Ceres CLONE 215272-F
  misc_feature: Encodes the peptide sequence at SEQ ID NO. 223
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (109)..(109): n is a, c, t, g, unknown, or other
gaccctagtccaaaccaccgcaccgacaccgnnnccgagccccgccgcgccgsgctacctccgctcctctcttcgyscctgccggcgtcgaggccgaagcgaaggcgangcatgcatcacgaccccaaccccttcgacgagggcagcgccgaggacaaccccttctcaaatggaggagccggastgcaagcagcagtacggcttccggccgactgagcccgtcgggttcggcggcgctacaggggcgacgcgtcgttgacgtcccgctcgagaccatgggggactctcggagcaaggtgaaggagctctcgtcgtgggaatcagatctgaaggcggcgagaggcggatatcaagaggagggaagaggcgct

SEQ ID NO: 223 - protein, 32 aa, Zea mays
  misc_feature: Ceres CLONE 215272-F
MGDSRSKVKELSSWESDLKAARGGYQEEGRGA

SEQ ID NO: 224 - DNA, 304 bp, Zea mays
  misc_feature: Ceres CLONE 215343-F
  misc_feature: Translation starting site: 117
  misc_feature (151)..(151): n is a, c, t, g, unknown, or other
agtcgcctccttcctgcgccgccgccgccgccgccgccgccgctaccaccgcctcgsgccgcctgcgtcccgcgtttccgcacggaagttggtgaaggtttcttgaggctgagaacatggtgctgaagacggaactttgccgcttcacgcnaggaagatttatcctgggaaaggcattagatttatccgtgctgattctcaggtcttcctttttgccaactcgaaatgcaagcgctactccacaaccgcctgaagcctggcaaagcttacctggacagcaatgtacaggaagcagcacaagaag

SEQ ID NO: 225 - DNA, 330 bp, Zea mays
  misc_feature: Ceres CLONE 215352-F
  misc_feature: Encodes the peptide sequence at SEQ ID NO. 226
attatcacggcggcggtggcggacggaaggcgaaggagtagcagcagcaggcgcgcgagtagcgctccccacctcgagcttgccaccatggctagaggattgaagaagcatttgaagaggctcaatgcgcccaagcattggatgctggacaagcttggcgasttttgskccaagccatcttctggacctcacaagtctagggagtgcctgccactgatcctcatcatcaggaacaggctcaagtatgctcttacataccgtgagtcatttccatcctgatcccaacgccatgtacttggttgatggcaaggtcaggacagacaagaccta

SEQ ID NO: 226 - protein, 63 aa, Zea mays
  misc_feature: Ceres CLONE 215352-F
  misc_feature (3)..(39): Pfam Name: RS4NT Pfam Description: RS4NT (NUC023) domain
  misc_feature (25)..(25): Xaa is any aa, unknown, or other
  misc_feature (27)..(27): Xaa is any aa, unknown, or other
  misc_feature (28)..(28): Xaa is any aa, unknown, or other
MARGLKKHLKRLNAPKHWMLDKLGXFXXKPSSGPHKSRECLPLILIIRNRLKYALTYRESFPS

SEQ ID NO: 227 - DNA, 260 bp, Zea mays
  misc_feature: Ceres CLONE 215449-F
  misc_feature (76)..(76): n is a, c, t, g, unknown, or other
  misc_feature (157)..(157): n is a, c, t, g, unknown, or other
ctctaatactgggccactggtttcgctccgcacttccgccgctatggccgccgcaaccttctccgcsgccggccgnggctcctctccaccgccgcggcasaggagaaaaccgagctccccgtccctatcgcccgtcttcgccagstcgsccgcgcwngccgcctcgacgacatcgacgcgactctcgcgcccctgttcccttcccaccccgtcgccgsgctchcggccctctccacggtggggcctccccgaccgcgcct

SEQ ID NO: 228 - DNA, 468 bp, Zea mays
  misc_feature: Ceres CLONE 215500-F
  misc_feature: Encodes the peptide sequence at SEQ ID NO. 229
gatttccgatctttccgtcctcggtcttcttgatttttccttcctacctccaccggttataccacctgctagcgccgtccgccgttcctcaggaaaatcctctcacctgagtatggagcagcaccccacttgcgcccagccgccggcgccggcgcccctggctgggcccgtcgtcccggtggacttcaaggtcgtcaagaagggacccgagatggcgatgcacgacgcgatcggccgcctcgccttccgcgtcgcggcatcgccggcggggccacggcgctccaggatgacgctggaggtgtcctggtcaccgtcagagcagcggccagggcgagtggcaagcattcagtgggaatagtttggaggagagacacatcattttcactgcaaaagctatacctgcttcttcaagtcgagaggaggtacatgtgttcatctcaccaagaagcactgttgaaagatttctca

SEQ ID NO: 229 - protein, 81 aa, Zea mays
  misc_feature: Ceres CLONE 215500-F
MEQHPTCAQPPAPAPLAGPVVPVDFKVVKKGPEMAMHDAIGRLAFRVAASPAGPRRSRMTLEVSWSPSEQRPGRVASIQWE

SEQ ID NO: 230 - DNA, 442 bp, Zea mays
  misc_feature: Ceres CLONE 215570-F
  misc_feature: Translation starting site: 104
  misc_feature: Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (318)..(318): n is a, c, t, g, unknown, or other
  misc_feature (376)..(376): n is a, c, t, g, unknown, or other
ctccgtgctttcttagaggtgggttggcttctcctccccctccggttcgggttcgggttcgtgaggttctccggggttcgggttcgtgggtgagcggatcgagatggcggcgtcggatgttcagtaccgctgcttcgtcggcggcctcgctgggccacggacgaccactcccatccacaacgccttcagcacctacggcgaggtcctcgagtccaagatcatcctcgatcgggagacgcagaggtcccgcggcttcggcttcgtcaccttctccacggaggaggcgatgcggaacgcatcgagggcatgaacggcaangagctggacggccgcaacatcaccgtcaacgaggcccagtcccgcggcggccgtggangcggcggcggtgggtacggtggtggccggtggaggcggcggctacggcggtggcgggctcgtgatg

SEQ ID NO: 231 - DNA, 416 bp, Zea mays
  misc_feature: Ceres CLONE 215599-F
  misc_feature: Translation starting site: 157
  misc_feature: Pfam Name: Epimerase Pfam Description: NAD dependent epimerase/dehydratase family
  misc_feature: SWISSPROT Homolog: EC 1.3.1.77 Anthocyanidin reductase
  misc_feature (51)..(51): n is a, c, t, g, unknown, or other
  misc_feature (52)..(52): n is a, c, t, g, unknown, or other
  misc_feature (130)..(130): n is a, c, t, g, unknown, or other
  misc_feature (293)..(293): n is a, c, t, g, unknown, or other
aatctagtcccaggaaactaatttcaacacacaactggacgacggtgcgtnncgttggtggccgccggcgacgatgtcgtcgtccgcgggcgacaagaggaagaagacggcgtgcgtgaccggaggasrngttacatcggctccgcgctcatcaagatgctgctggaggacggatacgccgtcaagacgacggtcaggaaccccgacgacatggacaagaactcccacctcaagggcctgcagcagctcgggccgctgacggttctccgcgccgacatggacgaggagggcancttcgacgacgccgtsccggctgcgactacgccttcctcgtcgccgccccggtgaacctctcggcacaggatccagagaaagagcagatcgagccgtccgtccgaggcacgctgaacgcgatg

SEQ ID NO: 232 - DNA, 323 bp, Zea mays
  misc_feature: Ceres CLONE 215619-F
  misc_feature: Translation starting site: 77
  misc_feature (126)..(126): n is a, c, t, g, unknown, or other
  misc_feature (127)..(127): n is a, c, t, g, unknown, or other
  misc_feature (184)..(184): n is a, c, t, g, unknown, or other
  misc_feature (264)..(264): n is a, c, t, g, unknown, or other
  misc_feature (299)..(299): n is a, c, t, g, unknown, or other
atccaactcacacacaggctcaccccaccaacagcaagcgaaaatctcccgatcccctctggtctccgcggcgaagatgtcggggcgcggcaagggcgggaagggcctgggcaagggcggcgcgannccgggtaaggtgctccgcgataacatccaggggatcacgaagccggcgatccggcgnctggcgcgcaggggcggcgtgaassattctccgggctcatctacgaggagagccgcggcgtcctcaagatcttcctgganaacgtgatccgcggacgccgtcactttacaccgancacgcgcgccgcaagaccgtcaca

SEQ ID NO: 233 - DNA, 441 bp, Zea mays
  misc_feature: Ceres CLONE 215645-F
  misc_feature: Encodes the peptide sequence at SEQ ID NO. 234
  misc_feature (99)..(99): n is a, c, t, g, unknown, or other
acaaattaccaaaccctaccccttcgccgcgaccgcgatcccccacatcgttggcgatgagctcctcctccaacagcgggaagaagccggcgcccgvrnccgcggggggcccaccatccgcacgctcgccgacataaaccgtggccctgccggtttcccaggtgccggasgcagcagcgatgacgacgagccccaggagtactacaccggcggcgagaagagtggaatgcttgttcaagatccaacaagaagaaatgacgtggatgcaatatttgaacaagcaagacagggcggggcgctatccatggaatgccccccttttcttggtggcgagtcttccagctctaggagctttactgggactggccgacttcttacaggggagacaagtaccatctgctgcacctcagggaaccagtaccaatttcgaatacgccacaa

SEQ ID NO: 234 - protein, 146 aa, Zea mays
  misc_feature: Ceres CLONE 215645-F
  misc_feature (33)..(33): Xaa is any aa, unknown, or other
  misc_feature (57)..(57): Xaa is any aa, unknown, or other
QITKPYPFAATAIPHIVGDELLLQQREEAGARXRGGPTIRTLADINRGPAGFPGAGXSSDDDEPQEYYTGGEKSGMLVQDPTRRNDVDAIFEQARQGGALSMECPPFLGGESSSSRSFTGTGRLLTGETSTICCTSGNQYQFRIRH

SEQ ID NO: 235 - DNA, 431 bp, Zea mays
  misc_feature: Ceres CLONE 215654-F
  misc_feature: Translation starting site: 283
aktcgcctccttcctgcgccgccgccgccgccgccgccgccgctaccaccgcctcgcgccgcctagcgstccgcgtttccgcacggaagttggtgaaggtttcttgaggctgagaacatggtgctgaagacggaactttgccgcttcagcgcaggaagatttatcctgggaaaggcattagatttatccgtgctgattctcaggtcttcctttttgccaactcgaaatgcaagcgctacttccacaaccgcctgaagcctgcaaaggcttacctggacagcaatgtacaggaagcagcacaagaaggatatccatgctgaagcggtaaagaagaggcgccgcgccaccaagaagccatactccaggtcaatggtgggtgcttccttgggaagtaatccagaagaggagagctgagaagccaggaggtccgc

SEQ ID NO: 236 - DNA, 460 bp, Zea mays
  misc_feature: Ceres CLONE 215689-F
  misc_feature: Translation starting site: 87
  misc_feature (229)..(229): n is a, c, t, g, unknown, or other
  misc_feature (242)..(242): n is a, c, t, g, unknown, or other
atcacaattcactccactcatcttttctcgtttagaacctctaaaatttcccccactcgccagtcgcagcagcacctgtagcagtcatggacgccagcggascggtagcaaggggaagaagggggckgccgggcgcaaggyaggctggccccaggaagawgtcggtgasgcggtccrtcaaggccgggctgcagttscccgtyggcsggatcgggcgctacctcaagangggccggtacgcncmcgtgggcactggcgcccccgtctacctcgccgccgtcctggagtacctcgccgccgagttctggagttggcagggaacgcggcgaaagacaacaagaaggacgcgcatcatcccgcgccacgtgctcctggcgatccgcaacgacgaggagctcgggaagctgctggccggcgtcaccatcgsgcmggsggcgtcctccccaacatccactccgtg

SEQ ID NO: 237 - DNA, 372 bp, Zea mays
  misc_feature: Ceres CLONE 215703-F
  misc_feature: Translation starting site: 281
  misc_feature (150)..(150): n is a, c, t, g, unknown, or other
  misc_feature (152)..(152): n is a, c, t, g, unknown, or other
  misc_feature (343)..(343): n is a, c, t, g, unknown, or other
agtcgcctccttcctgcgccgccgccgccgccgccgccgccgctaccaccgcctcgsgccgcctgcgtccgcgtttccgcacggaagttggtgaaggtttcttgaggctgagaacatggtgctgaagacggaactttgccgcttcasgcnangaagatttatcctgggaaaggmattagatttatccgtgctgattctcaggtcttcctttttgccaactcgaaatgcaagcgctacttccacaaccgcctgaagcctgcaaagcttacctgggacagcaatgtacaggaagcagcacaagaaggatatccatgctgaagcggtaaagaagaggcgccgcgcnaccaagaagccatactccaggtcaattgt

SEQ ID NO: 238 - DNA, 385 bp, Zea mays
  misc_feature: Ceres CLONE 215765-F
  misc_feature: Translation starting site: 154
  misc_feature: Pfam Name: LEA_2 Pfam Description: Late embryogenesis abundant protein
  misc_feature (25)..(25): n is a, c, t, g, unknown, or other
  misc_feature (275)..(275): n is a, c, t, g, unknown, or other
  misc_feature (277)..(277): n is a, c, t, g, unknown, or other
cccacccacccacccaccgagctgnctgctacacccctgccaagatccatctttccggttccgccgcctgatcgaactgaacaagcaaggaagagccatggcgagcgagcacgcgcggggggcgatgctaagcatcaccagaagcagagcctgatggacaaggcgaaggggttcgtcgcggagaagatcgcgcacatccccaagcccgaggccacgctggacggcgtgacgttcaagggcctgagccgggagtgcatcacgctgcacagcastanancgtgtccaacccctacgaccaccgcctccccatctgcgaggtgacctacacgctccggtgcgccggcaaggaggtggcgtccggcaccatgccggaccccggctggat

SEQ ID NO: 239 - DNA, 400 bp, Zea mays
  misc_feature: Ceres CLONE 215766-F
  misc_feature: Translation starting site: 93
  misc_feature: Pfam Name: Linker_histone Pfam Description: linker histone H1 and H5 family
  misc_feature (143)..(143): n is a, c, t, g, unknown, or other
  misc_feature (144)..(144): n is a, c, t, g, unknown, or other
  misc_feature (197)..(197): n is a, c, t, g, unknown, or other
atccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggcnngaagccgaagcctgccgccgccaagccgaasagccaccgctggtgcctcccanccgccttacttcgagatgatcaaggaggctatcacggcgctcaaggagaggaccggctccagctcgcaagcgatcgccaagtatgtgsggggacaagcacggcgcgtctctgcsagccaacttcaagaagatgctttccatccagctccgtgggtcagcagccaagggcaagctcgtgaaggtcaaggcttcgtacaagctct

SEQ ID NO: 240 - DNA, 348 bp, Zea mays
  misc_feature: Ceres CLONE 215784-F
  misc_feature: Encodes the peptide sequence at SEQ ID NO. 241
  misc_feature (18)..(18): n is a, c, t, g, unknown, or other
  misc_feature (19)..(19): n is a, c, t, g, unknown, or other
  misc_feature (259)..(259): n is a, c, t, g, unknown, or other
agccacgcacaaagaggnnttgctcgagggtttagctagcttggaagccctccgcaaactcccatggcgtgcctccdcgtgctcgtcatcgctgccacagtactaacgggtccaccgggaaaactgacgcacgccgctcggacgtcgccggcggaggccttctggacatgcggccctccccaggcgctcccatgcccgaggccatccgcgagctcttgcgcccagctggtgctgccgggaccaacgctccagacgccgnbvaggtccaggcaccacgacgccgatccgccgccgatgaacttcaagtacgaagactacaggtcctcgcgtcggaacgaagtcsaccgc

SEQ ID NO: 241 - protein, 95 aa, Zea mays
  misc_feature: Ceres CLONE 215784-F
  misc_feature (5)..(5): Xaa is any aa, unknown, or other
  misc_feature (66)..(66): Xaa is any aa, unknown, or other
  misc_feature (94)..(94): Xaa is any aa, unknown, or other
MACLXVLVIAATVLTGPPGKLTHAARTSPAEAFWTCGPPQALPCPRPSASSCAQLVLPGPTLQTPXRSRHHDADPPPMNFKYEDYRSSRRNEVXR

SEQ ID NO: 242 - DNA, 445 bp, Zea mays
  misc_feature: Ceres CLONE 215797-F
acagcsctasaacttastgcttgctctagctagctagctgctcccggcccatatccactacacaagtaggctagsagcagcagcagcaatggcctcggtgacgagttcccggccgtggccctcgtcctgctgctcgccgccagcgccttcctggccagcgaggtggcggcgtgcggmggctgcccgaaaccaactcctcctcctccatcgccaccaccgccgtcgcccascagcacgccgtgccctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgccgacctggaggcgccgtctgcctctgcaccgcgctcaaggccaacgtgctcggcatcaac

SEQ ID NO: 243 - DNA, 308 bp, Zea mays
  misc_feature: Ceres CLONE 215833-F
  misc_feature: Encodes the peptide sequence at SEQ ID NO. 244
ccgattatctgattctgtgatcgagatcgaggccgatcggccaggtttcttgttcgtgcgctctgctacgtgccatggcggtavtcaccttcttctcacaactmtstgccggartskwatggagctagcaggaacaggatgctcattccagccattctttcgattcttcagcttattcaactcgcagcgctaggcgtggacggagcggcgtcgttcaggttcaccaacgcttgccagcacccggttgggtgggcgcgctccacggcgccagstcgccgcsgctcgsaagctcgggcttctacctggcg

SEQ ID NO: 244 - protein, 56 aa, Zea mays
  misc_feature: Ceres CLONE 215833-F
  misc_feature (45)..(45): Xaa is any aa, unknown, or other
  misc_feature (48)..(48): Xaa is any aa, unknown, or other
  misc_feature (50)..(50): Xaa is any aa, unknown, or other
MLIPAILSILQLIQLAALGVDGAASFRFTNACQHPVGWARSTAPXRRXSXARASTW

SEQ ID NO: 245 - DNA, 415 bp, Zea mays
  misc_feature: Ceres CLONE 215865-F
  misc_feature: Encodes the peptide sequence at SEQ ID NO. 246
  misc_feature (40)..(40): n is a, c, t, g, unknown, or other
  misc_feature (269)..(269): n is a, c, t, g, unknown, or other
  misc_feature (337)..(337): n is a, c, t, g, unknown, or other
tccaggggtcgtcgtcgbcactctctccctctcgccctcnccatcgccctcgcggtctcgccgcggccataaacaaaacaagcaaagcaaggcaaaggcacaggcagaaccccacctcctcrctccgcacctcgtcgtctgsttttcctcggtgcggaacacaagcccctgccgcctcyatwaccgggctgtgctgtgcgaggctgcgagcgtggtggctgtgtctggctttgcggcggcggcggtgatggtggtggagatggacggrngcgtgggagtagcagcaggaggaggaggaggagcgcagacgccggcgccggcgccgccgcggcgggtnggcgcttggcggacgagcggtgcgacctgcgcgccatggagacggactacgtgcggcggttccaccggcacgagcccc

SEQ ID NO: 246 - protein, 56 aa, Zea mays
  misc_feature: Ceres CLONE 215865-F
  misc_feature (8)..(8): Xaa is any aa, unknown, or other
MVVEMDGXVGVAAGGGGGAQTPAPAPPRRVGAWRTSGATCAPWRRTTCGGSTGTSP

SEQ ID NO: 247 - DNA, 417 bp, Zea mays
  misc_feature: Ceres CLONE 215921-F
  misc_feature (65)..(65): n is a, c, t, g, unknown, or other
  misc_feature (230)..(230): n is a, c, t, g, unknown, or other
atcttgctctgaacgcattcctcccatctcccaagacctcctcagacccgagaagcgcakgcggnccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccac

SEQ ID NO: 248 - DNA, 304 bp, Zea mays
  misc_feature: Ceres CLONE 215922-F
  misc_feature: Pfam Name: PSI_PSAK Pfam Description: Photosystem I psaG / psaK
  misc_feature (96)..(96): n is a, c, t, g, unknown, or other
  misc_feature (194)..(194): n is a, c, t, g, unknown, or other
accagtaccacaccactcsgcgctactgaggacggtacagcggcacagaggtgcgacgtacgacgacgacgacgcaggsccacacatggcatccbnstctccgccgccgtgccccggttccacggcctccggggctacgcgcgcccaggtccgcggtggcagcgctgcsgtccgtaragggtgggcaggaagangtcgtcgtcgcagggcatccgctgcgactacatcggctccgcaccaacctgatcatggtgacgacgacgacgctgatgctgttcgcggggsggttcgggctggcgccgtc

SEQ ID NO: 249 - DNA, 393 bp, Zea mays
  misc_feature: Ceres CLONE 215925-F
  misc_feature: Pfam Name: 4F5 Pfam Description: 4F5 protein family
  misc_feature (105)..(105): n is a, c, t, g, unknown, or other
aaagataaaatcgagaggacgccagggccgattctctgcgtgasttggggcgtcgtcgcgagttttctccggccgagggcggcgcgaccggacaaccagcgtgancggaccggcgacatgactcgcggcaaccagcgtgaccgcgaccgtgagcgcgcggcggcsstaagcccaacgccaagaactcccaggacgggctcaccccggagcagcgccgcgagagggacaagaaagctctggaggagaaggcggccagaaggygyacaggcagcggccggtcggcaccggttacctccacggacaacaacaagaacaaggcaggtgggcaagaagtaggaggcagtggcgcgccgcacttctgtacgattaatcgatgccttgagcttgtaactt

SEQ ID NO: 250 - DNA, 495 bp, Zea mays
  misc_feature: Ceres CLONE 215945-F
  misc_feature: Encodes the peptide sequence at SEQ ID NO. 251
agaagcatcacacactaatcaacaagcaggaccagctagctagctcctctcactgctatcacccgcccagccatctcgctgaaagagaaaagcgcmscattgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggsgcaggagctgcccggcgactgcggcctctcgctgtcctacaacatcacccccgacatcgactgcgacaagatcgaatgaagggatactgttccttaccaggaatcatacgacggg

SEQ ID NO: 251 - protein, 104 aa, Zea mays
  misc_feature: Ceres CLONE 215945-F
  misc_feature (13)..(100): Pfam Name: Tryp_alpha_amyl Pfam Description: Protease inhibitor/seed storage/LTP family
  misc_feature (79)..(79): Xaa is any aa, unknown, or other
MLAVHSALADISCSDVLNDLSPCLPFLQGKAAKPSESNNQCCDGVRALYAAADTRPDRQATCRCLKAAYVQVHAVLSAXQELPGDCGLSLSYNITPDIDCDKIE

SEQ ID NO: 252 - DNA, 426 bp, Zea mays
  misc_feature: Ceres CLONE 215987-F
  misc_feature: Encodes the peptide sequence at SEQ ID NO. 253
  misc_feature (135)..(135): n is a, c, t, g, unknown, or other
  misc_feature (229)..(229): n is a, c, t, g, unknown, or other
  misc_feature (231)..(231): n is a, c, t, g, unknown, or other
  misc_feature (417)..(417): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctrsagttccccgtcagccgcgtcgggcgtacctcaaaaagggccggtacgcgcabgtnangggcacgggtgccccgtctacctcgccgccgtcctggagtacctcgcggccgaggtgctcgagctcgccggcaacgcscaagggacaacaagaagacgcgcatcattccgcgccacgtgctcctcgccatccgcaacgacgaggagctcggcaagctgctggccggcgtcaccatcgcccacgggncgtcctccc

SEQ ID NO: 253 - protein, 141 aa, Zea mays
  misc_feature: Ceres CLONE 215987-F
  misc_feature (28)..(28): Xaa is any aa, unknown, or other
  misc_feature (45)..(45): Xaa is any aa, unknown, or other
  misc_feature (58)..(58): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (103)..(103): Xaa is any aa, unknown, or other
  misc_feature (139)..(139): Xaa is any aa, unknown, or other
TFRLSTPKVPFFFSIWKRRSSSHGRERXGGKAKKGAAGRKAGGRXKKSVSRSSRAGLXFPVSRVGRTSKRAGTRXXXARVPRLPRRRPGVPRGRGARARRQRXRDNKKTRIIPRHVLLAIRNDEELGKLLAGVTIAHGXSS

SEQ ID NO: 254 - DNA, 198 bp, Zea mays
  misc_feature: Ceres CLONE 216010-F
  misc_feature: Encodes the peptide sequence at SEQ ID NO. 255
actctcgtcgctggattccatgtccaaccgcgtcgccggassggaaccatgaagcctgtcagtgtcgccgaacacaacaaccaccagcatcgcctgcactcccccacgccggcgtcggctaccaagatctcgatccccatctcttcgagcgaggcgacgctgttcgggaagggtasgtacaaggtgtgggccctcgcg

SEQ ID NO: 255 - protein, 50 aa, Zea mays
  misc_feature: Ceres CLONE 216010-F
  misc_feature (43)..(43): Xaa is any aa, unknown, or other
MKPVSVAEHNNHQHRLHSPTPASATKISIPISSSEATLFGKGXYKVWALA

SEQ ID NO: 256 - DNA, 264 bp, Zea mays
  misc_feature: Ceres CLONE 216024-F
  misc_feature: Encodes the peptide sequence at SEQ ID NO. 257
  misc_feature (107)..(107): n is a, c, t, g, unknown, or other
  misc_feature (193)..(193): n is a, c, t, g, unknown, or other
aatctccctgtttaatcaatccttcaagcgcaakgcactcctcctcgtcgtscggtcgtgagaagggatggcgggccgtggcaaggctatcggctggcgccgcgaanaaggcaacgtcgaggagctccaaggccggactccagttccccgtcggcaggattgccaggttcctcaaggcgggcaagtacgcggnsagtcggcgccggsgcccccgtgtacctcgccgccgtcctcgagtacctcgcggctgaggttctcgaactt

SEQ ID NO: 257 - protein, 82 aa, Zea mays
  misc_feature: Ceres CLONE 216024-F
  misc_feature (11)..(11): Xaa is any aa, unknown, or other
  misc_feature (17)..(17): Xaa is any aa, unknown, or other
  misc_feature (35)..(35): Xaa is any aa, unknown, or other
  misc_feature (64)..(64): Xaa is any aa, unknown, or other
  misc_feature (69)..(69): Xaa is any aa, unknown, or other
SPCLINPSSAXHSSSSXGREKGWRAVARLSAGAAXKATSRSSKAGLQFPVGRIARFLKAGKYAXSRRRXPRVPRRRPRVPRG

SEQ ID NO: 258 - DNA, 238 bp, Zea mays
  misc_feature: Ceres CLONE 216048-F
  misc_feature: Encodes the peptide sequence at SEQ ID NO. 259
  misc_feature (92)..(92): n is a, c, t, g, unknown, or other
  misc_feature (165)..(165): n is a, c, t, g, unknown, or other
aaggaagaggagcggaaggaggaggcgggggacaggaatacccaggagccgcagcaaggtcaaggcctcagcctctcactcgccaacggagncgacavgcagggtctggaatgttgccgatgtcgaaccmttcagctaatcccacacagcttacaattttctatngtggatcagtatgtgtctatgactcggtgccaccagaaaaggctcaggcaatcatgcttatagctgcggctgc

SEQ ID NO: 259 - protein, 78 aa, Zea mays
  misc_feature: Ceres CLONE 216048-F
  misc_feature (30)..(30): Xaa is any aa, unknown, or other
  misc_feature (32)..(32): Xaa is any aa, unknown, or other
  misc_feature (43)..(43): Xaa is any aa, unknown, or other
  misc_feature (55)..(55): Xaa is any aa, unknown, or other
GRGAEGGGGGQEYPGAAARSRPQPLTRQRXRXAGSGMLPMSNXSANPTQLTIFYXGSVCVYDSVPPEKAQAIMLIAAA

SEQ ID NO: 260 - DNA, 307 bp, Zea mays
  misc_feature: Ceres CLONE 216069-F
  misc_feature: Encodes the peptide sequence at SEQ ID NO. 261
  misc_feature (105)..(105): n is a, c, t, g, unknown, or other
  misc_feature (232)..(232): n is a, c, t, g, unknown, or other
aatacatttcgactctcaactcccaaggtccctttttttttctcgatctggaagcgccgcagtatcagccatggacgtgagcggasaggcggtaaggcgaagaanggcgcggcggggcgcaatgccggcgggcgagcgaagaagtcggtgtcgcggtcctccagggccgggctgcagttccccgtcagccgcgtcgggcgtacctcaaaaagggccggtacgcgcabtttanggcacgggtgccccgtctacctcgccgccgtcctggagtacctcgcggccgaggtgctcgagctcgccggcaacg

SEQ ID NO: 261 - protein, 102 aa, Zea mays
  misc_feature: Ceres CLONE 216069-F
  misc_feature (29)..(29): Xaa is any aa, unknown, or other
  misc_feature (35)..(35): Xaa is any aa, unknown, or other
  misc_feature (76)..(76): Xaa is any aa, unknown, or other
  misc_feature (78)..(78): Xaa is any aa, unknown, or other
NTFRLSTPKVPFFFSIWKRRSISHGRERXGGKAKXGAAGRNAGGRAKKSVSRSSRAGLQFPVSRVGRTSKRAGTRXLXHGCPVYLAAVLEYLAAEVLELAGN

SEQ ID NO: 262 - DNA, 285 bp, Zea mays
  misc_feature: Ceres CLONE 216105-F
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctgsagttccccgtcagccgcgtcgggcgtacctcaaaaagggccggtacgcgcabgtaggcacgggtgcccccgtctacctcgccgccgtcctggagtacctcgcggccga

SEQ ID NO: 263 - DNA, 291 bp, Zea mays
  misc_feature: Ceres CLONE 216120-F
  misc_feature: Encodes the peptide sequence at SEQ ID NO. 264
  misc_feature (229)..(229): n is a, c, t, g, unknown, or other
aagagccgcagcagcacactcccgcagtagcagcagccgccgccgccgccgcccagccgcagaaacaggaggaagatgccggcggggcacgggcttcggtcgcggacccgcgmttgttcgcgcggscgttccgcaagaagggttacatcccgctcaccacgtacctgcgcacctacaagatcggcgactacgtcgactccaaggtgaacggcgccgtgcacaagggcangccgcacaagttctaccacggccgcaccggtcgcgtctggaacgtcaccaagcgcgccatcg

SEQ ID NO: 264 - protein, 96 aa, Zea mays
  misc_feature: Ceres CLONE 216120-F
  misc_feature (37)..(96): Pfam Name: Ribosomal_L21e Pfam Description: Ribosomal protein L21e
  misc_feature (42)..(42): Xaa is any aa, unknown, or other
  misc_feature (76)..(76): Xaa is any aa, unknown, or other
EPQQHTPAVAAAAAAAAQPQKQEEDAGGARASVADPRLFARXFRKKGYIPLTTYLRTYKIGDYVDSKVNGAVHKGXPHKFYHGRTGRVWNVTKRAI

SEQ ID NO: 265 - DNA, 227 bp, Zea mays
  misc_feature: Ceres CLONE 216126-F
  misc_feature: Encodes the peptide sequence at SEQ ID NO. 266
  misc_feature (163)..(163): n is a, c, t, g, unknown, or other
atcacacactcgactctcctctctcgcatccgcrcctttcgagctctactccaccccctcgatctcgaagcgcragcagcagtcaggcggccatggasgcgagcgcacggagccggcgggaaggcgaagaagggcgcggccgggckyaaggccggcgggcganggaagaagtcggtaacgaggtccgtcaaggccgggctgcagtttcccgtcggccgcatcgggcg

SEQ ID NO: 266 - protein, 75 aa, Zea mays
  misc_feature: Ceres CLONE 216126-F
  misc_feature (12)..(12): Xaa is any aa, unknown, or other
  misc_feature (25)..(25): Xaa is any aa, unknown, or other
  misc_feature (33)..(33): Xaa is any aa, unknown, or other
  misc_feature (49)..(49): Xaa is any aa, unknown, or other
  misc_feature (55)..(55): Xaa is any aa, unknown, or other
ITHSTLLSRIRXFRALLHPLDLEAXAAVRRPWXRAHGAGGKAKKGAAGXKAGGRXKKSVTRSVKAGLQFPVGRIG

SEQ ID NO: 267 - DNA, 478 bp, Zea mays
  misc_feature: Ceres CLONE 216137-F
  misc_feature: Translation starting site: 141
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaagtttctctggaggatttgtacaatggcacatcgaagaa

SEQ ID NO: 268 - DNA, 405 bp, Zea mays
  misc_feature: Ceres CLONE 216152-F
  misc_feature: Translation starting site: 258
  misc_feature: Pfam Name: Cornichon Pfam Description: Cornichon protein
  misc_feature (82)..(82): n is a, c, t, g, unknown, or other
  misc_feature (184)..(184): n is a, c, t, g, unknown, or other
  misc_feature (200)..(200): n is a, c, t, g, unknown, or other
agcaaagcaggacccatcctctcccatctctcggtctccccatcccaacccgccgccgsygccgccgccgcsgcsgcttctnscgtctccagcgsccacagcgcsattgtatccgsggggcgagctgagtcaccaagctggtctagggcccatccatttggaaccctcgcgagaagcaaagcgnacggagcgccabgatncttagatcgattgctcgccaggctgttggcgaggagtcgtcaaccctcacggcagccatgtctgtggagctcatcctgtggcttttctccttcgtctccgtcatggtcctcatcggcctcascgsatassagcttatmtgtstgtcagatttggagtatgattatatcaacccatatgattcatcgtstcgcatcaacgctgtgg

SEQ ID NO: 269 - DNA, 407 bp, Zea mays
  misc_feature: Ceres CLONE 216190-F
  misc_feature: Pfam Name: CoA_binding Pfam Description: CoA binding domain
  misc_feature: SWISSPROT Homolog: EC 6.2.1.4 Succinate--CoA ligase (GDP-forming)
  misc_feature (105)..(105): n is a, c, t, g, unknown, or other
agaccaaagacaaaggaaagcgagggccaccatcccccaaacccgtgagaaatcgaatcgagaagggaagagcacgcgccgtcgccagcacsgcgttccgccatngccgcctcctccccccgcgcgttgcaatcgctggggtccgccgcctcccgcttcctccacgcgcggggcttcgcgcggcggccgcscsccctcgcckgcgtcttcgtcgacaagagcacccgcgtgatctgtcagggcatcacggggaagaacggcaccttccacaccgagcaggccatcgagtacggcaccaacatggttgtggagtgactcctaagaaaggtggaactgaacatttagggctcccagtgtttaactctgtagcagaagctaagggctgaaacaaaaggccaatgcaactt

SEQ ID NO: 270 - DNA, 472 bp, Zea mays
  misc_feature: Ceres CLONE 216229-F
  misc_feature (65)..(65): n is a, c, t, g, unknown, or other
atcttgctctgaacgcattcctcccatctcccaagacctcctcagacccgagaagcgcmbgcggnccatggacgccaccggcactggagctggagggaaggcgaagaagggagcggccggtcgcaaggccgcgggccgaggaagaagtcggtgacgaggtccgtgaaggccgggctccagttccccgtcggccgcatcgggcgctacctcaagaagggccgctacgcgcagcgtcggcagcggtgcccccgtctacctcgcgccgtcctggagtacctcgccgctgaggtcctggagctcgccggcaacgctgccaaggacaacaagaagacgcgcatcgtcccgcgccacgtgctgctggcgatccgcaacgacgaggagctcggggaagctgctgaccggcgtgaccatcgcccacggcggtcgtgttgcccaacatcaacccggtcctgctgcccaagaagacggcgga

SEQ ID NO: 271 - DNA, 438 bp, Zea mays
  misc_feature: Ceres CLONE 216262-F
  misc_feature: Translation starting site: 176
  misc_feature: SWISSPROT Homolog: EC 6.3.2.19 Ubiquitin--protein ligase
  misc_feature (202)..(202): n is a, c, t, g, unknown, or other
aacaccgctcgccttcgcctccccatcttctatcatccccgagctccagttctccacacctcacgtctataaataataaataaggcgcccgcccatsaattcgtgtcaccgcgtcccgagagcgcaaatcattccgcgcgacgcaaaaaccctagcctagccaccgatccctctcatggcaaccaccaccacccaggcgadnctcctcctccagaagcagctaagagatctcgcgamsaccccgtggatgggttctctgstgggctggtcgacgacagcaatgtcttcgagtggcaggtcaccatcatcggaccgcctgacaccctatatgatggaggttacttcaatgcagtaatgagcttcccacaaaattacccaaacagcccgccatcagtcagatttacctctgaaatgtggcatccaaatgtctatcctgat

SEQ ID NO: 272 - DNA, 371 bp, Zea mays
  misc_feature: Ceres CLONE 216289-F
  misc_feature: Translation starting site: 117
agtcgcctccttcctgcgccgccgccgccgccgccgccgccgctaccaccgcctcgsgccgcctgcgstccgcgtttccgcacggaagttggtgaaggtttcttgaggctgagaacatggtgctgaagacggaactttgccgcttcagcgcaggaagatttatcctgggaaaggcattagatttatccgtgctgattctcaggtcttcctttttggccaactcgaaatgcaagcgctacttccacaaccgcctgaagcctgcaaagctttacctggacagcaatgtacaggaagcagcacaagaaggatatccatgctgaagcggttaaagaagrkgcgccgcgccaccaagaagccatactccaggtcaa

SEQ ID NO: 273 - DNA, 217 bp, Zea mays
  misc_feature: Ceres CLONE 216299-F
  misc_feature: Encodes the peptide sequence at SEQ ID NO. 274
  misc_feature (83)..(83): n is a, c, t, g, unknown, or other
  misc_feature (203)..(203): n is a, c, t, g, unknown, or other
aagtagggatagcgcatcgtcatcgcacctccacgcgccggcgagccagaccaccagaggcagcgatggcggtggcggastgntgggagacactgaagcagtcgatcgttgcatacacggggctgtcgccggcggctttttcacggccgtggcggtggcggccgstctgtaccatgtcgwgtcggggctcttcgcagccccgnccccgccgccgccg

SEQ ID NO: 274 - protein, 72 aa, Zea mays
  misc_feature: Ceres CLONE 216299-F
  misc_feature (27)..(27): Xaa is any aa, unknown, or other
  misc_feature (28)..(28): Xaa is any aa, unknown, or other
  misc_feature (55)..(55): Xaa is any aa, unknown, or other
  misc_feature (60)..(60): Xaa is any aa, unknown, or other
  misc_feature (68)..(68): Xaa is any aa, unknown, or other
SRDSASSSHLHAPASQTTRGSDGGGGXXGDTEAVDRCIHGAVAGGFFTAVAVAAXLYHVXSGLFAAPXPPPP

SEQ ID NO: 275 - DNA, 175 bp, Zea mays
  misc_feature: Ceres CLONE 216365-F
  misc_feature (129)..(129): n is a, c, t, g, unknown, or other
atcacaattcactccactcatcttttcgcgtttagaacctctaaaatttcccccactcgccagtcgcagcagcacctgtagccatggacgccagcggagccggtagcaaggggaagaagggtgcccggncgcaaggtcaggcggccccaggaagatagtcggtgacgcggtccgt

SEQ ID NO: 276 - DNA, 479 bp, Zea mays
  misc_feature: Ceres CLONE 216396-F
  misc_feature: Encodes the peptide sequence at SEQ ID NO. 277
ttagccgcgcggacgccaccawgcagctgccccttgctgtcgccgcctctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggattacaaggatggaaggttctcacaggtcgtgtccaacgccctcgacatgaagctcagggacgacctcgagaggctcaagaagatcaggaaccaccgtggtctgcgtcactactggggctccgtgttcgtgg

SEQ ID NO: 277 - protein, 132 aa, Zea mays
  misc_feature: Ceres CLONE 216396-F
  misc_feature (14)..(128): Pfam Name: Ribosomal_S13 Pfam Description: Ribosomal protein S13/S18
MSLIAGEDFQHILRLLNTNVDGKQKIMFAMTSIKGVGRRFSNIVCKKADIDMNKRAGELTPEELERLMTVVANPRQFKVPDWFLNRKKDYKDGRFSQVVSNALDMKLRDDLERLKKIRNHRGLRHYWGSVFV

SEQ ID NO: 278 - DNA, 529 bp, Zea mays
  misc_feature: Ceres CLONE 216403-F
  misc_feature: Encodes the peptide sequence at SEQ ID NO. 279
cttgttcttctggctcctcctgcttcctcatgatcaagcgtgtgtcctctgctccgtccttgtccagatggacgatccaatacaagcaattgggacatacaatatatcggagaagccacgttctggcctttgctagtgcagataggcgccgtcaagcagaagcgatcaacggggcattggcagtgataggactcacggctggattgctagtggaggctcagacaggaaaggacatcttagggcagctagctggatatctgacggctatttctagtttatttgggcaataacactggaccatggttggagatttatttttcacgttccacggccaggagaggtcttatctgaatcttatttgatggatccacccaatttttttgggagctgatcccagatggatgtggaatagcgcacccagacttgtatgttgatcaagcacgatagcatgggctgaacattagtatttctatgtagcacatcaatttctgacgatagcgcctgctaaagagcagttctattcatactc

SEQ ID NO: 279 - protein, 95 aa, Zea mays; identical to SEQ ID NO: 146
  misc_feature: Ceres CLONE 216403-F

SEQ ID NO: 280 - DNA, 344 bp, Zea mays
  misc_feature: Ceres CLONE 216407-F
  misc_feature (187)..(187): n is a, c, t, g, unknown, or other
  misc_feature (218)..(218): n is a, c, t, g, unknown, or other
  misc_feature (233)..(233): n is a, c, t, g, unknown, or other
  misc_feature (236)..(236): n is a, c, t, g, unknown, or other
  misc_feature (245)..(245): n is a, c, t, g, unknown, or other
actaaacatttcgtcgaacgccagcksmgtsgagctcgagctsagccccagtyaccgsagccatgtcctcacgaaaccctacctctccaactcgctccttccagtcccatccccgccgccgtcgggccctactctcagctccaaccatgcaagcccccttgcsgcccctacttgccgtcgcagccgnctccgcatstccgccacatccacggctgcgnkcttccttcgtcggntgncgctgccancgcgtcgctgagtcgagtggacgtgctctcggaggcgctcccttttattcagcgattcaaaggcaagacggtggtggtcaagtacggcggtgssgcgat

SEQ ID NO: 281 - DNA, 489 bp, Zea mays
  misc_feature: Ceres CLONE 216435-F
  misc_feature: Encodes the peptide sequence at SEQ ID NO. 282
  misc_feature (348)..(348): n is a, c, t, g, unknown, or other
aaacatagtgcagcaagcaactgcaaagcagcaagctctactcttcttctgtactgaacgtgtgactagataacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcgcgatgggtacggcaggtccggcggcgacgactacggccgtggcaccggcggcggtggctacaacaagtccggcggcggagacgactacggccgcagcggcgcnacgactacggccgtggcaccggcggcggcgggtacaacaagtccggagacgacggctacgacagcgggtacaacagatcgggcaccaccaacgacgacgaatacggccgtggcaccggcggcgggtacgggcagcaggcct

SEQ ID NO: 282 - protein, 133 aa, Zea mays
  misc_feature: Ceres CLONE 216435-F
  misc_feature (87)..(87): Xaa is any aa, unknown, or other
MADEYGRSGYGRSGAGDDYDSGYNSKSGTDDYGRGEGGYNKSGGDDDYGRSGAMGTAGPAATTTAVAPAAVATTSPAAETTTAAAAXRLRPWHRRRRVQQVRRRRLRQRVQQIGHHQRRRIRPWHRRRVRAAG

SEQ ID NO: 283 - DNA, 463 bp, Zea mays
  misc_feature: Ceres CLONE 216446-F
  misc_feature: Encodes the peptide sequence at SEQ ID NO. 284
  misc_feature (171)..(171): n is a, c, t, g, unknown, or other
  misc_feature (174)..(174): n is a, c, t, g, unknown, or other
gagaaaaaaaatgggtgccgatggggaagaagcgtcgcgtatagtcgtgccaatggcggtggaggggacctcggagcagctggcgttcgtggaggagtcgaagctgcagaagcgcaaggagaacgcggactgggccgtcagaaccgggagcgcagggcggtaaagcgccancantccgcgacgagcacaaggtcaccgtaagcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccggcacatcaggaaggtcttgaggaagctacggctgacgacggtcctcaccgggcgtattcctcagggcccaccgagctgacgctgaagagggcttcttgtggtcga

SEQ ID NO: 284 - protein, 50 aa, Zea mays
  misc_feature: Ceres CLONE 216446-F
MGADGEEASRIVVPMAVEGTSEQLAFVEESKLQKRKENADWAVRTGSAGR

SEQ ID NO: 285 - DNA, 280 bp, Zea mays
  misc_feature: Ceres CLONE 216474-F
  misc_feature: Encodes the peptide sequence at SEQ ID NO. 286
  misc_feature (68)..(68): n is a, c, t, g, unknown, or other
  misc_feature (76)..(76): n is a, c, t, g, unknown, or other
  misc_feature (128)..(128): n is a, c, t, g, unknown, or other
  misc_feature (242)..(242): n is a, c, t, g, unknown, or other
aatccgtgcatacatgctcattgctcaccaaggacaagggaggaggagaggacacacagcagtagcgncgaaatgncggcgatgatgatggatagtaccgcggagaaagacctcgccggcgacgcttncggtgagcgggcacgggcaggacttggagcggtcttgccatgaccaggagcccgccgctgcagatggtgcgagcagcagaggcctagccatcgggcgtttcgtacgggagctgntggtggagggcgtggcgtcgttcctgctggtgttctgg

SEQ ID NO: 286 - protein, 32 aa, Zea mays
  misc_feature: Ceres CLONE 216474-F
  misc_feature (2)..(2): Xaa is any aa, unknown, or other
  misc_feature (19)..(19): Xaa is any aa, unknown, or other
MXAMMMDSTAEKDLAGDAXGERARAGLGAVLP

SEQ ID NO: 287 - DNA, 149 bp, Zea mays
  misc_feature: Ceres CLONE 216475-F
  misc_feature (58)..(58): n is a, c, t, g, unknown, or other
  misc_feature (140)..(140): n is a, c, t, g, unknown, or other
gataaggagacggtactagtaaactgactaactgctgcccactcgccggagaaccatngccacggcggcggcgtgtgttcgggtggcgtctccgttcacggcccacctatcttgcatcccagacacgtcatctcaacgangcggggacc

SEQ ID NO: 288 - DNA, 267 bp, Zea mays
  misc_feature: Ceres CLONE 216616-F
  misc_feature: Translation starting site: 17
  misc_feature: Pfam Name: Ribosomal_L14 Pfam Description: Ribosomal protein L14p/L23e
aacacaagccgccgtcatgtcgaagcgaggtaggggaggttcggctgggaacaagttccgcatgtcactgggtctaccggtggcggccacggtgaactgcgcgggacaacacgggcgcgaagaaccctctacatcatctccgtcaagggaattcaaggggccgcctcaaccgsctcccgtccgccttgcgtcggcgacatkgtcatggccaccgtcaagawwkkgawagsccgacctcaggaagaaagtgatgcctgccgtcatcgt

SEQ ID NO: 289 - DNA, 252 bp, Zea mays
  misc_feature: Ceres CLONE 216651-F
  misc_feature: Encodes the peptide sequence at SEQ ID NO. 290
  misc_feature (34)..(34): n is a, c, t, g, unknown, or other
gaccctagtccaaaccaccgcaccgacaccgahnccgagccccgccgcgccgsctacctccgctcctctcttcgcccctgccggcgtcgaggccgaagcgaaggcgagcatgcatcacgaccccaaccccttcgacgagggcagcgcgaggacaaccccttctcaaatggaggagccggasstcaagcagcagtacggcttccggccgactgagcccgtcgggttcggcggcgctacaggggcgacgcgttc

SEQ ID NO: 290 - protein, 47 aa, Zea mays
  misc_feature: Ceres CLONE 216651-F
  misc_feature (24)..(24): Xaa is any aa, unknown, or other
  misc_feature (25)..(25): Xaa is any aa, unknown, or other
MHHDPNPFDEGSARTTPSQMEEPXXKQQYGFRPTEPVGFGGATGATR

SEQ ID NO: 291 - DNA, 479 bp, Zea mays
  misc_feature: Ceres CLONE 216695-F
  misc_feature: Translation starting site: 292
  misc_feature: Pfam Name: Ribosomal_S4e Pfam Description: Ribosomal family S4e
attatcacggcggcggtggcggacgggaaggcgaaggagtagcagcagcaggcgcgccgagtagcgctccccacctcgagcttgcsaccatggctagaggattgaagaagcatttgaagaggctcaatgcgcccaagcattggatgctggacaagcttggcgasttttgctcccaagcyatcttctggacctcacaagtytagggagtgcctgcyactgatcctcatcatcaggaacaggctcaagtatgctcttacataccgtgagtcatttccatcctgatccaacgccatgtacttgttgatggcaaggtcaggacagacaagacctaccctgctgggttcatggatgtycatttccatccccaagaccaatgagaactacaggctgctgtacgataccagggccgcttccgrccttcacccaatcagggatgaggatgctaagttcaagctttgcaaggttaggtctgttcagtt

SEQ ID NO: 292 - DNA, 151 bp, Zea mays
  misc_feature: Ceres CLONE 216728-F
aacagcgaacacatctgcttcgcatttcttcccatcccccttcgcaacccaaaccccaacccctccgcatcgatggcgcccaaggccgagaagaagcccgcggcgaaagaagccggcggaggaggagcccgcggctgaraaggcgcccgcc

SEQ ID NO: 293 - DNA, 235 bp, Zea mays
  misc_feature: Ceres CLONE 216753-F
  misc_feature (57)..(57): n is a, c, t, g, unknown, or other
  misc_feature (58)..(58): n is a, c, t, g, unknown, or other
  misc_feature (106)..(106): n is a, c, t, g, unknown, or other
  misc_feature (173)..(173): n is a, c, t, g, unknown, or other
attccactagattaccaccacctccacctcgtcgtctcccaccaccgccgagcgcknncctagcccgatctagccggcggaggcaccagatcccgccgcccgmgtncccgggacgcgccccgccgaatccgccgctcctcgcactgcaacacgcccggaccacggtgcatwwnatccgtcccggccgcctacacgatgtccaagtcgggagcgctggatcttgcttctggcctcg

SEQ ID NO: 294 - DNA, 402 bp, Zea mays
  misc_feature: Ceres CLONE 216853-F
  misc_feature (381)..(381): n is a, c, t, g, unknown, or other
ctgcgcctgcsctcccctcctgcagcgcccgtcgcctccctttccccttccctccctccctctccccgcggccgccagaggaatttcgccctcgattcgaccccgattcgtccgcccgcgaccgggattccctccgccaagcgcggatctgaacgctgcgctccgtgtcgccgctcgaatccgccatgaagggggccaaatccaagggcgccgcaaggccgatgccaagctggcggtgaagagcaagggggcggagaagccgcywaggsagtgawaggkaaggycggcaaggaccccaacaagcctaagagggctcccagcgctttcttcgtgttcatggaggaatttcgcaaggagttcaaggagaagaaccctaaagancaagtctgtcgctgcggtggg

SEQ ID NO: 295 - DNA, 260 bp, Zea mays
  misc_feature: Ceres CLONE 216934-F
  misc_feature: Encodes the peptide sequence at SEQ ID NO. 296
atcacacactcgactctcstctctcgcatccgcagcctttcgagctctactccaccccctcgatctcgaagcgcagaggcagcagtcaggcggccatggacgcgagcgcavcggagccggcgggaaggcgaagaagggcgcggccgggcgcaaggccggcggggccgaggaagaagtcggtaacgaggtccgtcaaggccgggctgcagtttcccgtcggccgcatcgggcgggtacctgaagaagggccggtacgcgca

SEQ ID NO: 296 - protein, 55 aa, Zea mays
  misc_feature: Ceres CLONE 216934-F
  misc_feature (6)..(6): Xaa is any aa, unknown, or other
MDASAXEPAGRRRRARPGARPAGPRKKSVTRSVKAGLQFPVGRIGRVPEEGPVRA

SEQ ID NO: 297 - DNA, 328 bp, Zea mays
  misc_feature: Ceres CLONE 216939-F
  misc_feature: Encodes the peptide sequence at SEQ ID NO. 298
  misc_feature (144)..(144): n is a, c, t, g, unknown, or other
  misc_feature (177)..(177): n is a, c, t, g, unknown, or other
  misc_feature (179)..(179): n is a, c, t, g, unknown, or other
atccagtcgcatctccctctccgaaatcaaggtagcgtacaccgctgcagtttctagagccctctctgccactcgtgatcccactagtcacaatgcctgcsctcgccaagcccgcctcccgcaccgccaagcccgscgcggcdncgaagccgaagcctgccgccgccaagccgaasncncaccrctggtgcctcccacccgccttacttcgagatgatcaaggaggctatcacggcgctcaaggagaggaccggctccagctcgcaagcgatcgccaagtatgtgggggacaagcacggmgcgtctctgccagccaacttcaagaaga

SEQ ID NO: 298 - protein, 38 aa, Zea mays
  misc_feature: Ceres CLONE 216939-F
  misc_feature (1)..(38): Pfam Name: Linker_histone Pfam Description: linker histone H1 and H5 family
  misc_feature: Functional homolog of the protein sequence given in SEQ ID NO 96857
  misc_feature: Useful for making plants with modulated oxidative stress sensitivity
MIKEAITALKERTGSSSQAIAKYVGDKHGASLPANFKK

SEQ ID NO: 299 - DNA, 421 bp, Zea mays
  misc_feature: Ceres CLONE 217099-F
  misc_feature: Encodes the peptide sequence at SEQ ID NO. 300
agccgcaccgcgctcacttccgcaccctcttcccgccgcgccgccgccgccgccgcttcctccccgccgccgggcaagatgggtcgcgtgatccgcgcgcastatagggtgcgggatccgtgttcaagtcccacacccaccaccgcaaggccccgccgttccgctcccatcgacttcggcgagcgcaacgggtacctcaagggcgtagtcaccgacgtgatccacgaccccggacgcggcgccccgctcgccaaggtcaccttccgccaccccttcaggtacaagcaccagaaggagctcttcgtcgccgccgagggcatgtacaccggccagttcgtttactgcggcgccgcgccacgctctcccatcggcaacgtcctgccgctccgsgatccccgagggtgccgtcgtctgcaacgtc

SEQ ID NO: 300 - protein, 114 aa, Zea mays
  misc_feature: Ceres CLONE 217099-F
  misc_feature (16)..(89): Pfam Name: Ribosomal_L2 Pfam Description: Ribosomal Proteins L2, RNA binding domain
  misc_feature (8)..(8): Xaa is any aa, unknown, or other
MGRVIRAXYRVRDPCSSPTPTTARPRRSAPIDFGERNGYLKGVVTDVIHDPGRGAPLAKVTFRHPFRYKHQKELFVAAEGMYTGQFVYCGAAPRSPIGNVLPLRDPRGCRRLQR

SEQ ID NO: 301 - DNA, 488 bp, Zea mays
  misc_feature: Ceres CLONE 217119-F
  misc_feature: Translation starting site: 304
  misc_feature (475)..(475): n is a, c, t, g, unknown, or other
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgnagaagctctctct

SEQ ID NO: 302 - DNA, 465 bp, Zea mays
  misc_feature: Ceres CLONE 217122-F
  misc_feature: Encodes the peptide sequence at SEQ ID NO. 303
  misc_feature (202)..(202): n is a, c, t, g, unknown, or other
  misc_feature (203)..(203): n is a, c, t, g, unknown, or other
aacaccgctcgccttcgcctccccatcttctatcatccccgagctccagttctccacacctcacgtctataaataataaataaggcgcccgcccatcaattcgtgtcaccgcgtcccgagagcgcaaatcattccgcgcgacgcaaaaaccctagcctagccaccgatccctctcatggcaaccaccaccacccaggcgagnntcctcctccagaagcagctaagagatctcgcgamgaccccgtggatgggttctctgctgggctggtcgacgacagcaatgtcttccgagtggcaggtcaccatcatcggaccgcctgacaccctatatgatggaggttacttcaatgcaataatgagcttcccacaaaattacccaaacagcccgccatcagtcagatttacctctgaaatgtggcatccaaatgtctatcctgatgggcaggtttgtatctctattcttca

SEQ ID NO: 303 - protein, 96 aa, Zea mays
  misc_feature: Ceres CLONE 217122-F
  misc_feature (11)..(96): Pfam Name: UQ_con Pfam Description: Ubiquitin-conjugating enzyme
  misc_feature: SWISSPROT Homolog: EC 6.3.2.19 Ubiquitin--protein ligase
  misc_feature (9)..(9): Xaa is any aa, unknown, or other
  misc_feature (10)..(10): Xaa is any aa, unknown, or other
  misc_feature (21)..(21): Xaa is any aa, unknown, or other
MATTTTQAXXLLQKQLRDLAXTPWMGSLLGWSTTAMSSEWQVTIIGPPDTLYDGGYFNAIMSFPQNYPNSPPSVRFTSEMWHPNVYPDGQVCISIL

SEQ ID NO: 304 - DNA, 486 bp, Zea mays
  misc_feature: Ceres CLONE 217304-F
  misc_feature: Translation starting site: 306
  misc_feature (403)..(403): n is a, c, t, g, unknown, or other
aaaaaaacctctcctggcacgagatcacgcttctcgttggatcgaacagctagggtttccaagatgttcgggcgcgcgccgaagaagagcgacaacacacggtactacgagatcctcggggtctccaaggacgcgtccsaggatgacctcaagaaagcstaccgcaagccgccatcaagaaccaccccgacaagggcggcgatcccgagaagttcaaggagctagctcaggcttatgaggtcctsagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcanaaggcagckaaggggaaaggatgtggttcatcctctaaaggtttctctggaggatttgtacaatggcacatcaaagaagctct

SEQ ID NO: 305 - DNA, 476 bp, Zea mays
  misc_feature: Ceres CLONE 217334-F
  misc_feature: Encodes the peptide sequence at SEQ ID NO. 306
  misc_feature (31)..(31): n is a, c, t, g, unknown, or other
  misc_feature (32)..(32): n is a, c, t, g, unknown, or other
  misc_feature (309)..(309): n is a, c, t, g, unknown, or other
atcagaatcggaccaccacacgcccgaggcnngactgcaagcgcctgagcccaagacccatggccatggccgccgccaccgtcgsagcgtctctgcccgtggcgcaggggctcgggaagsccctctgcgccggaagcaacgcgccgtcgctccgggccgtcgcgggcgcgccccgtcgtcaggtcggccaggaccaggatggccgtcgtccgggcgtccgcgcaaaagcagcacccggccaaggagtgggcggccgcggctgccgtggcggcggcgctggtgcttccggagtcgcggaggccgcgccgnggatctccccgtcgctcaagaacttcctcctcagcatcgtctccggtggggtcgtgctcgtcgccatcgtcggcgccgtcgtcgccgtctctaacttcgatccgtcaggcggggttgagctgcatgcgtcgttgtgtgttgttgtacctatgtactgagatctctct

SEQ ID NO: 306 - protein, 133 aa, Zea mays
  misc_feature: Ceres CLONE 217334-F
  misc_feature (7)..(7): Xaa is any aa, unknown, or other
  misc_feature (19)..(19): Xaa is any aa, unknown, or other
  misc_feature (82)..(82): Xaa is any aa, unknown, or other
MAAATVXASLPVAQGLGKXLCAGSNAPSLRAVAGAPRRQVGQDQDGRRPGVRAKAAPGQGVGGRGCRGGGAGASGVAEAAPXISPSLKNFLLSIVSGGVVLVAIVGAVVAVSNFDPSGGVELHASLCVVVPMY

SEQ ID NO: 307 - DNA, 500 bp, Zea mays
  misc_feature: Ceres CLONE 217341-F
  misc_feature: Encodes the peptide sequence at SEQ ID NO. 308
aacaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctgtcccgcagt

SEQ ID NO: 308 - protein, 146 aa, Zea mays
  misc_feature: Ceres CLONE 217341-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRS

SEQ ID NO: 309 - DNA, 387 bp, Zea mays
  misc_feature: Ceres CLONE 217558-F
  misc_feature: Translation starting site: 175
  misc_feature: Pfam Name: SPC12 Pfam Description: Microsomal signal peptidase 12 kDa subunit (SPC12)
  misc_feature (306)..(306): n is a, c, t, g, unknown, or other
  misc_feature (309)..(309): n is a, c, t, g, unknown, or other
accggatcctggtatgsgcttacstgssccctctstctgtctcgtggttctactgaacgagcactcgsstgcgstcttststctstcgtggcgacgactgggtgaccgccggsgsscsaggcstgaggctccatcttcgggcccttcactggstacgagcaccaccagaggattatggattggstggggcagaagcgcgcggagatgctgatgcaggtgctgctggtggcgtctgctgtggcggcgttcctggtgggctacgtgcgcgcggacttccagctcatgctgctcgtctacgccggcgsncgntgctcacagcgctcgtcacmgtccccaactggcccttcttcaaccgtaacccgctcaagtggctcgacgctgccgagg

SEQ ID NO: 310 - DNA, 528 bp, Zea mays
  misc_feature: Ceres CLONE 217559-F
  misc_feature: Encodes the peptide sequence at SEQ ID NO. 311
  misc_feature (468)..(468): n is a, c, t, g, unknown, or other
cttgttcttctggstcctcctgcttcctcatgatcaagcgtgtgtcctctgctccgtccttgtccagatggacgatccaatacaagcaattgggacatacaatatatcggagaagccacgttctggcctttgctagtgcagataggcgccgtcaagcagaagcgatcaacggggcattggcagtgataggactcacggctggattgctagtggaggctcagacaggaaaggacatcttagggcagctagctggatatctgacggctatttctagtttatttgggcaataacactggaccatggttggagatttatttttcacgttccacggccaggagaggtcttatctgaatcttatttgatggatccacccaatttttttgggagctgatcccagatggatgtggaatagcgcacccagacttgtatgttgatcaagcacgatagcatgggctgaacattagtatntctatgtagcacatcaatgtctgacgatagcgcctgctaaagagcagttctattcatctc

SEQ ID NO: 311 - protein, 95 aa, Zea mays; identical to SEQ ID NO: 146
  misc_feature: Ceres CLONE 217559-F

SEQ ID NO: 312 - DNA, 461 bp, Zea mays
  misc_feature: Ceres CLONE 217570-F
  misc_feature: Encodes the peptide sequence at SEQ ID NO. 313
  misc_feature (35)..(35): n is a, c, t, g, unknown, or other
  misc_feature (109)..(109): n is a, c, t, g, unknown, or other
  misc_feature (186)..(186): n is a, c, t, g, unknown, or other
  misc_feature (362)..(362): n is a, c, t, g, unknown, or other
gaccctagtccaaaccaccgcaccgacaccgatynccgagccccgccgcgccgsctacctccgctcctctcttcgcccctgccggcgtcgaggccgaagcgaaggcgangcatgcatcacgaccccaaccccttcgacgagggcagcgcgaggacaaccccttctcaaatggaggagccggastcnaagcagcagtacggcttccggccgactgagcccgtcgggttcggcggcgctacaggggcgacgcgtcgttgacgtcccgctcgagaccatgggggactctcggagcaaggtgaaggagctctcgtcgtgggaatcagatctgaagcggcgagaggcggatatcaagaggagggaanaggcgctgaagaatgctggcgtgccaatggaggagaagaactggccaccattcttccccatcatccaccatgatattgccaatgagataccagcaaatg

SEQ ID NO: 313 - protein, 62 aa, Zea mays
  misc_feature: Ceres CLONE 217570-F
  misc_feature (30)..(30): Xaa is any aa, unknown, or other
MGDSRSKVKELSSWESDLKRREADIKRREXALKNAGVPMEEKNWPPFFPIIHHDIANEIPAN

SEQ ID NO: 314 - DNA, 148 bp, Zea mays
  misc_feature: Ceres CLONE 217572-F
  misc_feature (73)..(73): n is a, c, t, g, unknown, or other
acaaacgcgtcgcatccgctccacaggatcctctgcgccaccgcaaccgtgtgaccgcccgtgccgccgggdncccgatccgccgacccgtcccagccccgctcgcagccatgtcgccgtcggagccgacgcggggaggagagcgtgt

SEQ ID NO: 315 - DNA, 451 bp, Zea mays
  misc_feature: Ceres CLONE 217609-F
atctccctgtttaatcaatccttcaagcgcaaskgcctcctcctcgtcgtccggtcgtgagaagggatggcgggccgtggcaaggctatcggcgctggcgccgaagaaggcaacgtcgaggagctccaaggccggactccagttccccgtcggcaggattgcsaggttcctcaaggcgggcaagtacgcggasmgttcggcgccggcgcccccgtgtacctctccgccgtcctcgagtacctcgcggctgaggttctcgaacttgccgggaacgccgcgaggggtacaacaagaagacccgcattgtgccgcgccacatccagcttgctgtgcgcaacgacgaggagctgaccaaactgtttgggtggtgccaccatcgcgagcggaggtgttatgcctaacatccatcagcatctggctccccaagaaggctgcctcctccaaggccagt

SEQ ID NO: 316 - DNA, 258 bp, Zea mays
  misc_feature: Ceres CLONE 217620-F
  misc_feature: Encodes the peptide sequence at SEQ ID NO. 317
acctcaagcagcaaaaccccacacagcgagcgagcgaagtagdsagacgctggctgagatacacacacacacacatcaactgaaaactcggaggagtttttgttcatcatgggggtacagagcagcgagggccagatgatgttctcctccatcaccctgctgcagcagaggttcagggagctggagaggatcagggagaagcgggaggagaggctactccacgtgctcgccccgcgccctgttggcaacaactccccg

SEQ ID NO: 317 - protein, 50 aa, Zea mays
  misc_feature: Ceres CLONE 217620-F
MGVQSSEGQMMFSSITLLQQRFRELERIREKREERLLHVLAPRPVGNNSP

SEQ ID NO: 318 - DNA, 198 bp, Zea mays
  misc_feature: Ceres CLONE 217628-F
  misc_feature: Encodes the peptide sequence at SEQ ID NO. 319
  misc_feature (190)..(190): n is a, c, t, g, unknown, or other
atcacaattcacagcgctcaagttctcgcgcccacagccaaatttttctccactcaatcgcggcatcaagctgcactgcascatggacgccagcggascggtcagcaaggcgaagaagggggcggctggkcgcaaggytggcggccccaggaagawgtyggtgttcgcggtccgtcaaggccgggctgmngttccccg

SEQ ID NO: 319 - protein, 65 aa, Zea mays
  misc_feature: Ceres CLONE 217628-F
  misc_feature (27)..(27): Xaa is any aa, unknown, or other
  misc_feature (33)..(33): Xaa is any aa, unknown, or other
  misc_feature (46)..(46): Xaa is any aa, unknown, or other
  misc_feature (52)..(52): Xaa is any aa, unknown, or other
  misc_feature (53)..(53): Xaa is any aa, unknown, or other
  misc_feature (63)..(63): Xaa is any aa, unknown, or other
SQFTALKFSRPQPNFSPLNRGIKLHCXMDASGXVSKAKKGAAGRKXGGPRKXXVFAVRQGRAXVP

SEQ ID NO: 320 - DNA, 341 bp, Zea mays
  misc_feature: Ceres CLONE 217652-F
  misc_feature: Encodes the peptide sequence at SEQ ID NO. 321
  misc_feature (87)..(87): n is a, c, t, g, unknown, or other
  misc_feature (88)..(88): n is a, c, t, g, unknown, or other
  misc_feature (182)..(182): n is a, c, t, g, unknown, or other
gtgcgttcatctgcagtgcacgaacaatcgagccagcaacataaacgatcgaggcgcggtggccgtagcaaccgcagcaagcatgannaactcgcgcgctcyagtgttggtgctcctgctgctggccatcgccatggcgagctgcaggctctcgctcgccgcccacgagagcagcaccagcntcggacaccctcggccgcgacctgcggggctccatcgccatggccgccggcaacctcttcagaccggacggtggctcggcgcgccgcgaacgtcaccgccgacgccgaggcaaagmacctcgagggccgtggcgtcccggagcggcggcccgcaccagg

SEQ ID NO: 321 - protein, 86 aa, Zea mays
  misc_feature: Ceres CLONE 217652-F
  misc_feature (2)..(2): Xaa is any aa, unknown, or other
  misc_feature (7)..(7): Xaa is any aa, unknown, or other
  misc_feature (34)..(34): Xaa is any aa, unknown, or other
  misc_feature (72)..(72): Xaa is any aa, unknown, or other
MXNSRAXVLVLLLLAIAMASCRLSLAAHESSTSXGHPRPRPAGLHRHGRRQPLQTGRWLGAPRTSPPTPRQXTSRAVASRSGGPHQ

SEQ ID NO: 322 - DNA, 434 bp, Zea mays
  misc_feature: Ceres CLONE 217681-F
  misc_feature (92)..(92): n is a, c, t, g, unknown, or other
  misc_feature (246)..(246): n is a, c, t, g, unknown, or other
  misc_feature (308)..(308): n is a, c, t, g, unknown, or other
atcacaattcactccactcatcttttctcgtttagaacctctaaaatttcccccactcgccagtcgcagcagcacctgtagcagtcatggtngccagcggascggtcagcaaggggaagaagggggcggccgggcgcaaggyaggctggccccaggaagwagtcggtgwcgcggtccgtcaaggccgggctgcagttccccgtmggccggatcgggcgctacctcaagamgggccggtacgcvcancgtgggcactggsgcccccgtctacctcgccgccgtcctggagtacctcgccgccgaggttntggagttggcagggaacgcggcgaaagacaacaagaagacgcgcatcatcccgcgccacgtgctcctggcgatccgcaacgacgaggagctcgggaagctgctggccggcgtcaccatcgcgcacg

SEQ ID NO: 323 - DNA, 449 bp, Zea mays
  misc_feature: Ceres CLONE 217707-F
  misc_feature (139)..(139): n is a, c, t, g, unknown, or other
  misc_feature (234)..(234): n is a, c, t, g, unknown, or other
  misc_feature (380)..(380): n is a, c, t, g, unknown, or other
  misc_feature (392)..(392): n is a, c, t, g, unknown, or other
  misc_feature (420)..(420): n is a, c, t, g, unknown, or other
astcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtgacctcaaaaagggccggtacgcgcrbktnaggcacgggtcccccgtctacctcgccgccgtcctggagtacctcgcggccgaggtgctcgagctcgccggcaacgcscaagggacaacaagaagacgcgcatcattccgcgccacgtgctcctcgccatccgcaacgacgagganctcggcaagctnctggcmggcgtcaccatcgcccacggsncgtcctccccaacatccacactgtgctcc

SEQ ID NO: 324 - DNA, 267 bp, Zea mays
  misc_feature: Ceres CLONE 217718-F
  misc_feature (168)..(168): n is a, c, t, g, unknown, or other
  misc_feature (170)..(170): n is a, c, t, g, unknown, or other
aaaagataaaatcgagaggacgccagggccgattctstgcgtgasttggggcgtcgtcgcgagttttctccggccgagggcggcgcgaccggacaaccagcgtgabctgaccggcgacatgactcgcggcaaccagcgtgaccgcgaccgtgagckcgcggcggcggnanaggcccaacgccaagaactcccaggacgggctcaccccggagcagcgccgcgagagggacaagaaagctctggaggagaaggcggccaagaaggcgc

SEQ ID NO: 325 - DNA, 462 bp, Zea mays
  misc_feature: Ceres CLONE 217719-F
  misc_feature: Encodes the peptide sequence at SEQ ID NO. 326
  misc_feature (167)..(167): n is a, c, t, g, unknown, or other
  misc_feature (278)..(278): n is a, c, t, g, unknown, or other
gtcggagcagggcaggggttgcgtctcagttcctggttgtgttgttgtaagctcacaggtttcttctcttcgcgtgastagctagagtgggatcgcgaggaagaaggatgtcgtgctgcggaggcaactgcgggtgcggcasggatgcaagtgcggcasggctgcgnagggtrcaagatgtacccggacatggttgagcaggtgaccaccaccaccaccacccagactctcatcatgggtgttgcgccatccacgggcgggttcgaggcggccgcgtnagctgagaacggcgggtgcaagtgcggcgccastgcamctgcgacccctgcacctgcaagtgaggatgaccgggtgcagcatgcagggccgtgacgatggaggaagtagctagatcggaaggacacccttcagtatctctagctaaatcaagctctgcagtatgttgtagcagtgtcgtctgtg

SEQ ID NO: 326 - protein, 75 aa, Zea mays
  misc_feature: Ceres CLONE 217719-F
  misc_feature (1)..(64): Pfam Name: Metallothio_2 Pfam Description: Metallothionein
  misc_feature (5)..(5): Xaa is any aa, unknown, or other
  misc_feature (8)..(8): Xaa is any aa, unknown, or other
  misc_feature (10)..(10): Xaa is any aa, unknown, or other
  misc_feature (45)..(45): Xaa is any aa, unknown, or other
  misc_feature (56)..(56): Xaa is any aa, unknown, or other
  misc_feature (58)..(58): Xaa is any aa, unknown, or other
MQVRXGCXGXKMYPDMVEQVTTTTTTQTLIMGVAPSTGGFEAAAXAENGGCKCGAXAXATPAPASEDDRVQHAGP

SEQ ID NO: 327 - DNA, 486 bp, Zea mays
  misc_feature: Ceres CLONE 217729-F
  misc_feature: Encodes the peptide sequence at SEQ ID NO. 328
agaagcatcacacactaatcaacaagcaggaccagctagctagctcctctcactgctatcacccgcccagccatctcgctgaaagadaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggttgcctcaaggcggcctacgttcaggtccacgctgtgctctccgcggmgcaggagctgcccggcgactgcggcctctcgctgtcctacaacatcacccccgacatcgactgcgacaagatcgaatgaagggatactgttcccttaccagaatcc

SEQ ID NO: 328 - protein, 129 aa, Zea mays
  misc_feature: Ceres CLONE 217729-F
MKTTSSGIAVVLLVAMLAVHSALADISCSDVLNDLSPCLPFLQGKAAKPSESNNQCCDGVRALYAAADTRPDRQATCRLPQGGLRSGPRCALRGAGAARRLRPLAVLQHHPRHRLRQDRMKGYCSLTRI

SEQ ID NO: 329 - DNA, 455 bp, Zea mays
  misc_feature: Ceres CLONE 217852-F
  misc_feature: Encodes the peptide sequence at SEQ ID NO. 330
  misc_feature (415)..(415): n is a, c, t, g, unknown, or other
atacatttcgactctcaactcccaaggtcccttttttttctcgatctggaagcgccgcagtagcagccatggacgtgagcggasaggcgggaaggcgaagaagggcgcggccgggcgcaaggccggcgggcgagcgaagaagtcggtgtcgcggtcctccagggccgggctgcagttccccgtcagccgcgtcgggcgtacctcaaaaagggccggtacgcgcabgtaggcacgggtgccccgtctacctcgccgccgtcctggaktacctcgcggccgaggtgctcgagctcgccggcaacgcggcaagggacaacaagaagacgcgcatcatcccgcgcsasgtgctcctcgccatccgcaacgacgaggagctcggcaagctgctggccggcgtcaccatcgcccacggsgncgttcctccccaacatccacactgtgctcctccccaagaa

SEQ ID NO: 330 - protein, 129 aa, Zea mays
  misc_feature: Ceres CLONE 217852-F
  misc_feature (36)..(100): Pfam Name: Histone Pfam Description: Core histone H2A/H2B/H3/H4
  misc_feature (6)..(6): Xaa is any aa, unknown, or other
  misc_feature (53)..(53): Xaa is any aa, unknown, or other
  misc_feature (66)..(66): Xaa is any aa, unknown, or other
  misc_feature (92)..(92): Xaa is any aa, unknown, or other
  misc_feature (116)..(116): Xaa is any aa, unknown, or other
MDVSGXAGRRRRARPGARPAGERRSRCRGPPGPGCSSPSAASGVPQKGPVRAXRHGCPVYLAAVLXYLAAEVLELAGNAARDNKKTRIIPRXVLLAIRNDEELGKLLAGVTIAHGXVPPQHPHCAPPQE

SEQ ID NO: 331 - DNA, 482 bp, Zea mays
  misc_feature: Ceres CLONE 217858-F
  misc_feature: Encodes the peptide sequence at SEQ ID NO. 332
atttccccgtcacacacctttcgctttctcccagtccacacccccaactgcctccccacttcgcaccgccaccgtctcccgaccgcgacgccggcgacctccgcaccgcatcgctccagcagccgatcgttccgagatttgttgatcaaagaaccatggaaggatcgttccagttgaatcccaacgccagtcctttcatacctggattgctggtttcatctgcacaaaaagccccagaaaaacaaggaggatcatcatcaaagggagagccttctggtagcacctttgatccttctgagtatgaggaaaatgacatggatgaacttgctctagtcaaaatggtcttttcaatgttcccaaatgtctccacggacttcattgatgagttaatcaaggcaaatgattttgacttaaatctgactgttgatatgctttatgagctgaactcacaagatatgcttcatgatgatttctgaggctat

SEQ ID NO: 332 - protein, 106 aa, Zea mays
  misc_feature: Ceres CLONE 217858-F
MEGSFQLNPNASPFIPGLLVSSAQKAPEKQGGSSSKGEPSGSTFDPSEYEENDMDELALVKMVFSMFPNVSTDFIDELIKANDFDLNLTVDMLYELNSQDMLHDDF

SEQ ID NO: 333 - DNA, 117 bp, Zea mays
  misc_feature: Ceres CLONE 217868-F
aatcacactcgactctcctctctcgcatccgcrcctttcgagctctactccaccccctcgatctcgaagcgcvagcagcagtcaggcggccatggacgcgagcgcmcggtagccggc

SEQ ID NO: 334 - DNA, 224 bp, Zea mays
  misc_feature: Ceres CLONE 217872-F
  misc_feature (99)..(99): n is a, c, t, g, unknown, or other
agagcctcagaggggggagaggaggctagtagggatagcgcatcgtcatcgcasctccacgsgcsggygagcbagaccaccagaggcagcgatggcggntggcggactgtgggagacactgaagcagtcgatcgttgcatacacggggctgtcgccggcggsctttttcacggccgatggcggtggcggccgctctgtaccatgtcgtgtcggggctcymtcgc

SEQ ID NO: 335 - DNA, 346 bp, Zea mays
  misc_feature: Ceres CLONE 217970-F
  misc_feature: Translation starting site: 245
  misc_feature: SWISSPROT Homolog: EC 1.1.1.219 Dihydrokaempferol 4-reductase
  misc_feature: SWISSPROT Homolog: EC 1.3.1.77 Anthocyanidin reductase
  misc_feature (64)..(64): n is a, c, t, g, unknown, or other
  misc_feature (106)..(106): n is a, c, t, g, unknown, or other
  misc_feature (210)..(210): n is a, c, t, g, unknown, or other
  misc_feature (217)..(217): n is a, c, t, g, unknown, or other
acctcgagtctsagagaatggctaasactgctaakggtaaggtctcgtgtcactggggsgtctngtttcatcgsctcctggctcrtcaagcggcttctttagtctnggtaccatgtsctgggaacagtcagagacccagggaatggcaagaaagtagggcacctctggggcctggaasgcaaaggaaaggctgcagctcgtgagasttantctcttngaggaagggagcttcgacgacgctgtgatggcttgcgagggcgtcttccacaccgcatcgcccgtcgtcaccggatctaattccaaggaggagatgctttattcagcaataaacggcacgatgaacgtg

SEQ ID NO: 336 - DNA, 239 bp, Zea mays
  misc_feature: Ceres CLONE 217996-F
  misc_feature: Translation starting site: 60
  misc_feature: Pfam Name: Ribosomal_L15e Pfam Description: Ribosomal L15
  misc_feature (78)..(78): n is a, c, t, g, unknown, or other
agygcastccacccaaytcgccgccgccgctgccaacgccgcctgctgcsgcagccgccatgggggcgtacaagtatntgtcggaactatggaggaggaagcagtcggacgtgatgcgcttcgtgcagcgcgtgcgctgtgaggagtacaggcaksagccgtccatcgtccgcctcaccakgsmcacccgmsycgacaaggyccgtsgtctcggctacaakgccaagcagggatatgtt

SEQ ID NO: 337 - DNA, 195 bp, Zea mays
  misc_feature: Ceres CLONE 218027-F
  misc_feature (128)..(128): n is a, c, t, g, unknown, or other
gttcmmttcgttrcgtcttgaaaggggagagagagagagagaagagagagagaagagaagagagagagaggagtgggagacccgcgagaggctgcagtgtagggasmgtagactcagcgactgcgaangagggataaggggatagccggggatcggaccgatcaggcaggactgggagccggtcgttrtgcggaa

SEQ ID NO: 338 - DNA, 303 bp, Zea mays
  misc_feature: Ceres CLONE 218062-R
acaagaacatgaatamccagaaattatgatctggactgctttactgctttttcttagaccaataattgcaggagaatgttagttcatcttacttaaagattcgtccgtgtactttggtcctatcttacttcctgcttacttttgggtgtcatgagtgaacattaaactgatcgcaagttatgctttagagtgattgtttcttgcaacacttagctgttcacctcgtggccactcaaatwgcagaagttcccgrcaaactgaagrcaatcaataatactaatttatwcaaaaaaaaaaaaaaaa

SEQ ID NO: 339 - DNA, 592 bp, Zea mays
  misc_feature: Ceres CLONE 218080-R
  misc_feature: Pfam Name: Abhydrolase_1 Pfam Description: alpha/beta hydrolase fold
gcatagactgactgtctggagtgatctgatgttagcagacctttgataccagtatgcggtgatgcgtaggctgtagatgggtcgaatgtgcttgtgtgtgtatgtgccctgctgcaagttgccctttgctatttaaaatggaagaagaaatggcgcacggttcgtccccgcggccttcctgacaggcctccttgatcctgtccaatcgagggaggagtttctgcagttgttcgccaagttagacggagacgtaccagttctggtagtgtcaacggtcaatgctcccaagagatccaaggccgagatggaggctctcaggggatctaaaggggtgacgaagtttgtggaggtcgcaggcgctcttctaccgcaggaagaataccccttggcagtcgcggaggaactctacagcttcctgcaggaatcattcgcagcaagaaggtgaatgtgcgtgcgtgcgtgcgcacaactgtgccagaagacaggttctcaagtcccacacatcgtgagtaaattcgttagcctgctacagtgtactggaggtttttagcaacaataaagcggcatcactcgtacaaaaaaaaaaaaaaaa

SEQ ID NO: 340 - DNA, 484 bp, Zea mays
  misc_feature: Ceres CLONE 218088-F
  misc_feature: Encodes the peptide sequence at SEQ ID NO. 341
  misc_feature (74)..(74): n is a, c, t, g, unknown, or other
  misc_feature (346)..(346): n is a, c, t, g, unknown, or other
aatggcattcttgcattgaaggaaccttccctccacctccaccgcccgagagcgagcdgccggacgggggtttnggttggggcatggctgccccggcgatgctccaagtggtgatcctcgccgcggtcctccttctcccgttcctcagcgtgccgggcgccgaggcacagaccahsaagttctgcctcacgcagttcgccatcgctagccaggcctgcgccatcctgccacccaccagtcctgagcaccaccaccatcatcacgatgacgaggacaatkacgaggacaacgacgaagatgaggacgaagacgaggacaacgatgaagatgaaagahraggmcaatnacgacgatadcamcrgtdgcggcgaccgcggcgccgcccccgcgaccaaggcaagahgagcgacgtcgtcagtaaacccaccgtgtcgtccgcgagcaaacccgccgtgtcctccatgatcascgtcgawgcggtcam

SEQ ID NO: 341 - protein, 133 aa, Zea mays
  misc_feature: Ceres CLONE 218088-F
  misc_feature (31)..(31): Xaa is any aa, unknown, or other
  misc_feature (66)..(66): Xaa is any aa, unknown, or other
  misc_feature (85)..(85): Xaa is any aa, unknown, or other
  misc_feature (88)..(88): Xaa is any aa, unknown, or other
  misc_feature (91)..(91): Xaa is any aa, unknown, or other
  misc_feature (92)..(92): Xaa is any aa, unknown, or other
  misc_feature (93)..(93): Xaa is any aa, unknown, or other
  misc_feature (94)..(94): Xaa is any aa, unknown, or other
  misc_feature (107)..(107): Xaa is any aa, unknown, or other
  misc_feature (129)..(129): Xaa is any aa, unknown, or other
  misc_feature (131)..(131): Xaa is any aa, unknown, or other
MAAPAMLQVVILAAVLLLPFLSVPGAEAQTXKFCLTQFAIASQACAILPPTSPEHHHHHHDDEDNXEDNDEDEDEDEDNDEDERXGQXRRXXXXRRPRRRPRDQGKXSDVVSKPTVSSASKPAVSSMIXVXAV

SEQ ID NO: 342 - DNA, 516 bp, Zea mays
  misc_feature: Ceres CLONE 218091-R
  misc_feature: Encodes the peptide sequence at SEQ ID NO. 343
gcagagctagtgccgtcagaggcgtccccgtccccagatgatggcggcctggatgagattctaagcaagttgaacattgaagtgtctccaactttaatcctcactggatttggtgcttttattgctttatggatcctatcttctgttgttgctgcagttgattcagtccccctgctcccaaaattgctggaattaataggaactgcttacacaatttggttcatcgcacggtatctccttttcaaggaaagcagagatgacctgtttgcaaagttcgaagatctcaaacagaggattatttgatctatcgtcgcattttggtcggatctggtttccttggtgcagggagggtttctataccatgtcgcggtgtcggttgtgtgatctcatccccccttgtagatagtactctgctatctcgtcgtgatcgtgagtggtgattctgtctggttgatatttgctactgatattggtcccatttgagatatgcgttgctgctgaaaaaaaaaaaaaaaa

SEQ ID NO: 343 - protein, 100 aa, Zea mays
  misc_feature: Ceres CLONE 218091-R
  misc_feature: SWISSPROT Homolog: EC 6.1.1.9 Valine--tRNA ligase
AELVPSEASPSPDDGGLDEILSKLNIEVSPTLILTGFGAFIALWILSSVVAAVDSVPLLPKLLELIGTAYTIWFIARYLLFKESRDDLFAKFEDLKQRII

SEQ ID NO: 344 - DNA, 416 bp, Zea mays
  misc_feature: Ceres CLONE 218101-F
  misc_feature: Encodes the peptide sequence at SEQ ID NO. 345
aaaaaccgatcaatctcgcagagggagaaccaaccaatccatcatctgtctcgactctctcgcgtcttcgscvggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtcgcggcagcgggtccaggccgaccgcgccggcggccgcaaccctacctggaacgccacgctccgcttcgccgtcccggcaamcggcgcctcctcctccctccacatcctcctccgcgccgagcgcgcmctcggcgaccgcgacgtcggcgargtccacatcccgctctccgagctcctctc

SEQ ID NO: 345 - protein, 99 aa, Zea mays
  misc_feature: Ceres CLONE 218101-F
  misc_feature (7)..(92): Pfam Name: C2 Pfam Description: C2 domain
  misc_feature (67)..(67): Xaa is any aa, unknown, or other
MATTRPLELTLISAKDLKDVNLLSKMEVYAVASLSGDPRSRQRVQADRAGGRNPTWNATLRFAVPAXGASSSLHILLRAERALGDRDVGEVHIPLSELL

SEQ ID NO: 346 - DNA, 458 bp, Zea mays
  misc_feature: Ceres CLONE 218101-R
  misc_feature: Encodes the peptide sequence at SEQ ID NO. 347
gcgccatacgccgctcytccgtcgcagtacggcggktacggktacccgcmaccgmagsccgccgcgtacggstacccgccgccgccacaggccgggtacggstaccagccgccgcagaccgccgggtacgggtatcagcagcaggccaagaagaagaacaaacttcgggatggggctcggcgccgggctgctgggaggcgccgtcgggggccttctggtcggggacatgatctcggattcgtcggcgtatgatgccggctacgacgccgggttcgacgacggcggtggcttcgatttctagagcagcgcagtggtgagtggtgacgtgataccgcgcatctgagagacgagttttttcgtcttggatctgactttgtgatttctttcgctttatacgcgatctgattgttaggacgaaataaaattatgcatcttatatctcaaaaaaaaaaaaaaaa

SEQ ID NO: 347 - protein, 43 aa, Zea mays
  misc_feature: Ceres CLONE 218101-R
MGLGAGLLGGAVGGLLVGDMISDSSAYDAGYDAGFDDGGGFDF

SEQ ID NO: 348 - DNA, 426 bp, Zea mays
  misc_feature: Ceres CLONE 218105-R
  misc_feature: Encodes the peptide sequence at SEQ ID NO. 349
cgcacgctgctccgggaggccacggcggcgctgctcaacgcctactacaacgcccccgggggtcccttcctgtacccgaccacggccagcgtcatggaccacatgaacggcgcgctcctcagctccgggcagagggtgctcctggagggcgcgcggttccgcagggccaacgcaggcggcggcgggcggacaaggctcatgtgcgacttcacgacatgcagctgagctgaggattattactacctacctgttgatgatgaatgatcatcagatcagaccagtagcagtagcagcagcgcagcaaatgtttctaaaaattgcacggcgcgcatatgtagcactctgtcgtcgttttattcaggagcagattgggcagagcacgagtccattctygttgcactccccgcatcaaaaaaaaaaaawaaa

SEQ ID NO: 349 - protein, 74 aa, Zea mays
  misc_feature: Ceres CLONE 218105-R
RTLLREATAALLNAYYNAPGGPFLYPTTASVMDHMNGALLSSGQRVLLEGARFRRANAGGGGRTRLMCDFTTCS

SEQ ID NO: 350 - DNA, 439 bp, Zea mays
  misc_feature: Ceres CLONE 218110-R
  misc_feature: Encodes the peptide sequence at SEQ ID NO. 351
gcgacatgtaccgcacgctgctccgggaggccacggcggcgctgctcaacgcytactacaacgcccccggggstcccttcctgtacccgaccacggccagcgtcatggaccacatgaacggcgcgctcctcagctccgggcagagggtgctcctggagggcgcgcggttccgcagggccaacgcaggcggcggcgggcggacaaggctcatgtgcgacttcacgacatgcagctgagctgaggattattactacctacctgttgatgatgaatgatcatcagatcagaccagtagcagtagcagcagcgcagcaaatgtttctaaaaattgcacggcgcgcatatgtagcactctgtcgtcgttttattcaggagcagattgggcagagcacgagtccattckygttgcactccccgcatcgcaaaaaaaaaaaaaaaa

SEQ ID NO: 351 - protein, 77 aa, Zea mays
  misc_feature: Ceres CLONE 218110-R
  misc_feature (24)..(24): Xaa is any aa, unknown, or other
DMYRTLLREATAALLNAYYNAPGXPFLYPTTASVMDHMNGALLSSGQRVLLEGARFRRANAGGGGRTRLMCDFTTCS

SEQ ID NO: 352 - DNA, 377 bp, Zea mays
  misc_feature: Ceres CLONE 218119-R
  misc_feature (234)..(234): n is a, c, t, g, unknown, or other
ctcgaagagactgaacagcatgtccctgaacytgaaagsccggagcttggacaaggagaacgaggaggattgatccatccaccaacggacaaagcagctgtcgtaggtctggtgcagtactaccacgcgttcaaagcagcatctctgtatttacggaatttacggaggaagacgcggtttatctctttcataaactccacacatgtgagagagctctggcactaggtcaccgcntctatcatcattatcatcctagtttagtttagtgcgtaagttttgtacacatccaatcgatgtccagttcctaatttccttgtctctagtttgtacccataaattagtaatgtaagtacttatatcgaaaaaaaaaaaaaaaa

SEQ ID NO: 353 - DNA, 175 bp, Zea mays
  misc_feature: Ceres CLONE 218146-F
  misc_feature: Pfam Name: Ribosomal_L32e Pfam Description: Ribosomal protein L32
  misc_feature (116)..(116): n is a, c, t, g, unknown, or other
gccgctgcttaccgcctatctcgccaagcaccgccgcatcaccgaagttcgcaaagatggcggtgccgctgctgacgcagaagatcgtgaagaakaggggtcaagcagttcaagangccccatcttgaccgstacaaggtgccttaagccaagctggcgcaggcccaagggtats

SEQ ID NO: 354 - DNA, 341 bp, Zea mays
  misc_feature: Ceres CLONE 218176-F
  misc_feature: Encodes the peptide sequence at SEQ ID NO. 355
  misc_feature (132)..(132): n is a, c, t, g, unknown, or other
  misc_feature (141)..(141): n is a, c, t, g, unknown, or other
  misc_feature (143)..(143): n is a, c, t, g, unknown, or other
  misc_feature (155)..(155): n is a, c, t, g, unknown, or other
acaatcggaactcgctgcactgcttggaatccaacgagccaatcattcaaatcctccccggaaccgcgttgagcagggcacggtcgattggatctagggtgagggtccgtcgccgaagaaactcgcaggcrntcacgaggnangcrgcrgggganggcgggggagatggcctcggaggagatgacggcgacggaggtggctgcggctgctggacttgaagccgcacccggaggcggcttctacaccgagaccttccgcgacggctccatcacgctcaccacgtcccagstcccgccccactacaaggtaaascgtggctgttagcaccgcaatctatttcc

SEQ ID NO: 355 - protein, 52 aa, Zea mays
  misc_feature: Ceres CLONE 218176-F
  misc_feature (42)..(42): Xaa is any aa, unknown, or other
  misc_feature (49)..(49): Xaa is any aa, unknown, or other
MASEEMTATEVAAAAGLEAAPGGGFYTETFRDGSITLTTSQXPPHYKVXRGC

SEQ ID NO: 356 - DNA, 169 bp, Zea mays
  misc_feature: Ceres CLONE 218179-F
  misc_feature: Translation starting site: 45
aattcgctttcgatccccacagaggcacagacgagacgacagagatgaaggacggaacgtcgtcggggggaggggcgttcgstgcgggcagcgatccaaaggcadccgtcgacggcgaagcatacksgscgccgaagctgtcgccccaggacctasccatcgactatgc

SEQ ID NO: 357 - DNA, 1482 bp, Zea mays
  misc_feature: Ceres CLONE 218223
  misc_feature: Encodes the peptide sequence at SEQ ID NO. 358
aaaaacaccacgtacacgggcgcggcgcggagaccgaccaccacctcttcctccggttgcctccgccctcgggcctcgccttcgctccatcgtccccgtctccatcctccaggaccggcaaccccacgtagcgcgacagctcgtcgccgtagtccatggcggctacggaggtgtactcgccgaccacggcggcggcagcgcagcagcagcgggggaaggcggcatcgcaggcgtggcgagcggtggtagggtggatcggcttcttcctccaagtcctgcttcagatcctccggggcacgccctcctgcgcacagctcctctccttcgttggtttccgctatccgctcctctccggacctgcggcctcggagccgttgccggaggtggccttcatgccgctccactccgagatccctgctgacgcggcgcctgccccgaaacctgcgtctgagcccctgggccgcctcacggtagtgcttgacttggatgagactttagtttctgcatatgaatcatctagtcttcctgccattgtgcgcacacaagctgttgaagcaggattacattgctttgatatggaatgtatatcgtctgataaggatgttgaaggcaaacaaaaggtgaatcatgtgactgtttttgagcgccctggtttgcatgagttcttgcggaaaactagtgaatttgcagatcttatcctttttacagcaggtttagaaggttatgctagacctttagttgaccgaatagatgttcacaatagattcagaattcgtctctatcgcccatcaactgttaccacggaatatagagaacatgtgaaagatcttactcgcgtgtcaaaagattttggcaggattgtcattgtcgacaacaatccgttcagtttcattcttcagcctttgaatggaataccttgtgttccattttcagctggacaacattctgatgatcagctcatgacggttatatttccactcctgaagcatctttccctccagaaagacgtcagacccgtattgcgtgaaagatttcatatgccagaatggttccaaaaccatgggatcccccaaattagtcaggctgtgtaagttttgctgccgcacaatggaattgttttgatgaaggctggagtgcctactatgctataagccccttaaggtcatgttcgtttgatcccaaaaccatagggattgagggggattggaagggattggagaggattttgacttataggggatttaatccccctcagtccctatggattagtacaaaacgaacagggcttaagggagagcacttgtacattattatcaatattcacttagggttcttgataaaaccgagtcgctgttcatatggagttgtcacacccgaagataagaagattgtaatctagcatgacctcagatttaaatctgtgtagtggagcattttatatcaattaattgttgtatatcagcctcaaaaaaaaaaaaaaaa

SEQ ID NO: 358 - protein, 311 aa, Zea mays
  misc_feature: Ceres CLONE 218223
  misc_feature (95)..(291): Pfam Name: NIF Pfam Description: NLI interacting factor-like phosphatase
  misc_feature: SWISSPROT Homolog: EC 3.1.3.16 Phosphoprotein phosphatase
MAATEVYSPTTAAAAQQQRGKAASQAWRAVVGWIGFFLQVLLQILRGTPSCAQLLSFVGFRYPLLSGPAASEPLPEVAFMPLHSEIPADAAPAPKPASEPLGRLTVVLDLDETLVSAYESSSLPAIVRTQAVEAGLHCFDMECISSDKDVEGKQKVNHVTVFERPGLHEFLRKTSEFADLILFTAGLEGYARPLVDRIDVHNRFRIRLYRPSTVTTEYREHVKDLTRVSKDFGRIVIVDNNPFSFILQPLNGIPCVPFSAGQHSDDQLMTVIFPLLKHLSLQKDVRPVLRERFHMPEWFQNHGIPQISQAV

SEQ ID NO: 359 - DNA, 489 bp, Zea mays
  misc_feature: Ceres CLONE 218230-R
  misc_feature: Encodes the peptide sequence at SEQ ID NO. 360
macgtcttctccgagtacggcaacatgtccagcgcytgcgtgctcttcatccctggacgmsatgcgcaagcgctccgccgaggacggcccaggccaccaccggcgaggggctcgactggggcgtcctcttcggcttcggcccgggcctcaccgtcgagaccgtcgtgctccacagcgtccccatcaccaccggagcgcccaccgccgcctgagtcgtccatctatcctcgcgatcgctccagacatgaacgacccgacctacgaataatgtatctgcgtaattaattaatttctatctgtgttgtgtcctagtagctgttaagtacccgttttaaaaamccyttaattaattttattatgggcgagctagctcaagagtggagtcataaaaccgcatggatggtgaggtattgtatagtacatgtgtaagacaagcttggctggttttttattttaatttgtttgctcaaggcaaaaaaaaaaaaaaaa

SEQ ID NO: 360 - protein, 69 aa, Zea mays
  misc_feature: Ceres CLONE 218230-R
  misc_feature: SWISSPROT Homolog: EC 2.3.1.74 Naringenin-chalcone synthase
  misc_feature (20)..(20): Xaa is any aa, unknown, or other
RLLRVRQHVQRLRALHPWTXCASAPPRTAQATTGEGLDWGVLFGFGPGLTVETVVLHSVPITTGAPTAA

SEQ ID NO: 361 - DNA, 475 bp, Zea mays
  misc_feature: Ceres CLONE 218233-R
  misc_feature: Encodes the peptide sequence at SEQ ID NO. 362
ctactgtgcgtgttctgagacatcagtggscatactcgtgtgacaamgcaaagatggagctgggctataccccaagaaacttgaccgaaggtttgtcggagatgctcctgtggctcaaggaagaaaaactaatcaagttttagcgttctctgctacacaccacatcacatatttaatgtacaccgagacattggggatgtgctggggattttgaagtgtatatgcttcggcattgcatcacgtcgtattatgctagaggaaatctaagatgttgacgtgtaatactgatgttggcaacaaagagagaaattatgcatttttattttacatcaatgtatttagttcaatgctttgtaggctgtaattgtataactagttgcttgaattgaaacgtaggtaattcaaatttcaaaggcgtgcccaagacaatcaaactattctgctgggcgtttgcgatgcaaaaaaaaaaaaaaaa

SEQ ID NO: 362 - protein, 46 aa, Zea mays
  misc_feature: Ceres CLONE 218233-R
  misc_feature (10)..(10): Xaa is any aa, unknown, or other
  misc_feature (15)..(15): Xaa is any aa, unknown, or other
TVRVLRHQWXYSCDXAKMELGYTPRNLTEGLSEMLLWLKEEKLIKF

SEQ ID NO: 363 - DNA, 379 bp, Zea mays
  misc_feature: Ceres CLONE 218256-R
  misc_feature: Encodes the peptide sequence at SEQ ID NO. 364
acagaagagaaattcttggagaaattcgttgctccctacgaggaatccatccctggtcttgccgatgcttatgagtctgcttgtatggggaaagtgacccggggcctatgactggaatgtcgaggagaatttcgaaggtttgtgttccctccattgtgcatttgtgtaacctcattctactgatctcgcttcaacagaaaaaattattccactgatgractatcgaagacgaaggcagttcatggacattagcttaggtccacactagtaagcgcataaattcatgttatagccatgaaaatgttcatttctaacttaaggatcgtttcatatgaaagtgcaagcaatataattctttttttctcaaaaaaaaaaaaaa

SEQ ID NO: 364 - protein, 36 aa, Zea mays
  misc_feature: Ceres CLONE 218256-R
TEEKFLEKFVAPYEESIPGLADAYESACMGKVTRGL

SEQ ID NO: 365 - DNA, 521 bp, Zea mays
  misc_feature: Ceres CLONE 218262-R
  misc_feature: Encodes the peptide sequence at SEQ ID NO. 366
  misc_feature (283)..(283): n is a, c, t, g, unknown, or other
yctatattgtctttgtggcactgtacactgtaccagttctgtatgagaaatatgaggacaaggttgatgcttttggtgagaaggctatgactgaactgaagaagtattatgccattttcgatgagaagtgcctatcgaagattccaaagggcccccttaaggataagaagcactagattggtagtaagctttcaccatagttgcctggaagcttgaaatatattatgcgctctatcaatgtcatgtgaactttgtcatgtacctttaatattgatttggcgcntttcgcaagtgctaggttagtgaatgaagtgtgcacatttctgttcaaggtaatgatagtatttgatctagtttgataatgtggtccgttgtcttgaagtgtgcgtgcatcccatatgcatcattgcacggaagttatttgacaaaggtcccagctgaggcttgatatgaaactatgagagctctcaaacgttgtgcccttcacatatggattgtgccatgtagaaaaaaaaaaaaaa

SEQ ID NO: 366 - protein, 57 aa, Zea mays
  misc_feature: Ceres CLONE 218262-R
YIVFVALYTVPVLYEKYEDKVDAFGEKAMTELKKYYAIFDEKCLSKIPKGPLKDKKH

SEQ ID NO: 367 - DNA, 372 bp, Zea mays
  misc_feature: Ceres CLONE 218304-R
  misc_feature: Encodes the peptide sequence at SEQ ID NO. 368
ggcggatacggtggcgggcgccgtgatggaggcggctacggcggtggcggtggaggctacgscggtggtcgtggaggctacgscgscggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggktttatcttcgtctgtggtcgtctcgtgtccgtatgtttcgtttcgtgttcgttgttgttgttgcccatctgtgctgttgaagatgtaaatcttactttatctgcttatcttttttgtgagaattttgcaacaaaaaawaaaaaa

SEQ ID NO: 368 - protein, 104 aa, Zea mays
  misc_feature: Ceres CLONE 218304-R
  misc_feature (21)..(21): Xaa is any aa, unknown, or other
  misc_feature (28)..(28): Xaa is any aa, unknown, or other
  misc_feature (29)..(29): Xaa is any aa, unknown, or other
  misc_feature (76)..(76): Xaa is any aa, unknown, or other
ADTVAGAVMEAATAVAVEATXVVVEATXXVGDTVVQTAAAATATTTGTGGTERWGPLRPSYLVRFCYRVHPSLEGXLSSSVVVSCPYVSFRVRCCCCPSVLLKM

SEQ ID NO: 369 - DNA, 355 bp, Zea mays
  misc_feature: Ceres CLONE 218312-R
  misc_feature: Encodes the peptide sequence at SEQ ID NO. 370
kccggctacgggtaccagcagcagsccktgaggcygyagaagaagaagmacaacttcgggatggggctcggggccgggctgctcggaggcgccgtcgggggcctcctgatcggcgacatgatctcggactcgtcggcgtacgacgccgggttcgacgatggcggcggcttcgatttctagcgcgctccggtggcatggscgattggggcggtgacgccacgccgcgcatcagagacggagaggttcccgttttggatttgccttttgtgatttgtttccttctgtacgcaatctatgtaattgtcggaacgaaatcaatcaagattatgcatacatatgaaaaaaaaaaaawaaa

SEQ ID NO: 370 - protein, 58 aa, Zea mays
  misc_feature: Ceres CLONE 218312-R
  misc_feature (8)..(8): Xaa is any aa, unknown, or other
  misc_feature (9)..(9): Xaa is any aa, unknown, or other
  misc_feature (11)..(11): Xaa is any aa, unknown, or other
  misc_feature (12)..(12): Xaa is any aa, unknown, or other
  misc_feature (16)..(16): Xaa is any aa, unknown, or other
GYGYQQQXXRXXKKKXNFGMGLGAGLLGGAVGGLLIGDMISDSSAYDAGFDDGGGFDF

SEQ ID NO: 371 - DNA, 441 bp, Zea mays
  misc_feature: Ceres CLONE 218329-R
  misc_feature: Encodes the peptide sequence at SEQ ID NO. 372
gcccctgcgacccagaggatctcaaccacgccgtcaccatggtggggtatggtgccgaatccggtggatccaaatactggatcgtcaagaactcgtggggcgagaagtggggcgagaagggatactttcgcctcgagaggcgcgtcaaggacgtcaggggcactgcggtatagccgagtgggcaaactacccggtgatgtgagctcccgtcccgtgtctgtcgccaccgtgctttacctgcctggcctatagtacagtgcggtcgtcttgcttttycctgcacatgcgcaagcctatatatatgatgaggtgcagaagtcagcttgtagaacaggctgaaataaactcgatgtgcgcggcctgtgtactcagcagtgtcgtcgttgtcatttgtctattatctatcatcttaagaactatatagcaaaaaaaaaaaaaaaa

SEQ ID NO: 372 - protein, 56 aa, Zea mays
  misc_feature: Ceres CLONE 218329-R
  misc_feature: SWISSPROT Homolog: EC 3.4.22.38 Cathepsin K
PCDPEDLNHAVTMVGYGAESGGSKYWIVKNSWGEKWGEKGYFRLERRVKDVRGTAV

SEQ ID NO: 373 - DNA, 372 bp, Zea mays
  misc_feature: Ceres CLONE 218342-R
  misc_feature: Encodes the peptide sequence at SEQ ID NO. 374
scgacaaccgcgacgtgttcgcgttctgggacgcgttccaccccacggagagggcaaaccgcatcatcgtcgcccagttcatgcacggcgacacggactacatgcaccccatgaacctcagcaccatcctcgccacggaccaggagggcctctagactatagcttgatcagccggacacgattatacgtacatgcgtgatgtgtctcacgtgcytagcacgttagccatgtgttggatgatggcagcccaatttgccaataatattcgtgcctcgatccaagtttcaccttaaaaagaattagtgactggctatggttaatcgatccgtgttatatatstccgcgagcattcgttcaaaaaaaaaaaaaaaa

SEQ ID NO: 374 - protein, 50 aa, Zea mays
  misc_feature: Ceres CLONE 218342-R
DNRDVFAFWDAFHPTERANRIIVAQFMHGDTDYMHPMNLSTILATDQEGL

SEQ ID NO: 375 - DNA, 450 bp, Zea mays
  misc_feature: Ceres CLONE 218474-R
  misc_feature: Encodes the peptide sequence at SEQ ID NO. 376
gctctgtccgctggttcccggcccacagccgggctgcgccgtcacgcgccccatcgccgcgytctcaggtggcaacaatcctatctcatggaaactgagacggttctaccagttcaaatgaaaaacacttgcctgcaatatctgatccagaaatagaatctgcattymaggatttgttggctgctagttggaatgaactyccagattctcttgtascggaagcaaagaaagcagcatctaaagccaccgatgatagtgctggtcaagaggacctctacctgtgtggaatgtsgcsaggaataawycgtagtctgtagtgggggtgcttctggtgtgcgtgtttgcgttcttcggtctcggtgtctgtctaccaattcctatctgatgtatcggcttcggtttcgtatgaaccatgccggatgctttcagtatgtaaaaaaaaaaaawaaa

SEQ ID NO: 376 - protein, 39 aa, Zea mays
  misc_feature: Ceres CLONE 218474-R
  misc_feature (21)..(21): Xaa is any aa, unknown, or other
LCPLVPGPQPGCAVTRPIAAXSGGNNPISWKLRRFYQFK

SEQ ID NO: 377 - DNA, 343 bp, Zea mays
  misc_feature: Ceres CLONE 218477-F
  misc_feature: Encodes the peptide sequence at SEQ ID NO. 378
acgtcctcgtttctgtccgaggtcatcgcctccgcaacttcgtggccggtgaggtcgcaccaccatggcgtcgctcctagcccggcarggsagcgcargcggctbccgcgcggaggcaaacggcgcactcggggccmggcmgcgtcggcgatgcaagggsamctccgkacctacatggasgcgggggattcccaagcggttcaaagaggatgasgagaaagaacagcttgcaaaagatctcgcaaaagattggaatgctgtgtttgaaaggagcatcaatacattgtttttgactsmaatggtccgtggcttgatgctaamtctcaagtacttctttgataga

SEQ ID NO: 378 - protein, 93 aa, Zea mays
  misc_feature: Ceres CLONE 218477-F
  misc_feature (12)..(12): Xaa is any aa, unknown, or other
  misc_feature (14)..(14): Xaa is any aa, unknown, or other
  misc_feature (26)..(26): Xaa is any aa, unknown, or other
  misc_feature (33)..(33): Xaa is any aa, unknown, or other
  misc_feature (35)..(35): Xaa is any aa, unknown, or other
  misc_feature (39)..(39): Xaa is any aa, unknown, or other
  misc_feature (50)..(50): Xaa is any aa, unknown, or other
  misc_feature (78)..(78): Xaa is any aa, unknown, or other
  misc_feature (86)..(86): Xaa is any aa, unknown, or other
MASLLARQGSAXGXRAEANGALGARXRRRCKGXSXPTWXRGIPKRFKEDXEKEQLAKDLAKDWNAVFERSINTLFLTXMVRGLMLXLKYFFDR

SEQ ID NO: 379 - DNA, 372 bp, Zea mays
  misc_feature: Ceres CLONE 218479-R
ktgaggaagcagmccacaaggcggacccgccggcgagcacaggaccagctcctctaattaaggtcgcagtcgcagcgtgtcctggccgtgggcggcgattagaagctagctagcgttggcatgtgtattgggtyctggtttgcttttaccaaaagtttgtttcaaggtggatcgcctggtcaaggtccgtgtgctctattaaggtggatcgcgtgacctctggccagkssaktgtygctgcttgtgtaggacgtggtacgtacgggctttattttggtcccaagtcaaaagtcacggtcggtctggatgttgtgtacttgggtttgttgaattatgagcagctgcgtgttgtaattaaaaaaaaaaaaaaaa

SEQ ID NO: 380 - DNA, 525 bp, Zea mays
  misc_feature: Ceres CLONE 218486-R
  misc_feature: Encodes the peptide sequence at SEQ ID NO. 381
cgatggggaggacgcgttcgacatgcgcaagctgctccggcagccacagccgaagaagcaccaccaccaccatcacggtcccggtgggtgctgctcccacgacgcaccagttgcggcgactggttcttctccccagtcttctagttcacccgataagaaggctatcacttgagtaggactcgtatctacagagaggaatcaccaagccaattgtactcatctttcctctcactgggtatacaatatagtagttgtagcggtcttyccgtagtagaacggagaaagacctgtgcagtgagtatttgtgtacttggccgatggctcgaatcgtctgacctaatcagcgagaatggcaaccaaatatgcttcgtacttgaaaccttgtgttgtttttagacatgtgcgaattttcacagttcatttgattggtgatgcctgacaatttggtcagatctgataccgcggaatatataatgcaagtttgaaacctgtaatgcaattgttttgtcaaaaaaaaaaaaaaaa

SEQ ID NO: 381 - protein, 56 aa, Zea mays
  misc_feature: Ceres CLONE 218486-R
DGEDAFDMRKLLRQPQPKKHHHHHHGPGGCCSHDAPVAATGSSPQSSSSPDKKAIT

SEQ ID NO: 382 - DNA, 487 bp, Zea mays
  misc_feature: Ceres CLONE 218511-F
  misc_feature: Translation starting site: 304
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctc

SEQ ID NO: 383 - DNA, 474 bp, Zea mays
  misc_feature: Ceres CLONE 218591-F
  misc_feature: Translation starting site: 304
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcg

SEQ ID NO: 384 - DNA, 277 bp, Zea mays
  misc_feature: Ceres CLONE 218681-F
  misc_feature (134)..(134): n is a, c, t, g, unknown, or other
  misc_feature (226)..(226): n is a, c, t, g, unknown, or other
  misc_feature (229)..(229): n is a, c, t, g, unknown, or other
atacatttcgactctcaactcccaaggtcccttttttttctcgatctggaagcgccgcagtagcagccatggacgtgagcggasagrcgggaaggcgaagaagggcgcggccgggcgcaaggmcggcgggcgancgaagaagtcggtgtcgcggtcctccagggccgggctgcagttccccgtmagccgcgtcgggcggtacctcaaaaagggccggtacgcgcangtnaaggcacgggtgcccccgtctacctcgccgccgtcctggagtacctcg

SEQ ID NO: 385 - DNA, 163 bp, Zea mays
  misc_feature: Ceres CLONE 218682-F
aagagccccgtcccaactccaccacctctcttctctacggcgcgaswagggcggcgcggccgggcgtcggcgggaacgggcctcgctctcctcatctctccgatcacttctgtcttgtgaaaatggcggatgaactatgctcaatgtctgtgggtcagaagtt

SEQ ID NO: 386 - DNA, 433 bp, Zea mays
  misc_feature: Ceres CLONE 218748-F
  misc_feature: Translation starting site: 335
  misc_feature: Pfam Name: Ribosomal_L6 Pfam Description: Ribosomal protein L6
cgctccttcgcaaaccctcctaccccattccgccgcccgccccgcgaccccgaggaggaggcaagatgaagacgatcctggcgtcggagmatttggacatcccggagcgtcacagtgacggtggcggccaagctggtgacggtggagggcccccgcgggaagctcacccggaacttcaagcacctcaacctcgacttccagctgcaggagggcggccgcaagctcaaggtggacgcatggttcggcacccgccgcaccatggccgccatccgcaccgccatctcccacgtccagaacctcatcaagggggtcaccaaggggctaccgctacaagatgaggtttgtctacgcccatttccccatcaacgcgtccatcaccaactccaacaccgccatcgagataaggaacttcctcggcgagaagaaggtcaga

SEQ ID NO: 387 - DNA, 405 bp, Zea mays
  misc_feature: Ceres CLONE 218768-F
  misc_feature: Encodes the peptide sequence at SEQ ID NO. 388
  misc_feature (102)..(102): n is a, c, t, g, unknown, or other
  misc_feature (116)..(116): n is a, c, t, g, unknown, or other
aaacaagcaaaaggcacgaccaccaccgccggccgggtahgcaagctcaaaccctaatcgccgtccgccggcgacgcagcacgatggcccgctacgascgcnccatcaccgttttntcccccgayggcsacctcttccaggtggagtacgctctcgargccgtccgcaagvcaacgcgccgtgggstccgcggcacggacaccgtcgtcctcggcgtcgagaagaagtccacacccaagctccaggactccaggtccgtgcgcaagatcgcgtgcctagacactcacatagctctggcgtgcgcggggctgaaggcggacgcgcgcgtgctcatcaaccgcgcgcggtcgagtgccagagccaccgactcaccgtcgaggacccccgtcaccgtcgagtacatca

SEQ ID NO: 388 - protein, 107 aa, Zea mays
  misc_feature: Ceres CLONE 218768-F
  misc_feature: SWISSPROT Homolog: EC 3.4.25.1 Proteasome endopeptidase complex
  misc_feature (5)..(5): Xaa is any aa, unknown, or other
  misc_feature (7)..(7): Xaa is any aa, unknown, or other
  misc_feature (11)..(11): Xaa is any aa, unknown, or other
  misc_feature (16)..(16): Xaa is any aa, unknown, or other
  misc_feature (30)..(30): Xaa is any aa, unknown, or other
  misc_feature (35)..(35): Xaa is any aa, unknown, or other
MARYXRXITVXSPDGXLFQVEYALEAVRKXTRRGXRGTDTVVLGVEKKSTPKLQDSRSVRKIACLDTHIALACAGLKADARVLINRARSSARATDSPSRTPVTVEYI

SEQ ID NO: 389 - DNA, 1012 bp, Zea mays
  misc_feature: Ceres CLONE 218780-R
  misc_feature (1012)..(1012): n is a, c, t, g, unknown, or other
atgttggggtgggaggagggggggggtggaggggggggggaggagagaagagggtgggggggtcctggggggtgggtggttgttccgaatgggtaccgggccccccctcttctgatccagatgaagatcaaccgcagcgatttatcgtgcagttcgcgattcagtttaaaaaagttatctcgtagatgattgctttcgctgacggacatgtatccttttgccttcctcagttgcacgtatgcggcgaggtcaacgcgtgcgtcgatcaaccggttcagcagatcgattcgctgtctgtcaacgaacatacttcgatcctcctcttcccagccttgttgcaattaaatagtatggctattttttgagcaaaatgctgtccaggatcaattcttcacgccgaatcaacgaaatttgacatttcccttcgcctccggcaggctaatgagaattggcgatacaaaaggttaagccaggaacctccggtagaaatcccctggccctgaacctgtacccggtcacctcgtactattcttttttagcgccttattggagtctcaacgtttcgcttccccccctgtcctaatagttttctggcttgtttggtttttcctcttttgggtgaattggttggccgaaaaataaaaccctattgctgtcttatatcatttaaatgcagtgcagggtgtttttgccctggtatcttgggagaattctttgcgtttcgtataagataagaatcgtttgtattcgtagagcactggtggggttcccgcgcgatgctctttttttctgaccaggagaggcggcgcgtttcctctctgcgcgggcgaatttaagtaagattaagtgatgaccggggacgaggaatatcttcagtgaatgctaatgacaactacgaacggggtaagcgaaataattaattaccatggtgggacactatcgcctctaatttctccttattctcaggctcttttttttgaatctatacgtgcagcccaggcccatgcgggcn

SEQ ID NO: 390 - DNA, 270 bp, Zea mays
  misc_feature: Ceres CLONE 218787-F
  misc_feature: Encodes the peptide sequence at SEQ ID NO. 391
  misc_feature (123)..(123): n is a, c, t, g, unknown, or other
aaaatcgaaacaaagaaagaaaaaatcgagaggacgccagggccgattctctgcgtgacttggggcgtcgtcgcgagttttctccggccgagggcggcgcgaccggacaaccagcgttacgcngaccggcgacatgactcgcggcaaccagcgtgaccgcgaccgtgagcgcgcggmggcgaagcccaacgccaagaactcccaggacgggctcaccccggagcagcgccgcgagagggacaagaaagctctggaggagaaggcggccaa

SEQ ID NO: 391 - protein, 45 aa, Zea mays
  misc_feature: Ceres CLONE 218787-F
  misc_feature (1)..(45): Pfam Name: 4F5 Pfam Description: 4F5 protein family
  misc_feature (15)..(15): Xaa is any aa, unknown, or other
MTRGNQRDRDRERAXAKPNAKNSQDGLTPEQRRERDKKALEEKAA

SEQ ID NO: 392 - DNA, 260 bp, Zea mays
  misc_feature: Ceres CLONE 218829-F
  misc_feature (205)..(205): n is a, c, t, g, unknown, or other
  misc_feature (228)..(228): n is a, c, t, g, unknown, or other
akttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccscacccacgtctcccgcgagttccacgccttctgtgccacgcgcggacncacctggagccactgttcgccgngccctccgcatctccgacctctacatctccat

SEQ ID NO: 393 - DNA, 265 bp, Zea mays
  misc_feature: Ceres CLONE 218867-F
  misc_feature: Encodes the peptide sequence at SEQ ID NO. 394
  misc_feature (37)..(37): n is a, c, t, g, unknown, or other
  misc_feature (176)..(176): n is a, c, t, g, unknown, or other
aacctcgtgttcgttcggagcgcacacacacacaacnagatctcccccaaatccacccgtcggcacctccgcttcaagatgcagatctttgtgaaaccctgaccggcaagactatcaccctcgaggtggagtcgtctgacaccattgacaacgttaaggccaagatccaggacaanagagggcatcccccccagaccagcagcggctcatcttcgctggcaacagcttgaggacgggcgcacgcttgctgactacaacatccaga

SEQ ID NO: 394 - protein, 75 aa, Zea mays
  misc_feature: Ceres CLONE 218867-F
  misc_feature: Functional homolog of the protein sequence given in SEQ ID NO 96858
  misc_feature: Useful for making plants with modulated cold sensitivity
  misc_feature (12)..(12): Xaa is any aa, unknown, or other
  misc_feature (58)..(58): Xaa is any aa, unknown, or other
PRVRSERTHTQXDLPQIHPSAPPLQDADLCETLTGKTITLEVESSDTIDNVKAKIQDXRGHPPQTSSGSSSLATA

SEQ ID NO: 395 - DNA, 461 bp, Zea mays
  misc_feature: Ceres CLONE 218872-F
  misc_feature: Encodes the peptide sequence at SEQ ID NO. 396
aatcatcgcctccaccgttctctcttcctctgctcttctctgcctgcstgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgcacactggtgtcatggtcgagatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaa

SEQ ID NO: 396 - protein, 74 aa, Zea mays
  misc_feature: Ceres CLONE 218872-F
  misc_feature: SWISSPROT Homolog: EC 2.7.10.2 Non-specific protein-tyrosine kinase
MVEMGQKDAYVGDEAQSKRGILTLKYPIEHGIVSNWDDMEKIWHHTFYNELRVAPEEHPVLLTEAPLNPKANRE

SEQ ID NO: 397 - DNA, 962 bp, Zea mays
  misc_feature: Ceres CLONE 218944
  misc_feature: Encodes the peptide sequence at SEQ ID NO. 398
accaaacccacacctgcctcaactaatcgggtcagatcaggtcatcgggaaggccgccatggacgacgaggagcacgaggtttacggccaggagatccctgaggacggcgatatggacggcgctgacgttgatatggccgccgccggggacgacgcggcgaagcttcaggagcttgacgagatgaagcgcaagctgaaggagatggaggaggaggccgccgccctccgcgatatgcaggccaaggtcgccaaggagatgcaaggaggtgaccctagtatatctacagctgaggcgaaggagcaggtggatgcccggtctgtgtatgttggaaatgttgattatgcttgcaccccagaagaagtgcagcagcatttccaagcttgtggaactgtcaacagggtgacaatcttgactgacaagtttgggcagccaaaaggttttgcttatgttgaatttctggaacaagaagctgtccaggaagctctgaacttgaatgaatcggaattgcatggtcgacagattaaggttgcgccgaagaggactaatgtccctgggatgaagcagcgtccaccacgcgggtataatccctaccatggctacccttatagatcatatggagcaccgtacttccccccatacggttatgggagggctcctagattccgccgccctatgcgctacagaccttacttctgaagtacgtgcggggtaataatgttcaatgcaaaaccagccatggttagtggtcagtctcgggaataattaaacctactgctgtatcgtttgcgctgttcaatagttgacatcgttgcggttcaatgctcctttaccagctgccttttctgacctctgttctcgcataagcgacatgtagacacaggacgtagggttacaattgtttgcattttctgtcattcttgattctgatgaccctatacagcactcaaaaaaaaaaaaaaaa

SEQ ID NO: 398 - protein, 212 aa, Zea mays
  misc_feature: Ceres CLONE 218944
  misc_feature (88)..(157): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDDEEHEVYGQEIPEDGDMDGADVDMAAAGDDAAKLQELDEMKRKLKEMEEEAAALRDMQAKVAKEMQGGDPSISTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRAPRFRRPMRYRPYF

SEQ ID NO: 399 - DNA, 416 bp, Zea mays
  misc_feature: Ceres CLONE 218956-F
  misc_feature: Translation starting site: 123
  misc_feature: Pfam Name: ETC_C1_NDUFA4 Pfam Description: ETC complex I subunit conserved region
ctgcgctcctcctttcccctcagcctcccctcctctccggtgtacgtstccgccgagatggccgccccgstccggcgactcccctcccttggtcgcgcgcttctcacgccggcgccggccggatgctctccgcggaggcctctgatgccctcgttgagatcaagcccggggagatcgggatggtctccggcatccctgaggagcatctccggccgtaagttctaattttattcaccagctaggactgcatcccagcaaggttcagggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgcga

SEQ ID NO: 400 - DNA, 484 bp, Zea mays
  misc_feature: Ceres CLONE 218959-F
  misc_feature: Encodes the peptide sequence at SEQ ID NO. 401
  misc_feature (360)..(360): n is a, c, t, g, unknown, or other
acaaacctctcctggcacgagatcacgcttctcgttggatcgaacagctagggtttccaagatgttcgggcgcgcgccgaagaagagstgacaacacacggtactacgagatcctcgggagtctccaaggacgcgtcccaggatgacctcaagaaagcctaccgcaagccgccatcasraaccaccccgacaaggacggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttngtggtggaagcccttttggaggtggtggcagcagtaggggcagaaggcagcgaaggggagaggatgtggttcatcctctaaaggtttctctggaggatttgtacaatggcacatcaaagaagct

SEQ ID NO: 401 - protein, 59 aa, Zea mays
  misc_feature: Ceres CLONE 218959-F
  misc_feature (19)..(19): Xaa is any aa, unknown, or other
MGGGGGMHDPFDIFQSFFXGGSPFGGGGSSRGRRQRRGEDVVHPLKVSLEDLYNGTSKK

SEQ ID NO: 402 - DNA, 265 bp, Zea mays
  misc_feature: Ceres CLONE 219016-F
  misc_feature: Encodes the peptide sequence at SEQ ID NO. 403
  misc_feature (176)..(176): n is a, c, t, g, unknown, or other
  misc_feature (186)..(186): n is a, c, t, g, unknown, or other
tccattccatcatcccctttgcaagtatagtctctctgctaagcgamsagcttcaagctagtctcggcggctctagaagacgatgggcaaggacgasgtgatcgagagcggcgctagcggcggcgagttcgctgcsaaggactacacggaccctcccccgrsgccgctgatcgacnmggcggactnggggtcmtggtcgctgtaccgcgccgtgatcgccgagttcatcgccacgctgctgttcctgtacatcacggtggccacc

SEQ ID NO: 403 - protein, 61 aa, Zea mays
  misc_feature: Ceres CLONE 219016-F
  misc_feature (5)..(5): Xaa is any aa, unknown, or other
  misc_feature (27)..(27): Xaa is any aa, unknown, or other
  misc_feature (32)..(32): Xaa is any aa, unknown, or other
  misc_feature (35)..(35): Xaa is any aa, unknown, or other
MGKDXVIESGASGGEFAAKDYTDPPPXPLIDXADXGSWSLYRAVIAEFIATLLFLYITVAT

SEQ ID NO: 404 - DNA, 478 bp, Zea mays
  misc_feature: Ceres CLONE 219071-F
  misc_feature: Translation starting site: 305
  misc_feature (359)..(359): n is a, c, t, g, unknown, or other
  misc_feature (451)..(451): n is a, c, t, g, unknown, or other
cacaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttngtggtggaagcccttttggaggtggtggcagcagtaggggcagaaggcagcgaaggggagaggatgtggttcatcctctgaaggtttctctngaggatttgtacaatggcacatcgaag

SEQ ID NO: 405 - DNA, 377 bp, Zea mays
  misc_feature: Ceres CLONE 219084-F
  misc_feature: Encodes the peptide sequence at SEQ ID NO. 406
  misc_feature (313)..(313): n is a, c, t, g, unknown, or other
asatttcctctcccgataagagtgaggcctcggctcagcttgagcttcccctccctcccctcctgcgctccagctcccctccatcctcggccaaaaattctgcggcgagctccgatccggtccgactactaacccacgccgcagaagccgcgcgacctgatcgcggggggtcgaggagaggggaagcgcggcgccgcggttgcstgcsaccgtaccgccgcagagaaggaagaggagcccgtatccctccgccccgctgcccgscggaccgatggactccgagcactggatctcgcgcctggccgccgcgaanttctacgcgggcgcastcggccacagcgatcgggccgggatggatgagctggaaatggacgagg

SEQ ID NO: 406 - protein, 35 aa, Zea mays
  misc_feature: Ceres CLONE 219084-F
  misc_feature (14)..(14): Xaa is any aa, unknown, or other
  misc_feature (20)..(20): Xaa is any aa, unknown, or other
MDSEHWISRLAAAXFYAGAXGHSDRAGMDELEMDE

SEQ ID NO: 407 - DNA, 117 bp, Zea mays
  misc_feature: Ceres CLONE 219173-F
acgccgctgctccaagaaaccaccgccgagcccaaccgtcacaagcgcgcgaggtcaggagagagagagagagagagaggcggggagcaaaacaatgggaggggaaagaggaggacg

SEQ ID NO: 408 - DNA, 458 bp, Zea mays
  misc_feature: Ceres CLONE 219187-F
  misc_feature: Pfam Name: Ribosomal_S30 Pfam Description: Ribosomal protein S30
cttcctcccttcttacagccgccgccgccgcatcccagcctccatcaccgtttccgtctcgttgccatgggtaaggtgcacggatcgttggcgcgcgccgggaaggtccgcgggcagacccccaaggtggcgamsaggacaagaagaagaagccccgcgccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtcsatgtgctcagatgggaacttgagattgtatgaatttgagatatggtgatatgagctgatgatttttattatgcttattgtt

SEQ ID NO: 409 - DNA, 315 bp, Zea mays
  misc_feature: Ceres CLONE 219267-F
  misc_feature (127)..(127): n is a, c, t, g, unknown, or other
acaaatctttcgctccatactgataccgccccacgcccccaaaaaaaattcccaacaacctgcggtataaactacggtccctcttcgtcctcgtctcgtacgtgtaatcgccgatawssccaccgbnagtcaccactattcatcggccatggccgagcggtggctccaggtagactctcgccctcgtcgtcgtcacggcggcggcaacgacgktgttcctcagcccagcagacggcagcatcgttcccggscatgcccagctgcccgccggsgccgctcagcctgtscccgtrcatcggctacgtcttcggcgtc

SEQ ID NO: 410 - DNA, 128 bp, Zea mays
  misc_feature: Ceres CLONE 219301-F
  misc_feature (65)..(65): n is a, c, t, g, unknown, or other
gcggcgaccacttgtgcgatccatccctcaccatgtcgtcggagaaggaggcggcgctcgcggknggctcgatgacagcccaaccatatttgacaagatcatcaaaaaggaaataccttctactgtgg

SEQ ID NO: 411 - DNA, 111 bp, Zea mays
  misc_feature: Ceres CLONE 219343-F
agtaggaggcgacggcgggtgccgaggcccgcagcacggggaagctaccggctagcgtmcgggcgggctcgcgctttgctgtcgctccatgtcggtcgccggcgagacggc

SEQ ID NO: 412 - DNA, 1377 bp, Zea mays
  misc_feature: Ceres CLONE 219402
  misc_feature: Encodes the peptide sequence at SEQ ID NO. 413
atcagggccggacactacactaccatttttcctttcgcagcgtcccgtctgtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacacgcagcagcagaaggtggtggtcataggcaacgtctctgcagacgcgctcgtcaagaagctcctcaagtccgggaagcacgcggagccgtggccggagcctgctccagccccaccggccgccgacagcccgcccgggcccgacggatctcccggcagcgcaggcaagaagaagaaaaagaagaagggcaacaagagccccgaggcggcgaacaacaagcccgccgatccggcgccagcgcccgcgcccgcgccggcggagggcaacggcggacccaaccccccggagcagcacgacaaggctgacggcggcgcctcgtgcgatgaggcatcggatggtgagcaggataagcctgaggctggcggtggcggcggcaacggctcccctgacgccggagaagccaacgagggcggcaaggtggccccttccgccatgacgccgcacggcccgcagcccatcgcggctgccaccaacagcaatggtggtggtggtggtggcggcggcggcggcaagaagaaaggcaagaaaggtggccacggcaatgccaacagagacggcgccgggccaatcgtcgaggtccagcccccgccggacgcacccacgaagccggccgccggcaactccggccctctcactgtcatcgacgcgggaccgtacccaccaccggcagcggcggcgatgagctacccagggtactacgccgccggggtccacccgccggcgtacgtcatgagctacagcacggcgcacccgagctctgcgctccggagcagcgcgtactaccacccgatggccggtgcgccgtacacaccagggagcggcggcgggtacttctactcgaacggcgccggcgccgscgccggcggcgcccggatcgtactacatgttcagcgaggagaacgccaacgcatgcagcgtcatgtgagaagattagacggttaataatcaactcaactcaattattaactgcaagaagatgttgcagagagtggatgtgctagtcattatgctcttgttgtgcccaagaactggttgtcattgcaacgttattttgctgtatctgcaaaatacatggattttgaaaaaaaaaaaaaaaa

SEQ ID NO: 413 - protein, 360 aa, Zea mays
  misc_feature: Ceres CLONE 219402
  misc_feature (17)..(77): Pfam Name: HMA Pfam Description: Heavy-metal-associated domain
  misc_feature (333)..(333): Xaa is any aa, unknown, or other
MAAAEEGPEPLRYQTLALRVSIHCEGCKKKVKKVLHSIEGVYKTDIDTQQQKVVVIGNVSADALVKKLLKSGKHAEPWPEPAPAPPAADSPPGPDGSPGSAGKKKKKKKGNKSPEAANNKPADPAPAPAPAPAEGNGGPNPPEQHDKADGGASCDEASDGEQDKPEAGGGGGNGSPDAGEANEGGKVAPSAMTPHGPQPIAAATNSNGGGGGGGGGGKKKGKKGGHGNANRDGAGPIVEVQPPPDAPTKPAAGNSGPLTVIDAGPYPPPAAAAMSYPGYYAAGVHPPAYVMSYSTAHPSSALRSSAYYHPMAGAPYTPGSGGGYFYSNGAGAXAGGARIVLHVQRGERQRMQRHVRRLDG

SEQ ID NO: 414 - DNA, 457 bp, Zea mays
  misc_feature: Ceres CLONE 219443-F
  misc_feature: Pfam Name: ATP-synt_C Pfam Description: ATP synthase subunit C
  misc_feature: SWISSPROT Homolog: EC 3.6.3.14 H(+)-transporting two-sector ATPase
  misc_feature (437)..(437): n is a, c, t, g, unknown, or other
gagagagatcgcatacgcctgcstgcccacccacctccccttttccttcctcttcgccccagcgacgcgccgcccggagaccgagcgaggcaggcaactaaccaccgagaggcagggacaggaacaggaagccggaagatgtcgtcggtgttcagcggcgatgatgtacggcccccttcttcggcttcctcggcgccgcgccgccctcgtcttctcatgcatgggcgccgcgtacgggaccgcgaagagcgcgtcggcgtggcgtcgatgggtgtgatgcggccggagctcgtcatgaagtccatcgtgcccgtggtcatggctggtgtgctcbtatctacgggctcatcatcgccgtcatcattagcacggggatcaaccccaaggccaagccctactacctctttgatggctacgccacctttcgtccgggcttncctgtggtctcgctgggctt

SEQ ID NO: 415 - DNA, 492 bp, Zea mays
  misc_feature: Ceres CLONE 219474-F
  misc_feature: Translation starting site: 304
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaaggaagctctctctgtc

SEQ ID NO: 416 - DNA, 450 bp, Zea mays
  misc_feature: Ceres CLONE 219476-F
  misc_feature: Encodes the peptide sequence at SEQ ID NO. 417
aaaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggaraggatgtggttcatcctctgaaggtttctct

SEQ ID NO: 417 - protein, 129 aa, Zea mays
  misc_feature: Ceres CLONE 219476-F
  misc_feature (13)..(71): Pfam Name: DnaJ Pfam Description: DnaJ domain
  misc_feature (120)..(120): Xaa is any aa, unknown, or other
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGXDVVHPLKVS

SEQ ID NO: 418 - DNA, 297 bp, Zea mays
  misc_feature: Ceres CLONE 219536-F
  misc_feature (256)..(256): n is a, c, t, g, unknown, or other
agacgctgaggcctcgtccccgatcagacttgttcggcctcttcgacggcgtgcccgtctccccgggctcattcgccatgcattcctcagcctccgcgagaggaggacgagggctcctcttgcccggcggctgcggccggcggttgtggtgctactgttgggtgcagtcgcgccacggcgggttgctatccgcgcgtgttmaacttcggggactctctggcggacahgggcaactacccgttcgtctatggcaacnactcasccaagctccgggccaccctacggcgagaccttctt

SEQ ID NO: 419 - DNA, 780 bp, Zea mays
  misc_feature: Ceres CLONE 219554
  misc_feature: Encodes the peptide sequence at SEQ ID NO. 420
gcgtcgcgtccagatatctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttatcctctgcgaaggaaggaagaactgatctggaaatgtcggttggggagactgcatcatcaggttgtatgagacgcaatgcaaactactcaccttctctaataagcgctggacatgtgtactttgtgttgggctattcgcattctgttccaaacaagttgccaaaacaaaagaatgtgtgattcgctgtaattaacatattgtactgataatctgatatggcatacctatctgggtcagttaacaggtgggttttagcaaaaaaaaaaaaaaaa

SEQ ID NO: 420 - protein, 151 aa, Zea mays
  misc_feature: Ceres CLONE 219554
  misc_feature (56)..(148): Pfam Name: Rotamase Pfam Description: PPIC-type PPIASE domain
  misc_feature: SWISSPROT Homolog: EC 5.2.1.8 Peptidylprolyl isomerase
MGKDSKPKDAKGKGKQAAGSSGGDDGGGKGGKGKGKGKGGKSADGLGTCTYVKARHVLCEKQGKINEAYKKLQDGWLNNGDKVPPAEFAKVAQEYSECPSGKKGGDLGWFPRGKMAGPFQEVAFNTPEGTVSAPFKSTHGYHFILCEGRKN

SEQ ID NO: 421 - DNA, 421 bp, Zea mays
  misc_feature: Ceres CLONE 219563-F
  misc_feature: Encodes the peptide sequence at SEQ ID NO. 422
  misc_feature (339)..(339): n is a, c, t, g, unknown, or other
  misc_feature (369)..(369): n is a, c, t, g, unknown, or other
atctcacgccacgcctgctgcagcacctcgctctccgctccgttggccccatggagtccgtcgcgtccgccgcgatcgcsaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgaccaccagcctcgcgccgtacggactctccatctcgccactctccaaggacgcggccatggggctggtggtgagcgctgccacggggagcggctggacgacgggatcggggatngagggcccgccgacgsagtcaaagccggtngggcgggcaggccggagtgtcgacgctgccttggtccctcttcacgaaatca

SEQ ID NO: 422 - protein, 123 aa, Zea mays
  misc_feature: Ceres CLONE 219563-F
  misc_feature (97)..(97): Xaa is any aa, unknown, or other
  misc_feature (102)..(102): Xaa is any aa, unknown, or other
  misc_feature (107)..(107): Xaa is any aa, unknown, or other
MESVASAAIATTSRSLPLPFSSTPVHRRRRAAFLPVAASKRHDDDKEAAKGSGSEPRRDHQPRAVRTLHLATLQGRGHGAGGERCHGERLDDGIGDXGPADXVKAGXAGRPECRRCLGPSSRN

SEQ ID NO: 423 - DNA, 486 bp, Zea mays
  misc_feature: Ceres CLONE 219608-F
  misc_feature: Translation starting site: 179
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgagggcctttaacatagt

SEQ ID NO: 424 - DNA, 333 bp, Zea mays
  misc_feature: Ceres CLONE 219654-F
  misc_feature: Encodes the peptide sequence at SEQ ID NO. 425
  misc_feature (144)..(144): n is a, c, t, g, unknown, or other
acacaaccaagctcgatccatctcactctccgctggtcgctcactcttgcagctccacccttcactcagtcttagtctcttattagctctaggctctagctagccgcgccactccttcgtgtagccatcagycttctcatcgbnaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccga

SEQ ID NO: 425 - protein, 61 aa, Zea mays
  misc_feature: Ceres CLONE 219654-F
MATAEVQTPTVVAAEEAPVVETPPPAVVPEESAPAEAEAEAEAAAPADPEELPAAEQQAAA

SEQ ID NO: 426 - DNA, 175 bp, Zea mays
  misc_feature: Ceres CLONE 219678-F
gacacacgccgctgctccaagaaaccaccgccgagcccaacctgyacaagcgcgcgaggcaggagagagagagagagaggcggggagcaaaacaatgggaggggaaagaggaggacgtgcgcstgggcscaacaagttctcggagcgccacccatcgggacggcggcgcagggcg

SEQ ID NO: 427 - DNA, 2021 bp, Zea mays
  misc_feature: Ceres CLONE 219696
  misc_feature: Encodes the peptide sequence at SEQ ID NO. 428
gattccgctctcacccacctcctcttcctctcccctcccgggatcacgaggcgacgccacccgcgagattgacgggagccgatagatctgcgcggctacgctacgcagtcacactgcgctcacctgacctgactccgctctgttcatgccgcggaggtagagtccgcgggccggcggtggccacggccagcctcctcggccgtcgggatgaagccgcggaggttcggctacggctacggctacggctacggccgggtcaggcgcgcggcggcgctgctgctgctgctgctgctctgcctctgcctcagcagcctgttcctcctgcttctacatggctcctccacgccgctggagcccgcggcggcggcggcggcggcggaagcaagagttgccgaggcgcaggcggaggtcgaggaggcgccgctgccgccggggaactccaaggtcgccttcctcttcatcgcgcgcaaccgcctcccgctcgaactcgtctgggatgccttcttccgcggtgacaaggaggggaggttctccatcctcgtgcactcgcggccgggcttcgtgctcacacgagccaccactcgatcccgattcttctacaaccgtcaggtcaacgatagcatccaggtggattggggggaggcgagcatgatcacggctgagcgcattttgctcagccatgctctcaaggatccactcaatgaccgctttgtttttgtatctgacagctgtgtaccactatacaatttcagctatacttacgactacataatgtcgtcatcgaccagctttgtagacagttttgctgatacaaaggcagggagatacaacccaagaatggacccagttatcccagtggagaattggagaaaaggctcacagtgggctgtgctaattaaaaagcatgctgaggttgtggttgatgatgaagtggtgttaccagaattccagaagcattgcaggaggagacccttgccagagttctggcgggattgggatcgtcctattcctgcggaggcatggaaagcccataactgcataccagatgagcactatgttcagacgttgcttgcacaaagtggtctagaagaagaacttacgcggcgatcagtaacacatagtgcatgggatctttcagcttctaaagatcgtgaaagacgcgggtggcatcctgtaacatataaagtctctgatgctactccaagacttataaaatctataaaggatattgataatatatattacgagaccgaaaatagaagggagtggtgtacaagtaatggaaagccagccccctgcttcctttttgccaggaagtttacacgtggagctggtctgaagcttcttgattcatcactgatagcttcaaagtgatgaatattagtgacagatgcaagtgccttttgattgtttcacctttcgagaatatttcagttcacacaaatgtaaagtgtcttctggtggcacagctgctaatcgagtgtcttctggatagcgccggacctcgccgtcaaggggtgtcggcgccaagatctatgatgctgaccctctgggacttgccacatcgtctgacacataggaaaagttagcgctaatggtactggcgtcgctgtgctttacctcggtgccaatgacgatgacacacgtaggaaaagttggcgccaatgatactggtatcgttgtgcgttacctcggcgccaatgatgatgacgctgaggttagggtccatttttttaaaatgaaactgcaaatgacatagttgtgcaaaaaaacttcaaaagagtctaaaatgtaaaaaagttggtctggtggtaccggtttaattgactacgtacaattgaactcagggagtcagggtccaggagacatgttctgattgtaccattagtgcatgttcaagaggaactccaatatggttgtaaataaaacaaccttcaataacagctctatattataaaaaattatcaagcaattatagtattctcgggtcctagctctatcaaataaaaaaaaaaaaaaaa

SEQ ID NO: 428 - protein, 388 aa, Zea mays
  misc_feature: Ceres CLONE 219696
  misc_feature (49)..(380): Pfam Name: DUF266 Pfam Description: Arabidopsis protein of unknown function, DUF266
MKPRRFGYGYGYGYGRVRRAAALLLLLLLCLCLSSLFLLLLHGSSTPLEPAAAAAAAEARVAEAQAEVEEAPLPPGNSKVAFLFIARNRLPLELVWDAFFRGDKEGRFSILVHSRPGFVLTRATTRSRFFYNRQVNDSIQVDWGEASMITAERILLSHALKDPLNDRFVFVSDSCVPLYNFSYTYDYIMSSSTSFVDSFADTKAGRYNPRMDPVIPVENWRKGSQWAVLIKKHAEVVVDDEVVLPEFQKHCRRRPLPEFWRDWDRPIPAEAWKAHNCIPDEHYVQTLLAQSGLEEELTRRSVTHSAWDLSASKDRERRGWHPVTYKVSDATPRLIKSIKDIDNIYYETENRREWCTSNGKPAPCFLFARKFTRGAGLKLLDSSLIASK

SEQ ID NO: 429 - DNA, 464 bp, Zea mays
  misc_feature: Ceres CLONE 219723-F
  misc_feature: Encodes the peptide sequence at SEQ ID NO. 430
aattaaagaaaaacggtgagctagaaacttccaaatcgaacggcacacaaaaatcacaacccggaaagggaccagcagcgcaaaggtgagcgagctttccttcggaactctcgtgctcacctcatccgtccgacaaatccacacgaatcctctgattcagagcagggtgttggcattaatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctctgcgccgggagagtwaacggccatgctgccgatcctcccgtccag

SEQ ID NO: 430 - protein, 90 aa, Zea mays
  misc_feature: Ceres CLONE 219723-F
  misc_feature (10)..(80): Pfam Name: S1FA Pfam Description: DNA binding protein S1FA
  misc_feature (81)..(81): Xaa is any aa, unknown, or other
MADQFVDSANNVIIEEVNKGLNPGMVVLLVVASFLLLFFVGNYALYVYAQKTLPPKKKKPVSKKKLKREKLKQGVSAPGEXTAMLPILPS

SEQ ID NO: 431 - DNA, 205 bp, Zea mays
  misc_feature: Ceres CLONE 219967-F
agcagcagcacagtcatccacactaacgaacgaactgaggtbgacgacgactgatcgagcagcgacgatggcggctgtgctgaacagcaggaagacgccgcagtggttgccgtgctgttggcggcggcgctgctggcgtcgtccgcttcggcgcgatcacctgcgggcaggtagggtcgtcgctggctccgtgcatcccgtacgc

SEQ ID NO: 432 - DNA, 555 bp, Zea mays
  misc_feature: Ceres CLONE 220043-R
  misc_feature: Encodes the peptide sequence at SEQ ID NO. 433
gtgttcaaagtttagtagcctgctctttgagaaaactwcktggwaaagwtgatggaatcaatgcaggagtcgcaggctkttgcactggccttgmtctgagctttccaggtgcaccacaaactctgattcagagctgcctgacctttgggactttctcttacatcattgagaagctaawcaagcwgcaacctgggctggcgctcccacctgcgacaggtgtgatggatccgaaggctggacaaagcgttcttcstcccttcacacttcctcctctggatgccatggacgaattttgtaagttccaaaactttttgtcatccaaatttcggggaaactgagttatcctgctggagtgacgcctagttatctactctggaacgtgtccttgtaaatgcgtcaatggtcaaayctgagttyytttttccttgtttattcttcgccaatgtatgtttccaaattccaaggtagtgttttggtagtgttgatgattctaccttgacatatccaacacaaggcgagcagcttgtcctttgttcaagaaaaaaaaaaaaaaaa

SEQ ID NO: 433 - protein, 111 aa, Zea mays
  misc_feature: Ceres CLONE 220043-R
  misc_feature (13)..(13): Xaa is any aa, unknown, or other
  misc_feature (16)..(16): Xaa is any aa, unknown, or other
  misc_feature (26)..(26): Xaa is any aa, unknown, or other
  misc_feature (31)..(31): Xaa is any aa, unknown, or other
  misc_feature (59)..(59): Xaa is any aa, unknown, or other
  misc_feature (61)..(61): Xaa is any aa, unknown, or other
  misc_feature (84)..(84): Xaa is any aa, unknown, or other
VQSLVACSLRKLXGKXDGINAGVAGXCTGLXLSFPGAPQTLIQSCLTFGTFSYIIEKLXKXQPGLALPPATGVMDPKAGQSVLXPFTLPPLDAMDEFCKFQNFLSSKFRGN

SEQ ID NO: 434 - DNA, 502 bp, Zea mays
  misc_feature: Ceres CLONE 220050-F
  misc_feature: Encodes the peptide sequence at SEQ ID NO. 435
acggccgccgccagcatcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagagggacaggaagaaggtcaagaacatcaagcacagcggcaacatcagcctcgacgacgtcatcgagatcgccaagaccatgcggaacaggtccatggccaaggagttggccgggaccgtcaaggagatcctggggactgcgtcasgtcgggtgcac

SEQ ID NO: 435 - protein, 142 aa, Zea mays
  misc_feature: Ceres CLONE 220050-F
  misc_feature (12)..(71): Pfam Name: Ribosomal_L11_N Pfam Description: Ribosomal protein L11, N-terminal domain
  misc_feature (76)..(141): Pfam Name: Ribosomal_L11 Pfam Description: Ribosomal protein L11, RNA binding domain
  misc_feature (139)..(139): Xaa is any aa, unknown, or other
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIAKTMRNRSMAKELAGTVKEILGTASXRVH

SEQ ID NO: 436 - DNA, 532 bp, Zea mays
  misc_feature: Ceres CLONE 220052-R
  misc_feature: Encodes the peptide sequence at SEQ ID NO. 437
agctgagagcaacatgaacgatctggtgtctgagtaccagcagtaccaggatgccactgccgatgaggaggagtacgaggacgaggaggaggtccatgacgagtaaggtgatcttggaccctgctgcatattgtaccgtctctggacctggctttctttcaagctggagcttaggtttggttgttgtattcgaacatgctatgatgggtatgatgtattgatgtagtagtactttcgtgggtagcatgctgtatgctacbacttgccctctttcacctagctgcttgatttgctacttgtccgacctcttgtgtcgttggatctgcacggtccaagggatacacggccggctggacctcaatcccatcgctcttgcccagatcgagccacacttgccgcttaagatatttcctgcgatcgtagttctttctccaggatctagatgcagcttaagatatttccaaattcgtgcttgcgcgttcagtctacatgaaagaaaaatcatcaggtttgctcaaaaaaaaaaaaaaaa

SEQ ID NO: 437 - protein, 30 aa, Zea mays
  misc_feature: Ceres CLONE 220052-R
MNDLVSEYQQYQDATADEEEYEDEEEVHDE

SEQ ID NO: 438 - DNA, 409 bp, Zea mays
  misc_feature: Ceres CLONE 220070-R
atcggcgcccccgcctaagcccaagcccggygcccgcatcatgaccvatgtgcgtccaggagcagcacctgcccgagttccaggagcagatgatgasccagcaggccgcctaggcctagctagctcctgatcacccccatcaccatgttcatctatatcgtcatcgtcatcatgcatgcggcgtgcacgtttggaatattttytaatcaatcaataacgsygaggtgaggttgctattayatgaagtagtagtmacacctcmracarcaacaacccaayscaatgggaactcgcgtgtaatttgctccttcttcttcaaatataattccgcctcaattgtatgtatgtatgtattaagtctgtctgcctgtaaaaactaaagctttttgtttcaaaaaaaaaaaaaaaa

SEQ ID NO: 439 - DNA, 355 bp, Zea mays
  misc_feature: Ceres CLONE 220092-R
  misc_feature: Encodes the peptide sequence at SEQ ID NO. 440
tgctttataatctctatatcatcatcatcaggagcagaaggaacatgscaatgaggatgaggcatcaaagccacctccgccataacatcatggttgtgttctgccagtgatggcatcaagtagtacttatttcagttcatccacccaaagtagaacaagatggttttgggtagcactgtagagtgcagaccctgttdgcactgcagtaggagtgcttgagaaggatctccaattttgtctggtttatatttctaccaaatctcaatctgggtcctgccgaactacttgtaaactttggctggtgttgcctaaaatgatgtgtgatcctcgttactctccaaaaaaaaaaaaaaaa

SEQ ID NO: 440 - protein, 35 aa, Zea mays
  misc_feature: Ceres CLONE 220092-R
  misc_feature (16)..(16): Xaa is any aa, unknown, or other
LYNLYIIIIRSRRNMXMRMRHQSHLRHNIMVVFCQ

SEQ ID NO: 441 - DNA, 555 bp, Zea mays
  misc_feature: Ceres CLONE 220117-R
  misc_feature: Encodes the peptide sequence at SEQ ID NO. 442
gtggcagcgatgtaggagatgatccatgacgaggtgcacaagtacatgttagtggacgacacctgccaaagatacacaatttctactgtttttcagttggagaaaacatttaagacaatattttctcgtttgttctccatatggggcttgttccacgccacttgaaggaagaagggaatggtggtgttaagttcggacaatacatctacacatcttggagcatcggcatcaatgttttcaatcttctcaaatttcaaattattctggtctcttcgtgcaaccataaaagtttattaagtcacttatctgagtggtctaaaagtctagcatatttttgttcctctgcctgtcgagacggatcaactgacatgaataatatccagtgaatactgcaagagctattcatgatctgccgtgaactagctagtatgatataactcagtttgtggagtgctaatgcacaaacaggaaataggatgatacttcatgtatatttttttatttcatgaaaatgaactataggatactgttcacaatacaaaaaaaaaaaaaaaa

SEQ ID NO: 442 - protein, 48 aa, Zea mays
  misc_feature: Ceres CLONE 220117-R
MIHDEVHKYMLVDDTCQRYTISTVFQLEKTFKTIFSRLFSIWGLFHAT

SEQ ID NO: 443 - DNA, 432 bp, Zea mays
  misc_feature: Ceres CLONE 220161-R
bgcacccgtccccgccggchtcccccgccgygccggcgcagggcgtctcgtcttccgcttcctcccghaccgtcgaggccctgtgagtgtccgagaccaaagacgggcgaggcgcggggaaagtgagaagatgatgggatacttgtcgtgtcagtctgtcagaaggaaaggagggaagctattattccctcttgttgtgatccgcgcagttttctctcttccccctacccgtttcctcccttcgtgctggttgtggttctaaattcctgattgccggccgtcccgccctcttcctttgccaagacgagactcccctcctcctgccactgctaccgctgctcctctcaactggatgcctatgtaattaattgcctctctttaccattctacgtactgctagtattgaagtatcatcgaaaaaaaaaaaaaaaa

SEQ ID NO: 444 - DNA, 507 bp, Zea mays
  misc_feature: Ceres CLONE 220167-F
  misc_feature: Encodes the peptide sequence at SEQ ID NO. 445
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgar

SEQ ID NO: 445 - protein, 141 aa, Zea mays
  misc_feature: Ceres CLONE 220167-F
  misc_feature (10)..(141): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSE

SEQ ID NO: 446 - DNA, 632 bp, Zea mays
  misc_feature: Ceres CLONE 220187-R
  misc_feature: Encodes the peptide sequence at SEQ ID NO. 447
stgtcgcgctgctgctgttcgtcgttgtaatgtctgaagtagatggtggtgggtgctttctatgccgtgcctatttggctatttcggacgtgttggtgcctcaacttccggggccgtgtgacaattgcctcggtgaagaacttccagctgatcgccgcggctaccccgccacccgcaggtgcgccaaccccctcgcagcctgctccgtcagatcctgacaaggtgattctccagtttggcaaagtggcaagggatatgttcacgatggactatcgctaccctctctcggctttccaggcctttgccatttgtctgagtagctttgatacaaaattagcctttgaataaatggagaagaacaaaggtaaaggagaacagcaggttgcttgcattaggccatcagtgtacctctttccatctggctctcgtgttgccttggttgtatttgtgcttaatgtagccatgaagttggtggccatatatggacgcatgtgttgttgttggccctctcccttagaagtgattaaaagttgcatttggaccacatgttacccgatctgtaatatacttgcagtgcattgcatgccgcgtgataacaaagttcccgttcgtgactaaaaaaaaaaaaaaaa

SEQ ID NO: 447 - protein, 101 aa, Zea mays
  misc_feature: Ceres CLONE 220187-R
  misc_feature (1)..(95): Pfam Name: Tub Pfam Description: Tub family
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 462 in the 10/666,642 US patent application
  misc_feature: The sequence is a functional homolog of SEQ ID NO 458 in the 10/666,642 US patent application
MVVGAFYAVPIWLFRTCWCLNFRGRVTIASVKNFQLIAAATPPPAGAPTPSQPAPSDPDKVILQFGKVARDMFTMDYRYPLSAFQAFAICLSSFDTKLAFE

SEQ ID NO: 448 - DNA, 577 bp, Zea mays
  misc_feature: Ceres CLONE 220188-R
  misc_feature: Encodes the peptide sequence at SEQ ID NO. 449
ktcacgcagaatgtgtaagatttatgaggtccttcaacgtcccgctgttgctgcttggtggtggtgggtataccataagaaacgttgcacggtgttggtgctacgagacaggagttgcccttggtcatgagctcactgacaagatgccacctaatgagtactatgagtattttggtccagattacactctacatgtcgctccaagtaacatggagaataaaaacacacggcatcaattggatgacataaaatcaaaacttctagataatctttcaaaactccgacatgctcctagtgttcagtttcaagagcgacctcctgaggctgagttacctgagcaagatgaagacaaagagaatcctgatgaaagacatgatgctgattctgatgtggagatgaatgatgccaaacctttgcaggactctggaaggtatttgttattgttttctcatgtaatttgtagcagcaatcacttcaggtggctatattgtgtgttctattttgtgcaattttctaacataggagggggaatttaagaatgaagaaagaatctgctgaggcaaaaaaaaaaaaaaaa

SEQ ID NO: 449 - protein, 177 aa, Zea mays
  misc_feature: Ceres CLONE 220188-R
HAECVRFMRSFNVPLLLLGGGGYTIRNVARCWCYETGVALGHELTDKMPPNEYYEYFGPDYTLHVAPSNMENKNTRHQLDDIKSKLLDNLSKLRHAPSVQFQERPPEAELPEQDEDKENPDERHDADSDVEMNDAKPLQDSGRYLLLFSHVICSSNHFRWLYCVFYFVQFSNIGGGI

SEQ ID NO: 450 - DNA, 510 bp, Zea mays
  misc_feature: Ceres CLONE 220200-F
  misc_feature: Encodes the peptide sequence at SEQ ID NO. 451
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtccgcagtgttctctgctca

SEQ ID NO: 451 - protein, 149 aa, Zea mays
  misc_feature: Ceres CLONE 220200-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSAVFSA

SEQ ID NO: 452 - DNA, 454 bp, Zea mays
  misc_feature: Ceres CLONE 220214-R
  misc_feature: Encodes the peptide sequence at SEQ ID NO. 453
gtacccgccgccgcmacaggccgggtacgggtaccagccgccgcagaccgccgggtacgggtatcagcagcaggccaagaagaagaacaacttcgggatggggctcggcgccgggctgctgggaggcgccgtcgggggccttctggtcggggacatgatctcggattcgtcggcgtatgatgccggctacgacgccgggttcgacgacggcggtggcttcgatttctagagcagcgcagtggtgacgtgataccgcgcatctgagagacgagttctttcgtcttggatctgactttgtgacttctttcgctttatacgcgatctgattgttaggacgaaatcaaattatgcatcttatatctgatacactgcatgttattgatatgatactggaagcgtgacattatatgaatggcacacagttttcttttgttcaataaaaaaaaaaaaaaaa

SEQ ID NO: 453 - protein, 75 aa, Zea mays
  misc_feature: Ceres CLONE 220214-R
  misc_feature (5)..(5): Xaa is any aa, unknown, or other
YPPPXQAGYGYQPPQTAGYGYQQQAKKKNNFGMGLGAGLLGGAVGGLLVGDMISDSSAYDAGYDAGFDDGGGFDF

SEQ ID NO: 454 - DNA, 214 bp, Zea mays
  misc_feature: Ceres CLONE 220300-F
  misc_feature: Encodes the peptide sequence at SEQ ID NO. 455
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaakggcgcggcggggcgcaaggycggcgggcgancgaagaagtcggtgtcgcggtcctccagggccgggctgcagttccccgtcagccgcgtcgggcgtacctcaaaaa

SEQ ID NO: 455 - protein, 71 aa, Zea mays
  misc_feature: Ceres CLONE 220300-F
  misc_feature (30)..(30): Xaa is any aa, unknown, or other
  misc_feature (36)..(36): Xaa is any aa, unknown, or other
  misc_feature (43)..(43): Xaa is any aa, unknown, or other
  misc_feature (47)..(47): Xaa is any aa, unknown, or other
THTFRLSTPKVPFFFSIWKRRSSSHGRERXGGKAKXGAAGRKXGGRXKKSVSRSSRAGLQFPVSRVGRTSK

SEQ ID NO: 456 - DNA, 319 bp, Zea mays
  misc_feature: Ceres CLONE 220316-F
  misc_feature: Encodes the peptide sequence at SEQ ID NO. 457
  misc_feature (133)..(133): n is a, c, t, g, unknown, or other
atgcacaacacaacgcttatattacttacaacaaaagataaksccacgaatcagtagatcgaggtcccgcccagtccagcagaagcgcacacggagatgtcccagctgagccctgctgtgctctacatggctnsgacgctcctcctcatcctcctggcctccgcagcagcagcagcgtgtcagctgaccaacaggtctctgcctgccagaatgacatagacgcactgtggcgcagtgcaagcagttcgtccagaaggaggggcccaagatgcctccgtccgaggactgctgcaaaaccatcaaggccttagacgcgcac

SEQ ID NO: 457 - protein, 40 aa, Zea mays
  misc_feature: Ceres CLONE 220316-F
  misc_feature (13)..(13): Xaa is any aa, unknown, or other
MSQLSPAVLYMAXTLLLILLASAAAAACQLTNRSLPARMT

SEQ ID NO: 458 - DNA, 1289 bp, Zea mays
  misc_feature: Ceres CLONE 220477
  misc_feature: Encodes the peptide sequence at SEQ ID NO. 459
gtctcgggctctcggctcggctcggccacccaacgggcaagacgacgagggtttttgccgccgccatggcgatccctcgagcacgtctaactcgcctgctcctccacttcggcagccggggctccagattcctagcgcaacccttctctacctcttcctccgcacacggcctcttcccctctctgtggccgacgccgtccaccgccggcgcgtggcggcgcgcgttccacgatgggcggccgcgagggccgctgtggcggagcaagaagctgatcgggaaggaatccctatttgcgatccagggcctcaagcggttcaagggggacgaggagaagctagcggatttcgtgcggcggtatgtggccagactgctcaaggcggacaagctcgccgtgctcggcgagctggaacgccaggaggaggtcgatctggctgtcaagatgtttaggatcatacaaaaggaggactggtataaaccagatatttacatgtacaaagacttgattattgcactagccaaatgcaagaagatggaggaagcaatggtaatctgggggaacatgagagatgagaacttgtttcctgactcacagacttatgccgaagtaataagaggattcttgagatatggctccccatcagatgcaatgaatatttatgaggacatgaaaaagtcacctgatccaccagaagagttaccttttagggtattgttgaagggtcttttacctcacccactgctaagaaatagagtaaagcaagattttgaagagttcttcccagaaaggcatatctatgatcctccagaagaaatttttggcatgcactgaggtatactcagtggcatgaatgtgtttatcaattggatggttgcgttgcaaaaaaaaaataaatgggcgaaaactgagaagctgattattctgatttctgatagacagattagttgtccatatcattgtgctatcctttgttgttcagccaagctcattaatactgggccatctattcaactcaaccagtacaacttttcatggttgcaatgcctgatcttatgagtagtaacagaaaaaaatgtgttcttctttgggcccacttgtatgattaggttgttagaacaatgtactggcgtctggctacattcatgtcgttccttccctaactgcatgagagacctacttcgcatgaacattgtgatggtacctcatttcgtgaccctgttgagtttatgggtgatgattattgttaaaaaaaaaaaaaaaaaaaaaaaaaaaagaaaaaaaaaaaaaaaa

SEQ ID NO: 459 - protein, 254 aa, Zea mays
  misc_feature: Ceres CLONE 220477
  misc_feature (141)..(175): Pfam Name: PPR Pfam Description: PPR repeat
MAIPRARLTRLLLHFGSRGSRFLAQPFSTSSSAHGLFPSLWPTPSTAGAWRRAFHDGRPRGPLWRSKKLIGKESLFAIQGLKRFKGDEEKLADFVRRYVARLLKADKLAVLGELERQEEVDLAVKMFRIIQKEDWYKPDIYMYKDLIIALAKCKKMEEAMVIWGNMRDENLFPDSQTYAEVIRGFLRYGSPSDAMNIYEDMKKSPDPPEELPFRVLLKGLLPHPLLRNRVKQDFEEFFPERHIYDPPEEIFGMH

SEQ ID NO: 460 - DNA, 451 bp, Zea mays
  misc_feature: Ceres CLONE 220549-F
  misc_feature: Encodes the peptide sequence at SEQ ID NO. 461
gtgcctcatctagtcatctcgtcttaggtagcggccgaaccagagccccgtcccaactccaccacctctcttctctacggcgcgaswagggcggcgcggccgggcgtcggcgggaaccgggcctcgctctcctcatctctccgatcacttctgtcttgtgaaaatggcggatgaactatgctcaatgtctgtgggtcagaagttccatgggcagtccgtgctgttgagcagaatttcttcctattctgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatgggtggagtttctgctgctgtctccaagaca

SEQ ID NO: 461 - protein, 96 aa, Zea mays
  misc_feature: Ceres CLONE 220549-F
MADELCSMSVGQKFHGQSVLLSRISSYSAMNNPVFNNAYSAYNVPQRSYHGMNATAGLSSVMAPSPVFASAPKEKGFSGFMIDFMMGGVSAAVSKT

SEQ ID NO: 462 - DNA, 466 bp, Zea mays
  misc_feature: Ceres CLONE 220609-F
  misc_feature: Translation starting site: 95
ayaccctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaa

SEQ ID NO: 463 - DNA, 451 bp, Zea mays
  misc_feature: Ceres CLONE 220623-F
  misc_feature: Encodes the peptide sequence at SEQ ID NO. 464
  misc_feature (98)..(98): n is a, c, t, g, unknown, or other
  misc_feature (108)..(108): n is a, c, t, g, unknown, or other
  misc_feature (179)..(179): n is a, c, t, g, unknown, or other
  misc_feature (236)..(236): n is a, c, t, g, unknown, or other
  misc_feature (423)..(423): n is a, c, t, g, unknown, or other
ctcacacgatctctcctctacggctaacccggattgccgtctcaggctcgggatccgggcgctcgcggcgatggacggcggcggcggcgctggcggcnggaggggganctcacggcgcaggagacagsgctctacgaccgccagatccgmgtctggggcgtcgatgcccagaagagacnaagtaaggcgcacgtrcttgtwtgtggcatgaacggaaccaccatcgagttctgcanbaatattgttctagctggagttggaagtttatccttgatggatgataatgtagtcacagaggaggatctgaatgcaaatktcktaattsctcctgatgagagcatatatcgtggtagatctcgagcccaagtttgctgsgagtctttgatagatttcaatcctatggttagagtttctgttgaaamnggtgatccatcattaattgatggagaat

SEQ ID NO: 464 - protein, 81 aa, Zea mays
  misc_feature: Ceres CLONE 220623-F
  misc_feature (10)..(10): Xaa is any aa, unknown, or other
  misc_feature (37)..(37): Xaa is any aa, unknown, or other
  misc_feature (38)..(38): Xaa is any aa, unknown, or other
  misc_feature (40)..(40): Xaa is any aa, unknown, or other
  misc_feature (56)..(56): Xaa is any aa, unknown, or other
  misc_feature (72)..(72): Xaa is any aa, unknown, or other
MNGTTIEFCXNIVLAGVGSLSLMDDNVVTEEDLNANXXIXPDESIYRGRSRAQVCXESLIDFNPMVRVSVEXGDPSLIDGE

SEQ ID NO: 465 - DNA, 136 bp, Zea mays
  misc_feature: Ceres CLONE 220625-F
aattcgaacaaccgcgccgccgtcaccgactcaccgtcgtctctygctcactcgctcgcgctctccatccagatcggagcgctcggttcggataggggcgactaggaggtgaaggcgggcgcgtcaccaattgcgg

SEQ ID NO: 466 - DNA, 708 bp, Zea mays
  misc_feature: Ceres CLONE 220746-R
  misc_feature (401)..(401): n is a, c, t, g, unknown, or other
  misc_feature (415)..(415): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
cgaattgggtaccgggccccccctcgaggtcgacggtatcgataagcttttttttttttttttttaccgacgcaatagtatcatttttatgacggacaatattatacaaagctggatggtcctgcgagaatcatatcttcaagccgtcctagatatacaaacttgtatgcgtacaaataataaccactgtagcgcaatagtatttacatgctgccatcacatccagttatttggttgtgtaaactagacaggcaaatcatatatcagaggggggcgccaaggatgagttcatggaggcttggatctcctctagggttcttcctttggtttctggcactagctgctccacaaacacaactgtgagcccacagatgcttgcaaagatgaagaatgtgccgtangagttccacaccangaggaagttgaaggcgtacgagactatccacgagccaagccagctgacgagtgttacaaggcttcctgctgctcctttcatgtttatggggaaagatctctgacattattacccagggtattcctcccatacccagtgaaaatgatccacccgaaaatcagaatgcctgccaaagccagcactaagtcaggtctttccccatgatgtcctagctagatgacaatcactagagcacccagatgtcactgaatactcaatgtcatctacacacgnnnnnnnnnnnnnnnnnnnnn

SEQ ID NO: 467 - DNA, 393 bp, Zea mays
  misc_feature: Ceres CLONE 220764-F
  misc_feature: Encodes the peptide sequence at SEQ ID NO. 468
  misc_feature (198)..(198): n is a, c, t, g, unknown, or other
agtgtccgcatttcaaactgggctccataaagttctgtcgcctcgcctgtgkacctgtagggtagcagcaggtagcggagggggagagagagagaggggatggattctcaagcgccgcttcgtcctcctctagctttcgcctgcttcatcttcctttgctcatccttctgcgcasaaatgagatgtacgacagggttngtgcggcggcgtcagatggggagagcaggaggatgcggctgcacaccgacgggagccgcggcgacscacgcgtggccttgggtacctctacacccgagcagttgggagatgcacaccccaattctggagcagcggaccgagccctggcccaasatcgtcccacaggaagcggcggtggcgaargtgttcgggtct

SEQ ID NO: 468 - protein, 70 aa, Zea mays
  misc_feature: Ceres CLONE 220764-F
  misc_feature (6)..(6): Xaa is any aa, unknown, or other
  misc_feature (28)..(28): Xaa is any aa, unknown, or other
  misc_feature (57)..(57): Xaa is any aa, unknown, or other
  misc_feature (67)..(67): Xaa is any aa, unknown, or other
MYDRVXAAASDGESRRMRLHTDGSRGDXRVALGTSTPEQLGDAHPNSGAADRALAQXRPTGSGGGEXVRV

SEQ ID NO: 469 - DNA, 424 bp, Zea mays
  misc_feature: Ceres CLONE 220789-F
  misc_feature: Encodes the peptide sequence at SEQ ID NO. 470
  misc_feature (234)..(234): n is a, c, t, g, unknown, or other
  misc_feature (235)..(235): n is a, c, t, g, unknown, or other
  misc_feature (369)..(369): n is a, c, t, g, unknown, or other
gagagagagagaatcaaaatcactttgcgtgcagcatcgattgggtcggaaatcgagggtttggtaagcgagatcgccgccggtgacagctgacagggacgagatggacgccggcggaggcggcgtcttggtcgccgttctctgcatgctgctggtcttcgccatcttccccctcctcctctggcgccgcgctccgatgccgccaccgccgataaccaccgcgtcccgccccanncctccaggaggatcaggtgctgcacggtcgcgcggcggcsaggaatgcgtcggaggcctggggctgccggagcaggctcctctactgcgtcaactagcgcaatgctgtagaggacgacgcggagagtgacgatnaggaggtccccgaagtcgcaacgtccccagatcctccaaaaaggagaagaaaaag

SEQ ID NO: 470 - protein, 86 aa, Zea mays
  misc_feature: Ceres CLONE 220789-F
  misc_feature (44)..(44): Xaa is any aa, unknown, or other
  misc_feature (58)..(58): Xaa is any aa, unknown, or other
MDAGGGGVLVAVLCMLLVFAIFPLLLWRRAPMPPPPITTASRPXPPGGSGAARSRGGXECVGGLGLPEQAPLLRQLAQCCRGRRGE

SEQ ID NO: 471 - DNA, 476 bp, Zea mays
  misc_feature: Ceres CLONE 220801-F
  misc_feature: Encodes the peptide sequence at SEQ ID NO. 472
  misc_feature (73)..(73): n is a, c, t, g, unknown, or other
  misc_feature (74)..(74): n is a, c, t, g, unknown, or other
  misc_feature (94)..(94): n is a, c, t, g, unknown, or other
  misc_feature (95)..(95): n is a, c, t, g, unknown, or other
  misc_feature (199)..(199): n is a, c, t, g, unknown, or other
acaactcacatcgaggtctcagcttcaggaaagggaaggaagcatgttcgggcaccaccacggccacggcggnnaccaccaggccccgccgccnnacgagcagacgctgttcaggatcttctgccgcgccgacgaggcgtactgcctcaccgtgcgtcacgacgccgtsgtcctcgcgcccacsaayccccgcgacgwntaccagcactggtacaaggacatgaggcacagcacgaaggtgaaggacgcggagggccagccagcgttcgcgctcatcaacagggccaccggctcgccatcaagcactcgctcggccagtcccatcccgtgaagctggtgccctacaacgcggagtacctggacgagtcggtgctgtggacggagagccacgacgtggcaagggcttccgctgcatccgcatggtcaacaacatccacctcaacttcgacgccttccacggcgacaaggaccacggc

SEQ ID NO: 472 - protein, 95 aa, Zea mays
  misc_feature: Ceres CLONE 220801-F
  misc_feature (11)..(11): Xaa is any aa, unknown, or other
  misc_feature (18)..(18): Xaa is any aa, unknown, or other
  misc_feature (52)..(52): Xaa is any aa, unknown, or other
MFGHHHGHGGXHQAPPPXEQTLFRIFCRADEAYCLTVRHDAVVLAPTNPRDXYQHWYKDMRHSTKVKDAEGQPAFALINRATGSPSSTRSASPIP

SEQ ID NO: 473 - DNA, 960 bp, Zea mays
  misc_feature: Ceres CLONE 220884
  misc_feature: Encodes the peptide sequence at SEQ ID NO. 474
aaaaagcagcggcagtgggcagaggcgagagggcactcgactcctccagcgtccaacgccatccatccccgacctcgcaacgcaagcaaagaaagcccaggcaggcgtgtgcacggcgcggcggggcaaccaagggtgggtgaacccgcagagaggggcagctagcttccttccttcccaggcgcgcgggagaggttagccgccgtataagtagacagccagccagccatgtcgtcggtgtcgtcgtcgctgtccaacttcctgctctgctgcttctacccgtcatccgccggccaccaccgcggcggcgcctactactacagcagccacccgacgagcgccagcaccctgcactaccacgagggcaccttcgccgggcgcagggccatgggccggagcagcaggccgctgtcgctgcagacggtggagctgaaggtgcgcatgtgctgctcgggctgcgagcgcgtggtgaagcacgcggtgacgaggctgcgcggggtggactccgtggaggtggacgtggagatggagaaggtgacggtgacggggtacgtggaccgccaccgggtgctcaaggaggtccggcgcgccgggaagaaggcggagttctggcccaacccggacctgccgctgcacttcacctgcgccaaggactacttccacgacgaggagtcgtaccgccgcacctacaactactaccgccacggctacaacggcgacaagcacggacagctccacgagccccaccgcggcgccgaccccgtcagcaacatgttcaacgacgacgacgtcaacgcctgctccgtcatgtgatctcagtcgcgctctcgtcgtcgacaggcggtgtgtgtgtgtgtgtgcgtgcgctcgtcagctcgtgcgcgtgtaacagaaccaaatgcatggatggatgagtagtagcaatgcaatcgacaacgggcataaaaaaaaaaaaaaaaa

SEQ ID NO: 474 - protein, 194 aa, Zea mays
  misc_feature: Ceres CLONE 220884
  misc_feature (67)..(127): Pfam Name: HMA Pfam Description: Heavy-metal-associated domain
MSSVSSSLSNFLLCCFYPSSAGHHRGGAYYYSSHPTSASTLHYHEGTFAGRRAMGRSSRPLSLQTVELKVRMCCSGCERVVKHAVTRLRGVDSVEVDVEMEKVTVTGYVDRHRVLKEVRRAGKKAEFWPNPDLPLHFTCAKDYFHDEESYRRTYNYYRHGYNGDKHGQLHEPHRGADPVSNMFNDDDVNACSVM

SEQ ID NO: 475 - DNA, 474 bp, Zea mays
  misc_feature: Ceres CLONE 220959-F
  misc_feature: Encodes the peptide sequence at SEQ ID NO. 476
aaatgaaacggacgccgttcctcttctcccctcttccatagcatagcagagcaggcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggssgssctcggcacacgggtgtgatggttggaatgggccagaaggacgcctatgtaggtgacgaggcacagtcaaaaagaggtatcttgaccttgaagtaccccattgagcacggtatcgtgaac

SEQ ID NO: 476 - protein, 79 aa, Zea mays
  misc_feature: Ceres CLONE 220959-F
  misc_feature: SWISSPROT Homolog: EC 2.7.10.2 Non-specific protein-tyrosine kinase
  misc_feature (39)..(39): Xaa is any aa, unknown, or other
  misc_feature (40)..(40): Xaa is any aa, unknown, or other
MADGEDIQPLVCDNGTGMVKAGFAGDDAPRAVFPSIVGXXRHTGVMVGMGQKDAYVGDEAQSKRGILTLKYPIEHGIVN

SEQ ID NO: 477 - DNA, 181 bp, Zea mays
  misc_feature: Ceres CLONE 220974-F
  misc_feature: Encodes the peptide sequence at SEQ ID NO. 478
acttgtgacgaaaggaaacaatagtccgaccaataggctcggtcagcccaccccagaccccagacctttccccttccgtccccggccggcgccaacgccactccagtgagccgagggcgaagacggtcacggtgggcagagtgacacgccgcacgcctctccgcsscgctccgstccagaw

SEQ ID NO: 478 - protein, 35 aa, Zea mays
  misc_feature: Ceres CLONE 220974-F
LVTKGNNSPTNRLGQPTPDPRPFPFRPRPAPTPLQ

SEQ ID NO: 479 - DNA, 717 bp, Zea mays
  misc_feature: Ceres CLONE 220995-R
  misc_feature: Pfam Name: Galactosyl_T Pfam Description: Galactosyltransferase
ccaaattgggaccgggccccccctcgaggtcgacggtatcgatattttttttttttttttttgacacaccaataataataccatgcgcttttacgtggatcatagcatgccgtctcaagtgaaacaaccacgcttgccatgcagaatgtgtcatgccaaacagtggcgcaggcgcttccctctcgccttcgcgttttcatcaagtgaagctccgcatacaacaagtgttccgacgagaatggcaatctcgtctcaagtggcggcgttccagacggtgccttcgccttcaccgcacgccttgtggatgtggcgcatccggtccaccgacttacagacgccgctgcacgaccagtcgaaggacgccacgcacacgttcccggctcgcttcttccactcgcagtctggaggcgtcgcgcaacacatgctccggtcgacgacgtgctcgacctcgagcccgatcagccacgcccccagcgagacgtcctcgttcacgaacctgtgcaggatccgctagctgatggagatgtaagccgcgaagtccatggagatggcgtatatttagccggtggccgtgcgaacgtacttgttgccctcgtcgccgaacttcagtactctggctcgtggaacttgactcccttctgaagacagacatgccccggactcattgcaccgacgtaaccctcgggggcgtcctgagttttgtcagcctgctcggcg

SEQ ID NO: 480 - DNA, 447 bp, Zea mays
  misc_feature: Ceres CLONE 221010-F
  misc_feature: Encodes the peptide sequence at SEQ ID NO. 481
ctgcatcgaacaccaatggcattcttgcattgaaggaaccttccctccacctccaccgcccgagagcgagcggccggacggggttttcgttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagckgcggtggcggcgaccgcgggcgccgsccccgcgaccaaggcaagaagagcgacgtcgtcagtaaacccaccgtgtcgt

SEQ ID NO: 481 - protein, 117 aa, Zea mays
  misc_feature: Ceres CLONE 221010-F
  misc_feature (92)..(92): Xaa is any aa, unknown, or other
MAAPAMLQVVILAAVLLLPFLSVPGAEAQTKKFCLTQFAIASQACAILPPTSPEHHHHHHDDEDNDEDNDEDEDEDEDNDEDEDEDNDDDSXGGGDRGRRPRDQGKKSDVVSKPTVS

SEQ ID NO: 482 - DNA, 602 bp, Zea mays
  misc_feature: Ceres CLONE 221044
  misc_feature: Encodes the peptide sequence at SEQ ID NO. 483
aaaaatccacaagccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaaccsggccacggacaagtcgtgcaagcccgagggcgtgggggtggtgctgccgggcggcggcatcgacctcgacggcgacggtgacgaggacgagctgccgcagttccagccccacctcatgatcctcggtcatggccactgatgagtgtaaatggttggttggttggtcgtcctcgtctcagccgatctactggacgacacgatggcggtcacatttgcgtccgaatttctcttgttaaattgaggccagagtgattaaatgagcatatgatggtaatttattcaccgtgtattgcctgttcaaacatgaaagtgcactgatacaattttaaaaaacttatgcgcaaaaaaaaaaaaaaaa

SEQ ID NO: 483 - protein, 89 aa, Zea mays
  misc_feature: Ceres CLONE 221044
  misc_feature (44)..(44): Xaa is any aa, unknown, or other
MTTSPRVWLLAMALALACVLLVRSADAAAEASPTPGGSTYGCNXATDKSCKPEGVGVVLPGGGIDLDGDGDEDELPQFQPHLMILGHGH

SEQ ID NO: 484 - DNA, 267 bp, Zea mays
  misc_feature: Ceres CLONE 221185-F
ataattactcttccccgtgcgccctcgcgaggtcgaacccccaaggcgaggsgacgaaaccctcgccagtccccaactcgaacctcagtcaggcagcgtgaggagggagagttcaaggaccgaggcggcgtcgggcgagatgaagcttaacgtcaagaccctcaagggcacaacttcgagatcgaggcgagccccgatgcgtmrgttgctgacgtgaaagaggatcattkagaccactcagggtcagagtaccctaccgggcggacc

SEQ ID NO: 485 - DNA, 344 bp, Zea mays
  misc_feature: Ceres CLONE 221195-F
  misc_feature: Encodes the peptide sequence at SEQ ID NO. 486
attctcgtcatctcgtggctttgaaataccccgcgggcygsccccgcccaaatccaaccgccctaccaacgaccatctgctctgctctcgccgctcctacccttccaaatcccctcctcgcaacaaccaggcagccatcttccccatcagcaggcgatggagctcttccccgacggtggcttcgtgcggctgcagaaccgcgcgaatagaaggtacgtccacgccgacgrggactgggtgggggtctccttcgtccgaacgggcccgttcccatccctgaatgcggtctggcgggtggagcattgggtctccccgtttttgggccgaacgacggggacaccttc

SEQ ID NO: 486 - protein, 62 aa, Zea mays
  misc_feature: Ceres CLONE 221195-F
  misc_feature (25)..(25): Xaa is any aa, unknown, or other
MELFPDGGFVRLQNRANRRYVHADXDWVGVSFVRTGPFPSLNAVWRVEHWVSPFLGRTTGTP

SEQ ID NO: 487 - DNA, 276 bp, Zea mays
  misc_feature: Ceres CLONE 221211-F
  misc_feature: Translation starting site: 70
  misc_feature (134)..(134): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggccwakgycggcgggcgancgaagaagtcggtgtcgcggtcctccagggccgggctgcagttccccgtcagccgcgtcgggcggtacctcaaaaagggccggtacgcgcabgtawggcacgggtgccccgtctacctcgccgccgtcctggagtacctcgc

SEQ ID NO: 488 - DNA, 349 bp, Zea mays
  misc_feature: Ceres CLONE 221237-F
  misc_feature: Encodes the peptide sequence at SEQ ID NO. 489
  misc_feature (191)..(191): n is a, c, t, g, unknown, or other
atctcaagccaccatcgaccttcaagtctcgctacgtagcagtgcaataaaaaaagcagccgcaatggcgagcagcaccatggccctctcctccacggccttcgcsgcaagscgtgaacgtkccgtcgtcgtccgccttcgsaggcccgcgtgacgatgcgcaagacggcggcgaaggcaagccagcgsgncgtccgggagcccgtggtacggccccgaccgcgtgctgtacctgggcccactgtccggcgagccaccgagctacctgacgggcgagttcccgggcgactacggctgggkacaccgcggggctgtcggcggaccggagacgttcgccaagaccgggagc

SEQ ID NO: 489 - protein, 29 aa, Zea mays
  misc_feature: Ceres CLONE 221237-F
  misc_feature (16)..(16): Xaa is any aa, unknown, or other
  misc_feature (20)..(20): Xaa is any aa, unknown, or other
MASSTMALSSTAFAAXRERXVVVRLRRPA

SEQ ID NO: 490 - DNA, 184 bp, Zea mays
  misc_feature: Ceres CLONE 221361-F
  misc_feature: Encodes the peptide sequence at SEQ ID NO. 491
gcgagagccgagagsycagttgtttatataagawaaaaaaaaaggaagacctcaaattctgattttttgttcccttcaccgacggcgaggagtgagggttgacaacgggatggcgcggastattcgtacgtttcggcggcgamctggtatccatggcgcgaggcaatccccgcctcgccatcat

SEQ ID NO: 491 - protein, 33 aa, Zea mays
  misc_feature: Ceres CLONE 221361-F
  misc_feature (5)..(5): Xaa is any aa, unknown, or other
  misc_feature (6)..(6): Xaa is any aa, unknown, or other
  misc_feature (12)..(12): Xaa is any aa, unknown, or other
ARAEXXVVYIRXKKRKTSNSDFLFPSPTARSEG

SEQ ID NO: 492 - DNA, 413 bp, Zea mays
  misc_feature: Ceres CLONE 221398-F
  misc_feature: Translation starting site: 70
  misc_feature (135)..(135): n is a, c, t, g, unknown, or other
  misc_feature (239)..(239): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcabktaggcacgggtnccccgtctacctcgccgccgtcctggagtacctcgcggccgaggtgctcgagctcgccggcaacgcscaagggacaacaagaagacgcgcatcattccgcgccacgtgctcctcgcccatccgcaacgacgaggagctcggcaagctgctggccggcgtcaccatcgcccacgg

SEQ ID NO: 493 - DNA, 207 bp, Zea mays
  misc_feature: Ceres CLONE 221413-F
  misc_feature (93)..(93): n is a, c, t, g, unknown, or other
  misc_feature (135)..(135): n is a, c, t, g, unknown, or other
caatatccctccattctcctaccaaaaatcgcagcgccgcccgcaccaatctcgaagtgttcgaaagtttccagacccccaaaaggcgacggncgatgagttccaccggagcggcggccgcgggaaggcgavrgncgaccaagtcggtgtcgcggtcctccaaggctgggcttcagttcmccgtcggtcgcatcgcgcggtacctca

SEQ ID NO: 494 - DNA, 265 bp, Zea mays
  misc_feature: Ceres CLONE 221452-F
aatccaattcacaggctcaccacaccaaccaacaagcaaaaattccccaatcctctcgtctccgcggcgaagatgtcggggcgcggcaagggcggcaagggcctgggcaagggcggcgcgamtcaccggaaggtctgcgcgacaacatccaggggatcacgaagccggcgatccggaggctggcgcggcggggcggcgtgaagcsatctcggggctcatctacgaggagacccgcggcgtgctcaagatcttcctggagaacgtc

SEQ ID NO: 495 - DNA, 198 bp, Zea mays
  misc_feature: Ceres CLONE 221467-F
  misc_feature: Encodes the peptide sequence at SEQ ID NO. 496
  misc_feature (139)..(139): n is a, c, t, g, unknown, or other
actcatacatttcgactctcaactcccaaggtccctttttttttctcgatctggaagcgccgcagtagcagccatggacgtgarcggacaggcggtaaggcgaagaagggcgcggcggggcgcwaggccggcgggcgancgaagaagtcggtgtcgcggtcctccagggccgggctgcagttccccgtcagccgcgtc

SEQ ID NO: 496 - protein, 66 aa, Zea mays
  misc_feature: Ceres CLONE 221467-F
  misc_feature (42)..(42): Xaa is any aa, unknown, or other
  misc_feature (47)..(47): Xaa is any aa, unknown, or other
THTFRLSTPKVPFFFSIWKRRSSSHGRERTGGKAKKGAAGRXAGGRXKKSVSRSSRAGLQFPVSRV

SEQ ID NO: 497 - DNA, 310 bp, Zea mays
  misc_feature: Ceres CLONE 221478-F
  misc_feature: Encodes the peptide sequence at SEQ ID NO. 498
  misc_feature (81)..(81): n is a, c, t, g, unknown, or other
  misc_feature (82)..(82): n is a, c, t, g, unknown, or other
gagtttcctcctccactccctcccccccgcctccactaccccactcccaggagccgcccaggtacgtcgccggcggcattnnacgamrcttcaagaagaaccgcaagaagcgcggccacgtratccgccgggcacgscgcatcggcaagcaccggaagcatcccggagrtcgcggtaacscgrtggmatgcaccaccaccgcatcctcttcgacaagtaccatcccggctacttcggtaaggtcggcatgckctacttccacaagckccgcaacaagttctaytgcmccgcggtcaacatcgagcgcctc

SEQ ID NO: 498 - protein, 41 aa, Zea mays
  misc_feature: Ceres CLONE 221478-F
  misc_feature (22)..(22): Xaa is any aa, unknown, or other
  misc_feature (27)..(27): Xaa is any aa, unknown, or other
  misc_feature (34)..(34): Xaa is any aa, unknown, or other
MHHHRILFDKYHPGYFGKVGMXYFHKXRNKFYCXAVNIERL

SEQ ID NO: 499 - DNA, 411 bp, Zea mays
  misc_feature: Ceres CLONE 221500-F
  misc_feature: Encodes the peptide sequence at SEQ ID NO. 500
  misc_feature (217)..(217): n is a, c, t, g, unknown, or other
  misc_feature (314)..(314): n is a, c, t, g, unknown, or other
aggagagagaaagagggagctctagacggggaggctcccaaatcgatatttttcgcatctgttcgttctccgacgcggcggcgaatctgagaacccctcagcmtgagtggaggcggcgagtmcgtgatggtcggcggccggcgggcgcggacatgcacaaccgctccatcctcctccgccgcmgctgcgtcgtcgttgccgctctcccccgccgacndvttcctgcgcgtgaaggacggcgtggacggaatgatcaagtacgtcgccaacgagccctccgtcgkgctctacttcgtccagcagcacgcccgggnttccatgcccctcctcctcgacgtcaagggtaagctcgtagagaagactcgcgaggtgacattgcacactgaagacatggaggattctatttgcgct

SEQ ID NO: 500 - protein, 95 aa, Zea mays
  misc_feature: Ceres CLONE 221500-F
  misc_feature (31)..(31): Xaa is any aa, unknown, or other
  misc_feature (53)..(53): Xaa is any aa, unknown, or other
  misc_feature (63)..(63): Xaa is any aa, unknown, or other
MVGGRRARTCTTAPSSSAAAASSLPLSPADXFLRVKDGVDGMIKYVANEPSVXLYFVQQHARXSMPLLLDVKGKLVEKTREVTLHTEDMEDSICA

SEQ ID NO: 501 - DNA, 407 bp, Zea mays
  misc_feature: Ceres CLONE 221506-F
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcabgttaggcacgggtgcccccgtctacctcgccgccgtcctggagtacctcgcggccgaggtgctcgagctcgccggcaacgcscaagggacaacaagaagacgcgcatcattccgcgccacgtgctcctcgccatccgcaacgacgaggagctcggcaagctgctggccggcgtcacc

SEQ ID NO: 502 - DNA, 422 bp, Zea mays
  misc_feature: Ceres CLONE 221511-F
  misc_feature: Encodes the peptide sequence at SEQ ID NO. 503
  misc_feature (139)..(139): n is a, c, t, g, unknown, or other
  misc_feature (388)..(388): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcabgtaggcacgggtgcccccgtctacctcgccgccgtcctggagtacctcgcggccgaggtgctcgagctcgccggcaacgcscaagggacaacaagaagacgcgcatcattccgcgccacgtgctcctcgccatccgcaacgacgaggagctcggcaanctgctggccggcgtcaccatcgcccacgggggcg

SEQ ID NO: 503 - protein, 116 aa, Zea mays
  misc_feature: Ceres CLONE 221511-F
  misc_feature (6)..(6): Xaa is any aa, unknown, or other
  misc_feature (22)..(22): Xaa is any aa, unknown, or other
  misc_feature (53)..(53): Xaa is any aa, unknown, or other
  misc_feature (80)..(80): Xaa is any aa, unknown, or other
  misc_feature (105)..(105): Xaa is any aa, unknown, or other
MDVSGXAVRRRRARRGARPAGXRRSRCRGPPGPGCSSPSAASGVPQKGPVRAXRHGCPRLPRRRPGVPRGRGARARRQRXRDNKKTRIIPRHVLLAIRNDEELGXLLAGVTIAHGG

SEQ ID NO: 504 - DNA, 347 bp, Zea mays
  misc_feature: Ceres CLONE 221608-R
  misc_feature (112)..(112): n is a, c, t, g, unknown, or other
  misc_feature (119)..(119): n is a, c, t, g, unknown, or other
ytgcggggcgacgtggtgccgtgctccaaggaccggggtgccctactacaaactgccggatctcgaccwaccgccaacccctacaacccggggctgcgagagcwatcwaccnaggtgcnagggacgcggatccctaggctcttgctttgcttgctccgtcgccttgcaaaagggaagtgggtgtggggctgctgctcctcgctccttcgacgctgcagggcggtgttgctgcaaatgcttactaaatgaagtgtattttattctgtgttcttttttttcccttcctcttttttttcttggtcgtccttcctcctttgccgggatatttagtaagtstagtaatgaag

SEQ ID NO: 505 - DNA, 936 bp, Zea mays
  misc_feature: Ceres CLONE 221616
  misc_feature: Encodes the peptide sequence at SEQ ID NO. 506
gagaggattgcgccgcctgattggcgattgctgatagtctgccgccagtgccctcgcccgatttgctccgccgagaacaacatggggagaagctataatcacagtccatcgccaccaagaggctacaggagaagaactcgcagcccaagtcctcgtggtcggtatggaggccgtgatactgatagggacctcccaactagtcttttggtgaggaatcttcgtcgggattgtaggcctgatgaccttcgtagaccatttggaaaatttggccccgttaaagacatatatctgccaaaggattactacactcgggaacctagaggatttgggttcatccaatactttgatcctgaggatgcttctgatgcaaagtactatatggatgggaagatgctgcttggaagggaaattgctgttgtttttgcagaggaaaacaggaagaagccttctgacatgagggccagggaaaaaataagtggcagaggccgttcttatgatgggaggttgcgctcaaggtcacctgggttgaacggttctcctaggggtagatcacggtcccaaagccgaagctactcgccagcacctaagcgaaagcactattcaaggtccccggctcctcgacctcgggagagatctttgtcgcgttccccagctgtcaacagatcaaggagtgcaagccccattgttagcaggtctcctcataggcaggggtctctttctgttagcgagtgaggtatctcagggctctgtatgactatcttgtcgctgttatgctgaaccatatatgtttcagattatttttgttagcaccctcgtgtgtactctaggatatctgaacgtctactatgtattgggtatttccaaaatctctgatgagtgaagtgagttgtgaaccaaaaaaaaaaaaaaaaaaaaaacaaaaaaaaaaaaaaaaaa

SEQ ID NO: 506 - protein, 216 aa, Zea mays
  misc_feature: Ceres CLONE 221616
  misc_feature (41)..(112): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGRSYNHSPSPPRGYRRRTRSPSPRGRYGGRDTDRDLPTSLLVRNLRRDCRPDDLRRPFGKFGPVKDIYLPKDYYTREPRGFGFIQYFDPEDASDAKYYMDGKMLLGREIAVVFAEENRKKPSDMRAREKISGRGRSYDGRLRSRSPGLNGSPRGRSRSQSRSYSPAPKRKHYSRSPAPRPRERSLSRSPAVNRSRSASPIVSRSPHRQGSLSVSE

SEQ ID NO: 507 - DNA, 643 bp, Zea mays
  misc_feature: Ceres CLONE 221637-R
  misc_feature: Encodes the peptide sequence at SEQ ID NO. 508
gagtgcttctgctagactgggtgcctatgatgattccgtcgagtattttgtatgcttgaatgggcatgttattggacttggtaccctgctaccactctcagactcggaggaggcagcagwtgmgtaatcatcaagaatgagtcaggccatwacaaattaacwacatccggtgacaagtgcgccagtttaaggaaggtwgcagagtctctgtctcaaataaaagggtgccagggctatgatctagtttggaagattgaagcccaggacttgcgaaaatggtactgaatcttggttgtgactagcagagagtgggatgacattggttcagcaaactgttgcacgacaagaatctgtggtgggctctgcgtcggactgcccctgtgttcttgcacctgatgacaaaaaaaggaagagctattttatagtctctcctttatgtattgatctgtcacactgcatggaagttggattcacactgcatggaagttggattcagtttgcacacaaagataaaaatgtaaaactctgattgtcagaacttacttgatctgtcaattttaccaacttctctgctagtgaatcccgaatagatttcaacgaaaaaaaaaaaaaaaaacaaaaaaaaagaaaaaaaaaaaaaaaa

SEQ ID NO: 508 - protein, 39 aa, Zea mays
  misc_feature: Ceres CLONE 221637-R
SASARLGAYDDSVEYFVCLNGHVIGLGTLLPLSDSEEAA

SEQ ID NO: 509 - DNA, 492 bp, Zea mays
  misc_feature: Ceres CLONE 221692-F
  misc_feature: Encodes the peptide sequence at SEQ ID NO. 510
  misc_feature (167)..(167): n is a, c, t, g, unknown, or other
attcgtcttgctccagccgccgtcggatcggatccgatccaaagcaagcagcagcagccggctccgctcccgcagcagccacaccccgtccgtcaccagaggaagaggaagaggaggatgtcggggtcgaaggtgtacacccttgaggaggtggccaagcacaacancaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtccccctggcaatactgggcctggctgttgct

SEQ ID NO: 510 - protein, 125 aa, Zea mays
  misc_feature: Ceres CLONE 221692-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (17)..(17): Xaa is any aa, unknown, or other
MSGSKVYTLEEVAKHNXKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPLAILGLAVA

SEQ ID NO: 511 - DNA, 433 bp, Zea mays
  misc_feature: Ceres CLONE 221743-F
  misc_feature: Translation starting site: 70
  misc_feature: Pfam Name: Chloroa_b-bind Pfam Description: Chlorophyll A-B binding protein
  misc_feature (202)..(202): n is a, c, t, g, unknown, or other
  misc_feature (388)..(388): n is a, c, t, g, unknown, or other
acagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcagggcccgcgtgacgatgcgcaagayggcggggaaggccaagccggcggcgncgtccgggagcccgtggtacggccccgaccgcgtgctgtacctgggcccactgtccggcgagccgcgagctacctgacgggcgagttcccgggcgactacggctgggacaccgcggggctgtcggcggacccggagacgttcgccaagaaccgggagctggaggtgatccactcccgctggccatnctgggcgcgctcggctgcgtcttcccggagctgctcgcccgcaac

SEQ ID NO: 512 - DNA, 376 bp, Zea mays
  misc_feature: Ceres CLONE 221765-F
  misc_feature: Translation starting site: 66
  misc_feature: Pfam Name: Ribosomal_L21e Pfam Description: Ribosomal protein L21e
  misc_feature (115)..(115): n is a, c, t, g, unknown, or other
  misc_feature (190)..(190): n is a, c, t, g, unknown, or other
  misc_feature (245)..(245): n is a, c, t, g, unknown, or other
awaccctagtgcttcccaccgatccatttcagccgccgccgcgcgtasaagcaggagcagcaaggatgccggctggccacgggctgcgctcgcggacgcgcgacctgttcgcgsncccttccgcaagawgggctacatcccgctcaccacctacctccgcaccymcaagatcggcgactacrtcgacgtncaaggtgaacggcgccgtccacaaggggatgccgcacaagttctaccacggccgnaccggtcgcgtctggaacgtcaccaagcgcgccatcggstcgagattaaacaagcaggtgaatggtcgcatcatcaggaagcgtatccatgtccgcgtggagcatgtgcagccggtcccgctgcacagaag

SEQ ID NO: 513 - DNA, 330 bp, Zea mays
  misc_feature: Ceres CLONE 221770-F
  misc_feature: Encodes the peptide sequence at SEQ ID NO. 514
  misc_feature (183)..(183): n is a, c, t, g, unknown, or other
gagtttcctcctccactccctcccccccgcctccactaccccactcccaggcgccgcacaggtacgtcgccggcggattgacgacgcgcttcaagaagaacctcaagaagcgcggccacgtgtccgccgggcacggccgcatcggcaagcacaggaagcatcccggagtcgcggtaacgccgntggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccga

SEQ ID NO: 514 - protein, 47 aa, Zea mays
  misc_feature: Ceres CLONE 221770-F
MHHHRILFDKYHPGYFGKVGMRYFHKLRNKFYCPAVNIERLWSMVPA

SEQ ID NO: 515 - DNA, 427 bp, Zea mays
  misc_feature: Ceres CLONE 221778-F
  misc_feature: Encodes the peptide sequence at SEQ ID NO. 516
  misc_feature (183)..(183): n is a, c, t, g, unknown, or other
  misc_feature (212)..(212): n is a, c, t, g, unknown, or other
acagaacgatctcaatctccctagcaatctctagcagcagatcctcgtgcgavraagcgctasccccttcgtactgtcccgatggcccgcacgaagcagacggcgaggaagtccactggmggcaaggcgccaaggaagcagctggccaccaaggcggcgcgcaagatcttgccccggcgaccngcggagtgaagaagccccaccgtttccgncccggcaccgtcgckmttccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctgcgccattcacgcc

SEQ ID NO: 516 - protein, 36 aa, Zea mays
  misc_feature: Ceres CLONE 221778-F
MARTKQTARKSTGGKAPRKQLATKAARKILPRRPAE

SEQ ID NO: 517 - DNA, 276 bp, Zea mays
  misc_feature: Ceres CLONE 221847-F
  misc_feature: Encodes the peptide sequence at SEQ ID NO. 518
  misc_feature (274)..(274): n is a, c, t, g, unknown, or other
gaaacgaggccaccagctcaccgccgagcgaagscgccgagcaaccaacccctctcctcgtccgccgccgtctccccggaccatggccatggccgccgcctcctcccggctgctctagggcgtcccgcgccgccgcctacctcaggatctccaccttccccagggccttctccaccgwgctgaaggatctgaagtatgctgacactcatgaatgggtgaaagttgagggtgattcagcaaccgtmgggattactgaccatgccaggaccatttngg

SEQ ID NO: 518 - protein, 90 aa, Zea mays
  misc_feature: Ceres CLONE 221847-F
  misc_feature (11)..(11): Xaa is any aa, unknown, or other
  misc_feature (59)..(59): Xaa is any aa, unknown, or other
NEATSSPPSEXAEQPTPLLVRRRLPGPWPWPPPPPGCSRASRAAAYLRISTFPRAFSTXLKDLKYADTHEWVKVEGDSATVGITDHARTI

SEQ ID NO: 519 - DNA, 304 bp, Zea mays
  misc_feature: Ceres CLONE 221869-F
  misc_feature: Translation starting site: 48
  misc_feature: Pfam Name: PLAT Pfam Description: PLAT/LH2 domain
  misc_feature (103)..(103): n is a, c, t, g, unknown, or other
gaaggccgagctcatccaatccagtcgcctgattgcattgggatcccatggccaagctcgccgtcctcctcctcctcgccgtggccgcgtccgccacagtgcnkgcgcacggccgcgataccccgactgagatcaagctcatcaaaggcacggacgcctccggatgggcgacgacmgmatvgagtgcgtgtacacggtgttcatccggacggggtcgatcttgaaggccgggacgacgcgaacgtcacgctggagctggccgccgcggacggcaacggcgtggggatctcgaccctgcccgcct

SEQ ID NO: 520 - DNA, 134 bp, Zea mays
  misc_feature: Ceres CLONE 221918-F
atcacaattcacagcgctcaagttctcgcgcccacagccaaatttttctccactcaatcggcataagctgcactgcagcaatggacgccagcggascggtagcaaggcgaagaagggggcggctggkcgcaagg

SEQ ID NO: 521 - DNA, 469 bp, Zea mays
  misc_feature: Ceres CLONE 221939-F
  misc_feature: Translation starting site: 131
  misc_feature: SWISSPROT Homolog: EC 1.3.1.38 Trans-2-enoyl-CoA reductase (NADPH)
  misc_feature (116)..(116): n is a, c, t, g, unknown, or other
gccgcccccgtctcctctcctctcctctcctccgcatccacggccgcmrtcagccagccactcgacgatctagtcgtctctctctccccgctctrccgcctcgctgccgcrgcttnccgtcggctggaggatgaaggtcacggtcgtgtcccggagcggmcgggaggtcgtcaaaggcggcatcgacctcaaggactcggccaaggtcgcggacctgcaggaggccatccatgccaggactaagaagtattatccttctaggcagcggctcaccctcccccttcaacctggaaaakgcgggaagcagttgtcctcagtccaaaggccagcctgctagaatactgcgagaagggttctgggtcactgacagtgggtcttcaaaagatttagggccacaggtctactacagcacactgttcttcttcgagtacctgggtcctctcatcatctaccccatgttctactatct

SEQ ID NO: 522 - DNA, 471 bp, Zea mays
  misc_feature: Ceres CLONE 221946-F
  misc_feature: Pfam Name: Ribosomal_S24e Pfam Description: Ribosomal protein S24e
  misc_feature (109)..(109): n is a, c, t, g, unknown, or other
  misc_feature (110)..(110): n is a, c, t, g, unknown, or other
thtttttccgcgccgcctcccctcccgccctcttgctccgccggcgcgccaccgccaccgccaccgcaacagctagtcagcagatcgtaaccatggcggattcgaaggnngctgmggcggtgacstccgcacacgcaagttcatgaccaaccgtcttmatctcccgcaagcagwtcgtgctcgaggtcataccaccccggccgccccaacgtctccaaggcggastcaaggagaggctggcgaagatctacgaggtgaaggacccaaactgcatcttcgtgttcaagttccgaaccaacttcggaggcggcaagtccaccggcttcggtctcatctacgacaaccttgaggcccgccaagaagttcgagcccaagtaccgcctcatcaggaacggccttgctaccaaggtagagaagtcacgaaagcagatgaaggaacgtaagaacagggcgaagaaaatcgtggtgtga

SEQ ID NO: 523 - DNA, 227 bp, Zea mays
  misc_feature: Ceres CLONE 221994-F
  misc_feature: Pfam Name: Cupin_1 Pfam Description: Cupin
  misc_feature (67)..(67): n is a, c, t, g, unknown, or other
  misc_feature (70)..(70): n is a, c, t, g, unknown, or other
ccatagccgatgtgcatgtgatgtgcatggatctaagcccaaagaaacccaacaaggccagcgccankcnggcggactactacgactggtcccccgccgatctgcccatgctcggcgttgctccattggtgccgccaagctctgcctcaccgccggagtcttgccctacccagctactccgactctgccaagatcgcctacgtcctccaaggcaaaggtatcttcgg

SEQ ID NO: 524 - DNA, 240 bp, Zea mays
  misc_feature: Ceres CLONE 222034-F
  misc_feature: Encodes the peptide sequence at SEQ ID NO. 525
  misc_feature (167)..(167): n is a, c, t, g, unknown, or other
aagacctcctattcaccatgccgaccgaagagggttccgacggcggtggcggcgcggagccgggagccgggggagaagaagagctcgcaggcgcccgcaaagcctggagcgtgcggcscgcaaagttcctcgcggggttgccgtcgcgcggcamtttctcttccggntccgcccctccaatctgggagggttcagggtttacgtctgcgagcacagcacaggtcccccagaaggacaagt

SEQ ID NO: 525 - protein, 74 aa, Zea mays
  misc_feature: Ceres CLONE 222034-F
  misc_feature (34)..(34): Xaa is any aa, unknown, or other
  misc_feature (46)..(46): Xaa is any aa, unknown, or other
MPTEEGSDGGGGAEPGAGGEEELAGARKAWSVRXAKFLAGLPSRGXFSSGSAPPIWEGSGFTSASTAQVPQKDK

SEQ ID NO: 526 - DNA, 487 bp, Zea mays
  misc_feature: Ceres CLONE 222082-F
  misc_feature: Encodes the peptide sequence at SEQ ID NO. 527
  misc_feature (460)..(460): n is a, c, t, g, unknown, or other
actcttccatagcatagcagagcaggcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactgggatgatatngagaaaatctggcaccacaccttctac

SEQ ID NO: 527 - protein, 93 aa, Zea mays
  misc_feature: Ceres CLONE 222082-F
  misc_feature: SWISSPROT Homolog: EC 2.7.10.2 Non-specific protein-tyrosine kinase
  misc_feature (84)..(84): Xaa is any aa, unknown, or other
MADGEDIQPLVCDNGTGMVKAGFAGDDAPRAVFPSIVGRPRHTGVMVGMGQKDAYVGDEAQSKRGILTLKYPIEHGIVNNWDDXEKIWHHTFY

SEQ ID NO: 528 - DNA, 417 bp, Zea mays
  misc_feature: Ceres CLONE 222154-F
  misc_feature: Encodes the peptide sequence at SEQ ID NO. 529
  misc_feature (383)..(383): n is a, c, t, g, unknown, or other
atccagcaatacccgagtacccaacgcgctactagttctattgccgcaccccagatctccaggagggactcgttcttttcagctaactacactgcacgcaatggccaccacggcgaccgaggcggcgcgcckyaggakcagcaggccaackswacggcgagcagaagacgcggcactccgaggtcggccacaagagcctgctcaagagcgacgacctctaccagtacatcctgggcacgagcgtgtacccgcgggagccggagagcatgaaggagctccgcrtggtcaccgccaagcacccatggaacctgatgacgacctccgccgacgaggggcagttcctgaacatgctcatcaagctcatcggcgccaagaagaccatngagatcggcgtgtacaccggctactccctcctcg

SEQ ID NO: 529 - protein, 50 aa, Zea mays
  misc_feature: Ceres CLONE 222154-F
  misc_feature: SWISSPROT Homolog: EC 2.1.1.104 Caffeoyl-CoA O-methyltransferase
  misc_feature (6)..(6): Xaa is any aa, unknown, or other
  misc_feature (39)..(39): Xaa is any aa, unknown, or other
MKELRXVTAKHPWNLMTTSADEGQFLNMLIKLIGAKKTXEIGVYTGYSLL

SEQ ID NO: 530 - DNA, 477 bp, Zea mays
  misc_feature: Ceres CLONE 222201-F
  misc_feature: Translation starting site: 248
  misc_feature: Pfam Name: Ribosomal_60s Pfam Description: 60s Acidic ribosomal protein
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgggtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtggtggttt

SEQ ID NO: 531 - DNA, 462 bp, Zea mays
  misc_feature: Ceres CLONE 222207-F
  misc_feature: Encodes the peptide sequence at SEQ ID NO. 532
  misc_feature (279)..(279): n is a, c, t, g, unknown, or other
ayttccccgtgaccccgtttcctccagtttcctaccttcctctcgtcccagcagccgcaagcyaaaaccctagcaagcaaaccaccggagcagcggcgctcgcgcgggcggasatgcgacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgantaaaacaacaaaatatatgacgaakatgaacgtgcgcgcattcttggtacacgagccttgcagataagcatgaatgctccagtcatggttgagcttgaggggagaaactgaccctcttgagattgcggatgaaggagcttagagcgcgcaagatacccttcacgatcagacggtacctacctg

SEQ ID NO: 532 - protein, 45 aa, Zea mays
  misc_feature: Ceres CLONE 222207-F
MGYEDEPPEPEIEEGAEEELENNEDAPDDVIGGEGEDKEQEKTKR

SEQ ID NO: 533 - DNA, 91 bp, Zea mays
  misc_feature: Ceres CLONE 222317-F
aatcaccaatcagtcagtcacagctcacagcaaacaccgcgamcgcccccgctcccaaacccgaccgakcaaagcgtaaagccccccaacc

SEQ ID NO: 534 - DNA, 130 bp, Zea mays
  misc_feature: Ceres CLONE 222323-F
  misc_feature (74)..(74): n is a, c, t, g, unknown, or other
atcaagccattcgtccctgtggaagtttccacactcccttcccttcccttgtacccactccaatggcgccctbntcctggccgccgtctccgcctcgcccttcctcctacccggcagcagcggcatcagc

SEQ ID NO: 535 - DNA, 179 bp, Zea mays
  misc_feature: Ceres CLONE 222415-F
  misc_feature: Encodes the peptide sequence at SEQ ID NO. 536
  misc_feature (22)..(22): n is a, c, t, g, unknown, or other
  misc_feature (32)..(32): n is a, c, t, g, unknown, or other
gagcccaaactgcggtacgaanaacgcgagcnctgcggaaacaacgatggcgacgatgtctcttgccgcggcgtcacccctcgcctccattccccgcggcatcgcgttccaggctccttgcgcggcattcctgtccatccgcttaggtggcgcgacggcgacgcggttcgctggactgg

SEQ ID NO: 536 - protein, 44 aa, Zea mays
  misc_feature: Ceres CLONE 222415-F
MATMSLAAASPLASIPRGIAFQAPCAAFLSIRLGGATATRFAGL

SEQ ID NO: 537 - DNA, 239 bp, Zea mays
  misc_feature: Ceres CLONE 222424-F
  misc_feature: Encodes the peptide sequence at SEQ ID NO. 538
  misc_feature (108)..(108): n is a, c, t, g, unknown, or other
acaacaccagaatccgcgaatcacagacgcgtctatctcagcttgctgcactgcactaccctgccctgccatcatatcgtacgtgagcccggccgagcgagasmgggnatgaggcatggctgctccgaagctcgcgacgctggcgctggccgtgctcctggcggcgaccgtggtggctcccccggccgcggtgcgcgcsgaattktcgtgctccaccgtgtacagcacgctgatgccgt

SEQ ID NO: 538 - protein, 41 aa, Zea mays
  misc_feature: Ceres CLONE 222424-F
  misc_feature (30)..(30): Xaa is any aa, unknown, or other
MAAPKLATLALAVLLAATVVAPPAAVRAEXSCSTVYSTLMP

SEQ ID NO: 539 - DNA, 793 bp, Zea mays
  misc_feature: Ceres CLONE 222473
  misc_feature: Encodes the peptide sequence at SEQ ID NO. 540
ctcggtttccccctcccctaacactgtagccgctccttcaacggcgtcctcctcctcctcctctcccttcctgattctttctctctcccgctaaatcgatgggcacgctacgccgtattccttccccgcagccccgcagccgcttcttcgcccgcgcgctcggaatactccgcaccaatcctagctgcgggcaggggttccagccgcttcttcgcccacacgcccgctcgctcggaatactccgcaccaatccgtgtcggaccggtacgtgtgcgagatctgcgggcaggggttccagcgcgaccagaacctgcagatgcaccggcggcggcacaaggtgccgtggaagctgctgaagcgggaggccggggaggcggcgcggaagcgcktgttcctgtgcccggagccgagctgcctgcaccacgacccctcgcacgcgctgggcgacctcgtcggcatcaagaagcacttccgccgcaagcacagcggccaccgccagtgggcctgcgtcttctcccgcattgtgtggggatcaattgcttggcttatctagatggttccatatttagtacaagtgatcatcttttttgcgggagccgtgatggtaccttgaaaagatgggaattaaataatggggatgcaagcttctcaggaacttttgagtctcatgttgattgggtatgcttttttctgtttttaattaagtaggcttactgtttcatcaatcagtgctttaaatagacattatgtttataaattagttatgtttatgtttataaaaaaaaaaaaaaaa

SEQ ID NO: 540 - protein, 78 aa, Zea mays
  misc_feature: Ceres CLONE 222473
  misc_feature: The sequence is a functional homolog of SEQ ID NO 960 in the 11/435,388 US patent application
  misc_feature: The sequence is a functional homolog of SEQ ID NO 584 in the 10/666,642 US patent application
  misc_feature: The sequence is a functional homolog of SEQ ID NO 902 in the 11/435,388 US patent application
  misc_feature: The sequence is a functional homolog of SEQ ID NO 1785 in the 10/374,780 US patent application
  misc_feature: The sequence is a functional homolog of SEQ ID NO 178 in the 10/225,068 US patent application
  misc_feature: The sequence is a functional homolog of SEQ ID NO 358 in the 10/374,780 US patent application
  misc_feature: The sequence is a functional homolog of SEQ ID NO 1087 in the 10/666,642 US patent application
  misc_feature: The sequence is a functional homolog of SEQ ID NO 312 in the 10/666,642 US patent application
  misc_feature: The sequence is a functional homolog of SEQ ID NO 1086 in the 10/666,642 US patent application
  misc_feature: The sequence is a functional homolog of SEQ ID NO 1719 in the 11/479,226 US patent application
  misc_feature: The sequence is a functional homolog of SEQ ID NO 1524 in the 10/666,642 US patent application
  misc_feature: The sequence is a functional homolog of SEQ ID NO 650 in the 10/666,642 US patent application
  misc_feature: The sequence is a functional homolog of SEQ ID NO 214 in the 10/225,066 US patent application
  misc_feature: The sequence is a functional homolog of SEQ ID NO 2450 in the 10/374,780 US patent application
  misc_feature: The sequence is a functional homolog of SEQ ID NO 604 in the 10/412,699 US patent application
  misc_feature (25)..(25): Xaa is any aa, unknown, or other
MHRRRHKVPWKLLKREAGEAARKRXFLCPEPSCLHHDPSHALGDLVGIKKHFRRKHSGHRQWACVFSRIVWGSIAWLI

SEQ ID NO: 541 - DNA, 205 bp, Zea mays
  misc_feature: Ceres CLONE 222485-R
  misc_feature: Encodes the peptide sequence at SEQ ID NO. 542
tattgaagtgcttggcacgtcactcactcggtgcaatttcctggggaccaaggtggaaactctttccccctgtttttaccgtattttaagctgttaatttgtctgcggtgtagaaccttctgaaacctctaactgaagctagtcatatggcacattagcatataccaccagattgagatattttgtacaaaaaargraaaadwaa

SEQ ID NO: 542 - protein, 31 aa, Zea mays
  misc_feature: Ceres CLONE 222485-R
IEVLGTSLTRCNFLGTKVETLSPCFYRILSC

SEQ ID NO: 543 - DNA, 465 bp, Zea mays
  misc_feature: Ceres CLONE 222519-F
  misc_feature: Encodes the peptide sequence at SEQ ID NO. 544
  misc_feature (89)..(89): n is a, c, t, g, unknown, or other
acattcacctcccatccatttctcaccagaagcgaaggcgaaggcggaggcggaggagcggaggtaggagatctcgagcaagccggasnagtagatgaagacgttcgacccgtggccggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagaaacgcatgtttggccagccagttctgttatgcttttgaatgaaaaatttagacccctctttctcttttccttaatcgaaatgcttgaactctatgttccatttgtaatgtaataagaggcaaatgaattgawccaccagcaatcaacttctgattgaaaaatatcgatgtgtcatgtgt

SEQ ID NO: 544 - protein, 57 aa, Zea mays
  misc_feature: Ceres CLONE 222519-F
MKTFDPWPVFFRREWKRNWPFLTGFAITGFIITKMTSNFTEEDLKNSKFVQEHKKKH

SEQ ID NO: 545 - DNA, 1012 bp, Zea mays
  misc_feature: Ceres CLONE 222549
  misc_feature: Encodes the peptide sequence at SEQ ID NO. 546
accctagaagcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggagaccgaggtcgtcgccgctaaggagccggtgtcggccgaggtcgagactgagtccaaggaggtcgaggtcgaggccgaggccgtagctgaggctgagccgaccgaggcagagcccaaggaagcagagcccgaggccgccgcgccggcagcagagacggaggctgctgctgccccggtcgaggctgctgagccggagatagccgccgagaccaaggaggcggcggctgtggaggctaacgaggaggagggggaggcatcgcctgcggttgctgccactcctgaggtcgcagcgaccgaggaggaagcggcggtccctgctcccgaggccgccgtcgctgccgtcgagaagtccgtcgagtgagtccagcgccggacggcggccgatctagctcgctgcgtcagcctgtcacctggcgtgcgccgctctggtgccactgccacggcaacagcacggcatggcgccggcataggtcgctaggaaaaacctgcttttgtgttcgggttcacgtcgtgtcctacgtggcgcggcgggccccgcctagtaaaggagcgtaggagcgtcgttttgtgttgtggtcgaataaataatgtgtctgtgtgccgatcccgtgtcgggttagtgggcccactgtcggtgctgatgtggcctgcctttacagcacatcggtggggctgggccgttgagctcctgtgtcgtttaaatatatgtgtactctgtactgtaccaactagtatgtgtttcgagtgtgtagtaagcatatttgtgtcccatccatctttcgaaaaaaaaaaaaacaaaaaaaaaaaaaaaa

SEQ ID NO: 546 - protein, 153 aa, Zea mays
  misc_feature: Ceres CLONE 222549
MASGELACTYAALILSDDGIAITAEKIATIVKAETEVVAAKEPVSAEVETESKEVEVEAEAVAEAEPTEAEPKEAEPEAAAPAAETEAAAAPVEAAEPEIAAETKEAAAVEANEEEGEASPAVAATPEVAATEEEAAVPAPEAAVAAVEKSVE

SEQ ID NO: 547 - DNA, 308 bp, Zea mays
  misc_feature: Ceres CLONE 222554-F
  misc_feature (38)..(38): n is a, c, t, g, unknown, or other
  misc_feature (39)..(39): n is a, c, t, g, unknown, or other
  misc_feature (67)..(67): n is a, c, t, g, unknown, or other
  misc_feature (142)..(142): n is a, c, t, g, unknown, or other
attgggggcatttgctacaccaccacacccacaccccnnccagcacacaacaagcagcctggtttanggtagctgctagcaaaacaatggagaaccctgctccgagcatcgtagtggccatcgccgcacccgtkgcggcggnagttcgtgaagctcaccttccgtgccctgtaatatgcgccgggctggtcctggcagcagggagatgactgtkccgggaaggccatccgaccagctgggcagggagagtcgtcactgacagccccgtgtacgaamggccgtggcgccgacgccgcctcgtggctcgc

SEQ ID NO: 548 - DNA, 485 bp, Zea mays
  misc_feature: Ceres CLONE 222608-F
  misc_feature: Encodes the peptide sequence at SEQ ID NO. 549
  misc_feature (463)..(463): n is a, c, t, g, unknown, or other
ctgttccccacccatatcgtgaacccgccgccgactcagcagcaggagacgcgccaaggagagcccgcaaggaggcgactatgagggccaagtggaagaagaagcgcatkaggaggctgaagaggaagcgccgaaagatgaggcagagatccaagtaggctgatggggatttgtggatggtggtgacgacatggttktgttacgatttcttcgatgcgttgtgagttcatggagagattgtcacatcctagttcgtcgtcaccgttttccattgtgtccaatagctcgttcttggaaacctgcacttcagtaggccatctatcgtggtttctagctatatccagagttttktgctaagacaaatcagtcagtcgttttgtgaacctactatgatggagctttatttgctgctaatatcgacctacctattaagtaattgcaatgttcgtctatgctgtgcttngttcctcaataaaaaaaaaaaa

SEQ ID NO: 549 - protein, 40 aa, Zea mays
  misc_feature: Ceres CLONE 222608-F
  misc_feature (3)..(3): Xaa is any aa, unknown, or other
MVXLRFLRCVVSSWRDCHILVRRHRFPLCPIARSWKPALQ

SEQ ID NO: 550 - DNA, 191 bp, Zea mays
  misc_feature: Ceres CLONE 222697-F
aaaaaggagccgatctcaaaaacagaacagtgcccgcatttcaaactgggctccataaagttctgtcgcctcgcctgtgacctgtagggtagcagcaggcagcggaggggagagagagagagagagaggggatggattctcaagcgccgcttcgtcctcctctagctttcgcctgcttcatcttcctttgc

SEQ ID NO: 551 - DNA, 420 bp, Zea mays
  misc_feature: Ceres CLONE 222713-F
  misc_feature: Pfam Name: Pyrophosphatase Pfam Description: Inorganic pyrophosphatase
  misc_feature: SWISSPROT Homolog: EC 3.6.1.1 Inorganic diphosphatase
  misc_feature (140)..(140): n is a, c, t, g, unknown, or other
  misc_feature (316)..(316): n is a, c, t, g, unknown, or other
  misc_feature (330)..(330): n is a, c, t, g, unknown, or other
awttgattcgagccagtcagccagccccggagccctggacagcagcagcgaactcgaggccgctccgccacctcgccactcgcctcttctcgctctcgccaccgggccagggaagggaccatccgatcggctccgtcatngctggagctgctgctctcaatgagggtatcctttcttccgtgtccgagaaaaatgttgctgctcacccatggcatgatttttgagataggaccagaggctcctgaagtgttcaaattgtgtggttgagattcctcagaggcagcaaggtgtaaatattaatttgacaaratatctngtctkatcaaagtngatcvtgtcctttactcctctgttgtttacccacataactatggtttcattccacgcacactctgtgaggatagcgaacccattgaacgt

SEQ ID NO: 552 - DNA, 471 bp, Zea mays
  misc_feature: Ceres CLONE 222778-F
  misc_feature: Translation starting site: 74
  misc_feature: Pfam Name: Ribosomal_L22 Pfam Description: Ribosomal protein L22p/L17e
gcttcgaagtgttcgtgcgaaggcgaccctccctccttcgctccttccccgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtctcgccactccaatgggcagggccgctggcggttaaatcagccgggttcatcctggatttgctgaagaatgctgagagtaacgctgatgtgaaaggctatgtggacaacctctatatttcacacatccaggtgaaccaagcccagaagcagatgcgccgcacctaccgtgctcac

SEQ ID NO: 553 - DNA, 510 bp, Zea mays
  misc_feature: Ceres CLONE 222793-F
  misc_feature: Pfam Name: Ribosomal_L19e Pfam Description: Ribosomal protein L19e
  misc_feature (68)..(68): n is a, c, t, g, unknown, or other
  misc_feature (69)..(69): n is a, c, t, g, unknown, or other
  misc_feature (135)..(135): n is a, c, t, g, unknown, or other
tccacacctgagtccccwccgccgcctgccgcactctcccgcgacgccaccaccacacgttcacggtnncgagagcttatcgtcgtcggcggcgaagatggtgtcgctgaagctgcagaagcggctcgccgcgangcgtcctcaagtgtgggaaaggcaaagtctggcttgaccccaatgaaagtcagcgagatctccatggctaactcccgccagaaacatccggaaagttggttaaggatgggtttatcatcagggaagcctcagaaggttcactctaggtcccgtgcaagaagggcacatgaggccaagcagaagggaaggcactctggatatggcaagcgcaggggtacagggaggctaggctccccaccaagattctgtggatgaggaggatgcgtgttctgaggcgcctgctctgcaagtaccgtgaggccaagaagatcgacagcacatgtatcatgacatgtacatgaaggtcaaggggtaatatgttttagaacaagaggg

SEQ ID NO: 554 - DNA, 145 bp, Zea mays
  misc_feature: Ceres CLONE 222852-F
  misc_feature (55)..(55): n is a, c, t, g, unknown, or other
  misc_feature (81)..(81): n is a, c, t, g, unknown, or other
aatcgaaaaaacccagtgtgcgcacttcaccccccctctcggtctcaccctcctngcgacgactgggcggccgaacggctncgkccgccgccccacgccaggtttcaaagtcttcgtcaggcccttctccggcgactcgagcacc

SEQ ID NO: 555 - DNA, 151 bp, Zea mays
  misc_feature: Ceres CLONE 222856-F
  misc_feature (40)..(40): n is a, c, t, g, unknown, or other
  misc_feature (41)..(41): n is a, c, t, g, unknown, or other
acacgccgctgctccaagaaaccaccgccgagcccaaccnnacaagcgcgcgaggcaggagagagagagagagaggcggggagcaaaacaatgggaggggaaagaggaggacgtgcgcctggggcscaacaagttctcggagcgccaccca

SEQ ID NO: 556 - DNA, 630 bp, Zea mays
  misc_feature: Ceres CLONE 222866-R
  misc_feature: Pfam Name: tRNA-synt_2 Pfam Description: tRNA synthetases class II (D, K and N)
  misc_feature: SWISSPROT Homolog: EC 6.1.1.6 Lysine--tRNA ligase
cgattgggtccgggccccccctcgaggtcgacggtatcgatattttttttttttttttttgttagaccaaagaatctcttaaatggtagttcaaggcgacatgcgcaaccatgtcaccgaagaatcagagtatccagtggagatagctgttttgcagcacattaattgtaaaatgtggattccattattattcaaacatctataaagtttttaatatcggcttggactctgaactatagtacatctcaattacatcatcaaataataaatggccacatctatgagctataaaaaggtcagcagatataaaacctgctgtactgaaccaagcgcaaaaggaaggctgctagtgttttcttcagcagccacgcctcttcacagaatgaaggggatctattgctgaatcttcaagacaggaaaggcaataacgtcccttatgctagaagagttcgtcaaaagcattactaaccggtcgataccgaggcccattcctgatgccggtggcattccgtattccaatgaagtcaagaagtcctcgtctaaagaaacttcatacgagtaatcgtcgtcgccttcaccctcggtagatttgacctccttagccattgcagcacgcttagcattgtgctg

SEQ ID NO: 557 - DNA, 348 bp, Zea mays
  misc_feature: Ceres CLONE 222879-F
  misc_feature: Encodes the peptide sequence at SEQ ID NO. 558
  misc_feature (39)..(39): n is a, c, t, g, unknown, or other
  misc_feature (40)..(40): n is a, c, t, g, unknown, or other
  misc_feature (68)..(68): n is a, c, t, g, unknown, or other
  misc_feature (134)..(134): n is a, c, t, g, unknown, or other
  misc_feature (135)..(135): n is a, c, t, g, unknown, or other
aattgggggcatttgctacaccaccacacccacaccccnnsccagcacacaacaagcagcctggtttnggtagctgctagcaaaacaatggagaaccctgctccgagcatcgtagtggccattgtygcacccgnngcggcggagttcgtgaagctcaccttccgtgccctgtatatgcgccgggctggtcctggcagcagggagatgactgtrccgggaaggccatccgaccagctgggcaggagagtcgtcactgacagccccgtgtacgacggccgtggcgccgacgccgcctcgtggctcgcatacagggagtcacggtccwggtcggtaacgcagacgccttgt

SEQ ID NO: 558 - protein, 87 aa, Zea mays
  misc_feature: Ceres CLONE 222879-F
  misc_feature (16)..(16): Xaa is any aa, unknown, or other
  misc_feature (80)..(80): Xaa is any aa, unknown, or other
MENPAPSIVVAIVAPXAAEFVKLTFRALYMRRAGPGSREMTVPGRPSDQLGRRVVTDSPVYDGRGADAASWLAYRESRSXSVTQTPC

SEQ ID NO: 559 - DNA, 188 bp, Zea mays
  misc_feature: Ceres CLONE 222896-F
agaaaagggcggataaactgcttgaactggaagcgaccctagtccaaaccaccgcaccgacaccgahbccgagccccgccgcgccgsctacctccgctcctctcttcgcccctgccggcgtcgaggccgaagcgaaggcgagcatgcatcacgacccaaccccttcgacgagggcagcgcgaggacaa

SEQ ID NO: 560 - DNA, 227 bp, Zea mays
  misc_feature: Ceres CLONE 222904-F
  misc_feature: Encodes the peptide sequence at SEQ ID NO. 561
  misc_feature (20)..(20): n is a, c, t, g, unknown, or other
akattagcaggccgcctgcnctccttgcccctaagcctcgtttccggtgtacgactccaacgacgacgagatggcgctccgtcggagcttcccctccctcggccgcgcgcttctcacgccggcgccgggccgcggggaacgctctccgcggaggcctccgatgccctcggttgagatcaagcccggggaaattgggatggtctccggcatccccgaggagcacctcc

SEQ ID NO: 561 - protein, 52 aa, Zea mays
  misc_feature: Ceres CLONE 222904-F
MALRRSFPSLGRALLTPAPGRGERSPRRPPMPSVEIKPGEIGMVSGIPEEHL

SEQ ID NO: 562 - DNA, 484 bp, Zea mays
  misc_feature: Ceres CLONE 222937-F
  misc_feature: Translation starting site: 201
  misc_feature: Pfam Name: Actin Pfam Description: Actin
  misc_feature: SWISSPROT Homolog: EC 2.7.10.2 Non-specific protein-tyrosine kinase
atagcatagcagagcaggcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtggccgccctcggcacacgggtgtgatggttggaatgggccagaaggacgcctatgtaggtgacgaggcacagtcaaaaagaggtatcttgaccttgaagtaccccattgagcacggtatcgtgaacaacttggatgatatsgagaaaatyttgcaccamaccttctacaatgaa

SEQ ID NO: 563 - DNA, 198 bp, Zea mays
  misc_feature: Ceres CLONE 222971-F
aaatcgccctacgcccacggttccacctcctcgtccacgaggtgaggaaaccctagcgaccgaccatggcgttgctcccgcgcaccgscttgggccctcctttccaccccgcgggcgtactccgctgccgctgctgcgcgcgcctccccgacgtccccagcgccatacgggggcgcccccccaccggcgatgtcgaag

SEQ ID NO: 564 - DNA, 394 bp, Zea mays
  misc_feature: Ceres CLONE 223006-F
atacatttcgactctcaactcccaaggtcccttttttttctcgatctggaagcgccgcagtagcagccatggacgtgagcggacaggcgggaaggcgaagaagggcgcggccgggcgcaaggccggcgggcgacgaagaagtcggtgtcgcggtcctccagggccgggctgcagttccccgtcagccgcgtcgggcggtacctcaaaaagggccggtacgcgcabgtaggcacgggtgcccccgtctacctcgccgccgtcctggagtacctcgcggccgaggtgctcgagctcgccggcaacgcggcaagggacaacaacaagacgcgcatcatcccgcgccacgtgctcctcgccgtccgcaacgacgaggagcycggcaagctkctkgccg

SEQ ID NO: 565 - DNA, 496 bp, Zea mays
  misc_feature: Ceres CLONE 223007-F
  misc_feature: Encodes the peptide sequence at SEQ ID NO. 566
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccaggaatccatacgacggg

SEQ ID NO: 566 - protein, 119 aa, Zea mays
  misc_feature: Ceres CLONE 223007-F
  misc_feature (28)..(115): Pfam Name: Tryp_alpha_amyl Pfam Description: Protease inhibitor/seed storage/LTP family
MKTTSSGIAVVLLVAMLAVHSALADISCSDVLNDLSPCLPFLQGKAAKPSESNNQCCDGVRALYAAADTRPDRQATCRCLKAAYVQVHAVLSAAQELPGDCGLSLSYNITPDIDCDKIE

SEQ ID NO: 567 - DNA, 1557 bp, Zea mays
  misc_feature: Ceres CLONE 223049
  misc_feature: Encodes the peptide sequence at SEQ ID NO. 568
ctaacccctccttcgtttgcccatcctcgtgacggctcctcgccagtcgcctcgtctctccctgccgcgtcgcctccattttttttttttttttttcatcagaaactactgcgaatgagcttgtattatccaaaattcaggaagaatcactgttactaccagaaatacaatcacccacagacacaacatacgtagcatgcttcaaagcgcttcattgcagaagcgatggattacacagctattgcagcaatactacctcagaaagcatcacacagagacatgtcccctaaccagtccccgactacgaagaggcgcctagcctagcctccgaagccgtagagggtgcggccctggcgcttgagcgcgtagacgacgtccatggcggtcacggtcttgcggcgcgcgtgctcggtgtaggtgacggcgtcgcggatgacgttctcgagaaagatcttgagcacgccgcgggtctcctcgtagatgagccccgagatgcgcttcacgccacccctcctagccagcctccggatcgccggcttggtgatgccctggatgttgtcgcggagcaccttccggtggcgcttcgcgccgcccttgcccagacccttgccgcccttgccgcgcccagacatcgccgccgcctctctgacgcggaccaaagaactggggatttttctggtgtaggggaaggttgggtactgatgggtatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctgaagagcccgaaaacacagccacaatcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcaccttgcaagttgcacttgttgagccagagaaagttcatcctaaattatggaaaggggtgcgaaggggatttatacctgttgatcgagtagcaattgaacggaagagacacaacaaggataagactgtagcagagcacaaaaagatggttgaaggaattgtaaagcgggatggaaagcgtcgcaaaagaatcaaggcagctggtattgactatgagtgtccagctcttatagggagcattcaaccatcagcgaaaaagatcaagttcgatgaggcatagtattttattctaatgggctgttggatccttagtagacgaggcggtggaatggttgagcaatatattcaccttttgaggagacggcagacaactatgtatttcacttttgaatttctctatgttttatgaatgacaccgacacagatgttacaacttaagtatgaaaatgcaatgggcgatgtgttcttaaagaaaaaaaaaaaaaaaa

SEQ ID NO: 568 - protein, 215 aa, Zea mays
  misc_feature: Ceres CLONE 223049
  misc_feature (56)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGMRDKKRNQKRVLARRTAAPRPGEGKDFLPLEGGPGKKHLKVQQPEEPENTATIVYIGHIPHGFYEDEMKGFFKQFGDIKRLRIARNRKTGKSKHYGFIEFENPAVAKVVADEMNNYLLFERTLQVALVEPEKVHPKLWKGVRRGFIPVDRVAIERKRHNKDKTVAEHKKMVEGIVKRDGKRRKRIKAAGIDYECPALIGSIQPSAKKIKFDEA

SEQ ID NO: 569 - DNA, 142 bp, Zea mays
  misc_feature: Ceres CLONE 223089-F
atcccatccatcgagctgcccgcgcgcgcagttaagctcacacatcagctagctcaccttggacggccgaccaggtacgttgcgagcgatggcggggatacaaagcgtcgggcggcaggcgctcggcgtcgtcctggctgtt

SEQ ID NO: 570 - DNA, 392 bp, Zea mays
  misc_feature: Ceres CLONE 223101-F
  misc_feature: Pfam Name: Metallophos Pfam Description: Calcineurin-like phosphoesterase
  misc_feature: SWISSPROT Homolog: EC 3.1.3.16 Phosphoprotein phosphatase
  misc_feature (303)..(303): n is a, c, t, g, unknown, or other
awagagggagccgctaggktttagcggcttccgcgtctgggcgagggcttacccgcgagkacggcgcgacgcggcggcacttgagctagggtttaaccctccgatcccgttcctttcccggcgaggcgatggacgaggcggcgattgacgacttgatccggcggctcctcgaggcccgcggcgggcgcaccccgcgcaacgsaggttgactgacgccgagatccggcgcctctgcgcaaccgccaaggacgttttcctctcccagcccaacctcctggagctcgaggcccccattaagatatncggggatatccatagccagtattcagacctccttcgattatttgagtatcggtggctatccaccagatgcaaattatctgttcctgggt

SEQ ID NO: 571 - DNA, 180 bp, Zea mays
  misc_feature: Ceres CLONE 223141-F
  misc_feature: Encodes the peptide sequence at SEQ ID NO. 572
  misc_feature (135)..(135): n is a, c, t, g, unknown, or other
accgaattcgagacctccaattccctcgtagcagcagcaccagtagagtytccttcctctccggcggcgatgtctgggcgcggcaagggcggcaaggggctgggcaagggcggcgcaagcggcaccgcaagstcncgcgacaacatccaagggatcacgaagccggcgatccggaggctt

SEQ ID NO: 572 - protein, 37 aa, Zea mays
  misc_feature: Ceres CLONE 223141-F
  misc_feature (21)..(21): Xaa is any aa, unknown, or other
MSGRGKGGKGLGKGGASGTAXSRDNIQGITKPAIRRL

SEQ ID NO: 573 - DNA, 393 bp, Zea mays
  misc_feature: Ceres CLONE 223144-F
  misc_feature: Translation starting site: 69
  misc_feature (225)..(225): n is a, c, t, g, unknown, or other
  misc_feature (231)..(231): n is a, c, t, g, unknown, or other
atacatttcgactctcaactcccaaggtcccttttttttctcgatctggaagcgccgcagtagcagccatggacgtgagcggasaggcgggaaggcgaagaagggcgcggccgggcgcaaggccggcgggcgacgaagaagtcggtgtcgcggtcctccagggccgggctgcagttccccgtcagccgcgtcgggcggtacctcaaaaagggccggtacgcgcanktttanggcacgggtkccccgtctacctcgccgccgtcctggagtacctcgcggccgargtgctcgagctcgccggcaacgcggcaagggacaacaagaagacgcgcatcatcccgggccacgtgctcctcgccatccgcaacgacgaggagctcggcaagctgctgg

SEQ ID NO: 574 - DNA, 234 bp, Zea mays
  misc_feature: Ceres CLONE 223199-F
  misc_feature: Encodes the peptide sequence at SEQ ID NO. 575
  misc_feature (112)..(112): n is a, c, t, g, unknown, or other
aatggaacaaatgtcaaaaccatcgggggcaaaaggataggagaataaggaaaaaacaatggcggtgctactccgccgcgccgcgsttccctcgtcgtcgctgctgtctgcncggacggcgcctccacgttctactcctccgaccccaacctcggatccgcgcgcgtcgtcttccagacgaattttggtratattkcagtttggtttctttcctcatgttgcacctaagactgt

SEQ ID NO: 575 - protein, 58 aa, Zea mays
  misc_feature: Ceres CLONE 223199-F
  misc_feature (10)..(10): Xaa is any aa, unknown, or other
  misc_feature (46)..(46): Xaa is any aa, unknown, or other
MAVLLRRAAXPSSSLLSARTAPPRSTPPTPTSDPRASSSRRILVIXQFGFFPHVAPKT

SEQ ID NO: 576 - DNA, 248 bp, Zea mays
  misc_feature: Ceres CLONE 223211-F
  misc_feature: Encodes the peptide sequence at SEQ ID NO. 577
  misc_feature (62)..(62): n is a, c, t, g, unknown, or other
  misc_feature (136)..(136): n is a, c, t, g, unknown, or other
aaaacacgagcgagcacaaaaaaaaawtcccaatatccgcaacggcaatktytccgctgcyncgcatcgtgctcctcgccgtcgccgccgccgccgccgcagcgttcacggcgtcasacgtcgctcagcggcgcgncgaacgacctactccccaaktacggcytcccgarggcttcatcccggactccgtcgcctcctacagcttcgacgaggcmacgggcgccttcgagatccacctcgccggcacc

SEQ ID NO: 577 - protein, 82 aa, Zea mays
  misc_feature: Ceres CLONE 223211-F
  misc_feature (9)..(9): Xaa is any aa, unknown, or other
  misc_feature (16)..(16): Xaa is any aa, unknown, or other
  misc_feature (17)..(17): Xaa is any aa, unknown, or other
  misc_feature (20)..(20): Xaa is any aa, unknown, or other
  misc_feature (39)..(39): Xaa is any aa, unknown, or other
  misc_feature (45)..(45): Xaa is any aa, unknown, or other
  misc_feature (52)..(52): Xaa is any aa, unknown, or other
  misc_feature (54)..(54): Xaa is any aa, unknown, or other
NTSEHKKKXPISATAXXPLXRIVLLAVAAAAAAAFTASXVAQRRXERPTPQXRXPEGFIPDSVASYSFDEATGAFEIHLAGT

SEQ ID NO: 578 - DNA, 475 bp, Zea mays
  misc_feature: Ceres CLONE 223212-F
  misc_feature: Encodes the peptide sequence at SEQ ID NO. 579
akccgcgcgacgcccaccwgcagctgccccttgctgtcgccgcctctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggattacaaggatggaaggttctcacaggtcgtgtccaacgccctcgacatgaagctcagggacgacctcgagaggctcaagaagatcaggaaccaccgtggtctgcgtcactactggggcctccgtgttcgt

SEQ ID NO: 579 - protein, 132 aa, Zea mays
  misc_feature: Ceres CLONE 223212-F
  misc_feature (14)..(132): Pfam Name: Ribosomal_S13 Pfam Description: Ribosomal protein S13/S18
MSLIAGEDFQHILRLLNTNVDGKQKIMFAMTSIKGVGRRFSNIVCKKADIDMNKRAGELTPEELERLMTVVANPRQFKVPDWFLNRKKDYKDGRFSQVVSNALDMKLRDDLERLKKIRNHRGLRHYWGLRVR

SEQ ID NO: 580 - DNA, 410 bp, Zea mays
  misc_feature: Ceres CLONE 223217-F
  misc_feature: Pfam Name: Ribosomal_S11 Pfam Description: Ribosomal protein S11
  misc_feature (256)..(256): n is a, c, t, g, unknown, or other
  misc_feature (306)..(306): n is a, c, t, g, unknown, or other
gtttcggcggcgcggcgtgctcgtgatctcaacccaaggcgtgcctccgctccggtcacccgtcgctccacgcaaccatgtcgaggaggaagaccagggagcccaawggaggagaacgtcacccttkggacccactgtccgtgaaggagagtatgtctttggtgtcgctcacatctttgcatccttcaatgacaccttcattcatatcactgatttgtctgggagggaaactctggttcggatcaccggtggcatnaaggtgaaagctgaccgtgacgagtcgtcaccttacgctgctaatgcttnctgctcaagacgtcgcacagcgctgcaaggagctttgcattactgcactgccacattaagcttcgcgccaccggggcaacaagaccaagacccctggacctggt

SEQ ID NO: 581 - DNA, 198 bp, Zea mays
  misc_feature: Ceres CLONE 223340-F
  misc_feature (118)..(118): n is a, c, t, g, unknown, or other
tcacagctcaaaagcagccaaaacgctagctagctgcagcgatgatgtctcgctcctgctacctcgccgtgtcggtccttctcgcggtcgccgcgacaccagcgggccatcgcgcggncgttgctgcacgaggtgcgcctcgaggaggagggcctgatggtcgcggagggmgcgaggrtggcgtccacctrggcgggc

SEQ ID NO: 582 - DNA, 378 bp, Zea mays
  misc_feature: Ceres CLONE 223354-F
  misc_feature (138)..(138): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctgcagttccccgtcagccgcgtcgggcgttacctcaaaaagggccggtacgcgcaytaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgagga

SEQ ID NO: 583 - DNA, 406 bp, Zea mays
  misc_feature: Ceres CLONE 223358-F
  misc_feature (392)..(392): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcrbttaaggcacgggtgcccccgtctacctcgccgccgtcctggagtacctcgcggccgaggtgctcgagctcgccggcaacgcgcaagggacaacaagaagacgcgcatcattccgcgccacgtgctcctcgccatccgcaacgacgaggagctcggcaagctnctggccggcgtcac

SEQ ID NO: 584 - DNA, 348 bp, Zea mays
  misc_feature: Ceres CLONE 223370-F2
  misc_feature (316)..(316): n is a, c, t, g, unknown, or other
ggcgaagatttcggggcgcggcaagggcggcaagggcctgggcaagggcggcgcgavtcacccggaaggbctgcgcgacaacatccaggggatcacgaaccggcgatccggagctggcgcggcggggcggcgtgaacsatctcggggctcatctacgaggagacccgcggcgtgctmaagatcttcctggagaacgtmatccgcgacgccgtcacctacaccgagcacgcgcgccgtaagaccgtcaccgccatggacgtcgtctacgcgcttaagsscagggccgaaccctctacggcttcggcggctaggcctnccgcgccggcttcgmmgtcgctrcggttctgg

SEQ ID NO: 585 - DNA, 348 bp, Zea mays; identical to SEQ ID NO: 584
  misc_feature: Ceres CLONE 223370-F
  misc_feature: Encodes the peptide sequence at SEQ ID NO. 586
  misc_feature (316)..(316): n is a, c, t, g, unknown, or other

SEQ ID NO: 586 - protein, 115 aa, Zea mays
  misc_feature: Ceres CLONE 223370-F
  misc_feature (19)..(19): Xaa is any aa, unknown, or other
  misc_feature (46)..(46): Xaa is any aa, unknown, or other
  misc_feature (59)..(59): Xaa is any aa, unknown, or other
  misc_feature (66)..(66): Xaa is any aa, unknown, or other
  misc_feature (92)..(92): Xaa is any aa, unknown, or other
  misc_feature (93)..(93): Xaa is any aa, unknown, or other
  misc_feature (111)..(111): Xaa is any aa, unknown, or other
  misc_feature (113)..(113): Xaa is any aa, unknown, or other
AKISGRGKGGKGLGKGGAXHPEGLRDNIQGITNRRSGAGAAGRREXSRGSSTRRPAACXRSSWRTXSATPSPTPSTRAVRPSPPWTSSTRLXXGPNPLRLRRLGLPRRLRXRXGS

SEQ ID NO: 587 - DNA, 265 bp, Zea mays
  misc_feature: Ceres CLONE 223376-F
  misc_feature (199)..(199): n is a, c, t, g, unknown, or other
atctccctgtttaatcaatccttcaagcgcaabkgcctcctcctcgtcgtccggtcgtgagaagggatggcgggccgtggcaaggctatcggcgctggcgcscgaagaaggcaacgtcgaggagctccaaggccggactccagttccccgtcggcaggattgccaggttcctcaaggcgggcaaktacgcggasmgttncggcgccggcgcccccgtgtacctcgccgccgtcctcgagtacctcgcggctgaggtctcgaactt

SEQ ID NO: 588 - DNA, 335 bp, Zea mays
  misc_feature: Ceres CLONE 223379-F
  misc_feature: Encodes the peptide sequence at SEQ ID NO. 589
  misc_feature (116)..(116): n is a, c, t, g, unknown, or other
  misc_feature (183)..(183): n is a, c, t, g, unknown, or other
  misc_feature (288)..(288): n is a, c, t, g, unknown, or other
acaagcagcatccgcacactcccaattcccctcgagcgccgcagcgagcccaagaagccgaccgccgagccccctctccagtccagtccgcggtctcggtttcttgcttgcccggngcccaatcttcagagagagctccttctcgtcgtctgtctccatggccgcctcgaccaagaccgtmgncgtcctcctcgccgggtdmtcctcgcgctggtcggtccgcggcaccagcaggaagctggaggaggacgcacttctgggaagcctggccccagcccccgcgccggncgttggcggtgccgcggggctacctggcggcaagcgggggcgtgggc

SEQ ID NO: 589 - protein, 59 aa, Zea mays
  misc_feature: Ceres CLONE 223379-F
  misc_feature (9)..(9): Xaa is any aa, unknown, or other
  misc_feature (15)..(15): Xaa is any aa, unknown, or other
  misc_feature (44)..(44): Xaa is any aa, unknown, or other
MAASTKTVXVLLAGXSSRWSVRGTSRKLEEDALLGSLAPAPAPXVGGAAGLPGGKRGRG

SEQ ID NO: 590 - DNA, 422 bp, Zea mays
  misc_feature: Ceres CLONE 223406-F
  misc_feature: Translation starting site: 87
  misc_feature (232)..(232): n is a, c, t, g, unknown, or other
  misc_feature (248)..(248): n is a, c, t, g, unknown, or other
  misc_feature (249)..(249): n is a, c, t, g, unknown, or other
atcacaattcactccactcatcttttctcgtttagaacctctaaaatttcccccactcgccagtcgcagcagcacctgtagcagtcatggacgccagcggagccggtagcaaggggaagaagggggcggccgggcgcaaggtcaggctggccccaggtaagaagtcggtgacgcggtccgtcaaggccgggctgcagttccccgtmggccggatcgggcgctacctcaagangggccggtacgcgcanngtggggcactggcgcccccgtctacctcgccgccgtcctggagtacctcgccgccgaggttctggagttggcagggaacgcggcgaaagacaacaagaagacgcggcatcatcccggsgccacgtgctcctggcgatccgcaacgacgaggagctcgggaarctgctggccgg

SEQ ID NO: 591 - DNA, 282 bp, Zea mays
  misc_feature: Ceres CLONE 223477-F
  misc_feature: Translation starting site: 72
  misc_feature: Pfam Name: Mov34 Pfam Description: Mov34/MPN/PAD-1 family
  misc_feature (33)..(33): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (176)..(176): n is a, c, t, g, unknown, or other
  misc_feature (275)..(275): n is a, c, t, g, unknown, or other
accccctccccaatcacgccacccgacaccgynctccgcagattcgtagtcgccgctasstntccggnnagatggacgtggtgaaggrcggcgcagttgtcggggcggamgctggaacgggtartggtgcatcccttggtgctctcagcatcgtcgaccactacaaccgcgtcgtncgcgacaccacgcaagckcgtcgtcggcgtcctcctcggcacctcatcccgcgggtccgtcgatgtcaccawctcctacgccgtgccktttgaggaggntgacaag

SEQ ID NO: 592 - DNA, 472 bp, Zea mays
  misc_feature: Ceres CLONE 223526-F
  misc_feature: Encodes the peptide sequence at SEQ ID NO. 593
  misc_feature (428)..(428): n is a, c, t, g, unknown, or other
ccccaccacctccctgtatccctcctccccttctggccgacgaaaccctacgcgcgcgcgctgyyyaagacctcgccgccgacgcctactccgactccgacgccgcagtcgtgatgtacgccgacagacctcgggcaggaaacgctctgtaatggaccgcctcggctcgggcggcggctcgcgctcgcggtccgacgacgcaaaaakgttttgccaggatgatgggacatggagacgtgagctttataaggattctagaggaactcagacttcatctgaacctacttccagaaatctggaatcgaacaaaaaatcccaagtgcagcaaaaggttgtgaagaaattaccagtttcagatcttcgtggaaagttatctggtgtcgcgagccagcgccctcaacttagcagtactgttcaggtcccaaawnctgtaaaagaggttattaagagcaacaaacctgttcaaaaagag

SEQ ID NO: 593 - protein, 107 aa, Zea mays
  misc_feature: Ceres CLONE 223526-F
  misc_feature (19)..(19): Xaa is any aa, unknown, or other
  misc_feature (92)..(92): Xaa is any aa, unknown, or other
  misc_feature (93)..(93): Xaa is any aa, unknown, or other
MDRLGSGGGSRSRSDDAKXFCQDDGTWRRELYKDSRGTQTSSEPTSRNLESNKKSQVQQKVVKKLPVSDLRGKLSGVASQRPQLSSTVQVPXXVKEVIKSNKPVQKE

SEQ ID NO: 594 - DNA, 277 bp, Zea mays
  misc_feature: Ceres CLONE 223548-F
  misc_feature: Encodes the peptide sequence at SEQ ID NO. 595
  misc_feature (58)..(58): n is a, c, t, g, unknown, or other
  misc_feature (148)..(148): n is a, c, t, g, unknown, or other
  misc_feature (149)..(149): n is a, c, t, g, unknown, or other
aagttcgtgcacgtacgcacgcaccgggacaccakhaacccccaacagcgccactgtncagtgcgcgcgtcaagcttgcttagctagccgccatggcctccctcgccgccgtctccgtgaagyycgtkgccatcaagggtctcgccgnnagctccatctccggaaggwagctcgccrtcgccaggccgtcggccgctccatccgcagccccgcgcagcgccgtggtggccaagtacggcgacaagagcgtctactttggacctcgacgacatcggca

SEQ ID NO: 595 - protein, 61 aa, Zea mays
  misc_feature: Ceres CLONE 223548-F
  misc_feature (11)..(11): Xaa is any aa, unknown, or other
  misc_feature (19)..(19): Xaa is any aa, unknown, or other
  misc_feature (26)..(26): Xaa is any aa, unknown, or other
  misc_feature (29)..(29): Xaa is any aa, unknown, or other
MASLAAVSVKXVAIKGLAXSSISGRXLAXARPSAAPSAAPRSAVVAKYGDKSVYFGPRRHR

SEQ ID NO: 596 - DNA, 242 bp, Zea mays
  misc_feature: Ceres CLONE 223575-F
  misc_feature: Pfam Name: Ribosomal_S8 Pfam Description: Ribosomal protein S8
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (179)..(179): n is a, c, t, g, unknown, or other
  misc_feature (190)..(190): n is a, c, t, g, unknown, or other
ctagccgcctgcctctcctcctccagagctcgtcgccaccggtcttkgtnakcnnngatcacgccgtccgtcgaggtaaggtcagcatagtgarggtcagtgtgctcaacgatgcgctcaagtccatgtacaacgctgagaagattsgcaagaggcaggtcatgatcaggccgtcatcnaggtcatcatncagttcctgacggtcatgcagcgccatggctacattggagarttcsagtacg

SEQ ID NO: 597 - DNA, 227 bp, Zea mays
  misc_feature: Ceres CLONE 223604-F
  misc_feature: Encodes the peptide sequence at SEQ ID NO. 598
  misc_feature (176)..(176): n is a, c, t, g, unknown, or other
atcacacactcgactctcctctctcgcatccgcagcctttcgagctctactccaccccctcgatctcgaagcgcmagcagcagtcaggcggccatggacgcgagcgcmcggagcmggcgggaaggcgaagaagggcgcggccgggcgcaaggccggcgggmgagggaagaagtcgntgacgaggtccgtcaaggccgggctgcagtttcccgtcggccgcatcgggc

SEQ ID NO: 598 - protein, 75 aa, Zea mays
  misc_feature: Ceres CLONE 223604-F
  misc_feature (25)..(25): Xaa is any aa, unknown, or other
  misc_feature (36)..(36): Xaa is any aa, unknown, or other
  misc_feature (59)..(59): Xaa is any aa, unknown, or other
SHTRLSSLASAAFRALLHPLDLEAXAAVRRPWTRAXGAGGKAKKGAAGRKAGGRGKKSXTRSVKAGLQFPVGRIG

SEQ ID NO: 599 - DNA, 460 bp, Zea mays
  misc_feature: Ceres CLONE 223694-F
  misc_feature: Translation starting site: 232
  misc_feature: Pfam Name: Ribosomal_L13 Pfam Description: Ribosomal protein L13
  misc_feature (94)..(94): n is a, c, t, g, unknown, or other
tysacccacctccgccagcycactccaaacacttgckccgccgctgcctcacaggtaaggccgccatggtctccggttcgggcgtgtgcgcgantccgttggtcgacgcgcgccaccacatgctgggccgtctctcctcgatcatagccaaggagctgctcaattgggcagaaggtggtcgtcgtccgctgcgaggagatctgcatttcgggcggcctcgtccgtcagaagatgaaktacctccgcttcctccgcaagckgwtgaacaccaagccgtcccacgggcccatccacttccgcgcccccgccaagatcctgtggcgcaccatccgcgggatgattccgcacaagaccaatakgggggagcggctctggcgaggctcaagacgtacgagggcgtcccgccgccgtacgacaagaccaagcgttatggtcatccctgacgctcttaaggttctga

SEQ ID NO: 600 - DNA, 270 bp, Zea mays
  misc_feature: Ceres CLONE 223707-F
  misc_feature: Encodes the peptide sequence at SEQ ID NO. 601
  misc_feature (182)..(182): n is a, c, t, g, unknown, or other
  misc_feature (244)..(244): n is a, c, t, g, unknown, or other
ctgttcgccagagccacctcgctccagaagctttcctcccctagatctccctcccgtgcccggtcgcgctgccgacccggscatggcaccaaggggaagctcggggagctagtgtgggagcaccgggtgcaggcggccgcagcggtggctttcgtggccgcgggcgccgtctcgatctccgncgtcgggcccaaggctcggcgccgtagtgtcattcttctggccgctgctcgtctccacgggnctcttcctggtggcggtcgccgtgct

SEQ ID NO: 601 - protein, 90 aa, Zea mays
  misc_feature: Ceres CLONE 223707-F
  misc_feature (61)..(61): Xaa is any aa, unknown, or other
  misc_feature (82)..(82): Xaa is any aa, unknown, or other
LFARATSLQKLSSPRSPSRARSRCRPGHGTKGKLGELVWEHRVQAAAAVAFVAAGAVSISXVGPKARRRSVILLAAARLHGXLPGGGRRA

SEQ ID NO: 602 - DNA, 461 bp, Zea mays
  misc_feature: Ceres CLONE 223781-F
  misc_feature: Encodes the peptide sequence at SEQ ID NO. 603
  misc_feature (227)..(227): n is a, c, t, g, unknown, or other
  misc_feature (228)..(228): n is a, c, t, g, unknown, or other
  misc_feature (273)..(273): n is a, c, t, g, unknown, or other
gagaatcaaaatcactttgcgtgcagcatcgattgggtcggaaatcgagggtttggtaagcgagatcgccgccggtgacagctgacagggacgagatggacgccggcggaggcggcgtcttggtcgccgttctctgcatgctgctggtcttcgccatcttccccctcctcctctggcgccagcgctccgatgccgccaccgccgataaccaccgcgtcccgccccanncctccaggaggatcaggtgctgcacggtcgcgcggcggcgsaggnattgcgtcggaggcctggggctgccggagcaggctcctctactgcgtcaactagccgcaatgctgtagaggacgacgcgvagagtgacgatgaggaggttccccgaaggtcgcaacgtccccagatcctccaaaaaggagaagaaaaggcaagagcgagagatgcagcgtcaggccgaagaacctgca

SEQ ID NO: 603 - protein, 81 aa, Zea mays
  misc_feature: Ceres CLONE 223781-F
  misc_feature (44)..(44): Xaa is any aa, unknown, or other
  misc_feature (45)..(45): Xaa is any aa, unknown, or other
  misc_feature (60)..(60): Xaa is any aa, unknown, or other
MDAGGGGVLVAVLCMLLVFAIFPLLLWRQRSDAATADNHRVPPXXSRRIRCCTVARRRRXCVGGLGLPEQAPLLRQLAAML

SEQ ID NO: 604 - DNA, 222 bp, Zea mays
  misc_feature: Ceres CLONE 223845-F
  misc_feature: Encodes the peptide sequence at SEQ ID NO. 605
  misc_feature (13)..(13): n is a, c, t, g, unknown, or other
  misc_feature (14)..(14): n is a, c, t, g, unknown, or other
  misc_feature (129)..(129): n is a, c, t, g, unknown, or other
  misc_feature (162)..(162): n is a, c, t, g, unknown, or other
ayacycaycgagnnctcctcgggctttctttctccgttcctccctcgcgcgctcagggtttcacgatsgaggccgaggcggcggccaagakggcgcgggagggcggggaggacgccaccgcgccggtgntgggccgaggcggtggtcgccgrkgctggcgancaagcgggaatctccgccatcatcccaggatggttctccgagatcagccccatgtggccc

SEQ ID NO: 605 - protein, 71 aa, Zea mays
  misc_feature: Ceres CLONE 223845-F
  misc_feature (2)..(2): Xaa is any aa, unknown, or other
  misc_feature (20)..(20): Xaa is any aa, unknown, or other
  misc_feature (28)..(28): Xaa is any aa, unknown, or other
  misc_feature (40)..(40): Xaa is any aa, unknown, or other
  misc_feature (48)..(48): Xaa is any aa, unknown, or other
  misc_feature (51)..(51): Xaa is any aa, unknown, or other
EXSSGFLSPFLPRALRVSRXRPRRRPRXRGRAGRTPPRRXWAEAVVAXAGXQAGISAIIPGWFSEISPMWP

SEQ ID NO: 606 - DNA, 462 bp, Zea mays
  misc_feature: Ceres CLONE 223862-F
  misc_feature: Encodes the peptide sequence at SEQ ID NO. 607
atccactaccgcagccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcsgaggcaaacggcgcactcgggccggccgagtcgggatgcaagggcacctccgtacctacatgaacgcggggattcccaagcggttcaaagaggatgaggagaaagaacagcttgcaaaagatctcgcaaaagattggaatgctgtgtttgawaggagcatcaatacattgtttttgactgaaatggtccgtggcttgatgctaactctcaagtacttctttgatagaaatgtcacaattaactatccgtttgagaagggtcctctgagcccccgcttccgtggtgaagcacgctctcagacggttatga

SEQ ID NO: 607 - protein, 117 aa, Zea mays
  misc_feature: Ceres CLONE 223862-F
  misc_feature: SWISSPROT Homolog: EC 1.6.5.3 NADH dehydrogenase (ubiquinone)
  misc_feature (15)..(15): Xaa is any aa, unknown, or other
  misc_feature (65)..(65): Xaa is any aa, unknown, or other
MASLLARQAAQALRXGKRRTRAGRVGMQGHLRTYMNAGIPKRFKEDEEKEQLAKDLAKDWNAVFXRSINTLFLTEMVRGLMLTLKYFFDRNVTINYPFEKGPLSPRFRGEARSQTVM

SEQ ID NO: 608 - DNA, 471 bp, Zea mays
  misc_feature: Ceres CLONE 223909-F
  misc_feature: Encodes the peptide sequence at SEQ ID NO. 609
gcgattctccatctctttccctgctgcgtttcgtcgttctcttccccttcttttcctcagccacttcgctccctccctagcagcaaaaacctccacgaatcgccgacactccaacccggaagagccaacgaggtgactccgcgccccggtcatgggtgacagccaatactccttctctcttaccaccttcagcccgtcgggaaagcttgtgcagatagagcacgcgctcacggctgtcggatccgggcagacctccctagggatcaaagctgccaacggtgtagtgattgccaccgagaagaaactgccttctattttagtggatgaaacatctgtgcaaaagattcaggcactaacaccaaatattggagttgtctatagtgggatgggtccagattttcgtgttctggtgagaaaaagtcgaaagcaggcacagcagtattatcggttgtacaaggagcatatacctgt

SEQ ID NO: 609 - protein, 106 aa, Zea mays
  misc_feature: Ceres CLONE 223909-F
  misc_feature: SWISSPROT Homolog: EC 3.4.25.1 Proteasome endopeptidase complex
MGDSQYSFSLTTFSPSGKLVQIEHALTAVGSGQTSLGIKAANGVVIATEKKLPSILVDETSVQKIQALTPNIGVVYSGMGPDFRVLVRKSRKQAQQYYRLYKEHIP

SEQ ID NO: 610 - DNA, 270 bp, Zea mays
  misc_feature: Ceres CLONE 223911-F
  misc_feature: Translation starting site: 86
  misc_feature (57)..(57): n is a, c, t, g, unknown, or other
  misc_feature (61)..(61): n is a, c, t, g, unknown, or other
  misc_feature (128)..(128): n is a, c, t, g, unknown, or other
gcgaaccctagagccgcaccagcacactcccgcagcagtagccgccgccgccgccgnygbncccagccgtagaaacaggaggaagatgccggcggggcacgggcttcggtcgcggaccggamtggttngcgcggacgttccgcaagaagggttacatcccggctcaccacgtacctgcrgmacctacaagatcggcgactacgtcgacgtcaaggtgaacggcgccgtgcacaaggggcatgccgcacaagttctaccacggccgcaccg

SEQ ID NO: 611 - DNA, 210 bp, Zea mays
  misc_feature: Ceres CLONE 223971-F
  misc_feature: Encodes the peptide sequence at SEQ ID NO. 612
  misc_feature (108)..(108): n is a, c, t, g, unknown, or other
  misc_feature (142)..(142): n is a, c, t, g, unknown, or other
aatcttgctctgaacgcattcctcccatctcccaagacctcctcagacccgagaagcgcmkkcggccatggacgccaccggcactggagctggagggaaggcgaagangggagcggccggtcgcaaggycggckgggccganggtaagaattcggtgacgaggtccgttgaaggccgggctccagttccccgtcggccgcatcgggcgct

SEQ ID NO: 612 - protein, 47 aa, Zea mays
  misc_feature: Ceres CLONE 223971-F
  misc_feature (14)..(14): Xaa is any aa, unknown, or other
  misc_feature (21)..(21): Xaa is any aa, unknown, or other
  misc_feature (23)..(23): Xaa is any aa, unknown, or other
  misc_feature (25)..(25): Xaa is any aa, unknown, or other
MDATGTGAGGKAKXGAAGRKXGXAXGKNSVTRSVEGRAPVPRRPHRA

SEQ ID NO: 613 - DNA, 398 bp, Zea mays
  misc_feature: Ceres CLONE 223981-F
  misc_feature: Encodes the peptide sequence at SEQ ID NO. 614
  misc_feature (83)..(83): n is a, c, t, g, unknown, or other
  misc_feature (84)..(84): n is a, c, t, g, unknown, or other
agattagcaggccgcctgckctcctcctttcccctcagcctcccctcctctccggtgtacgtctccgccgakatggccgcccnntccggcgactcccctcccttggtcgcgcgcttctcacgccggcgccggscggatgctctccgcggaggcctctgatgccctcgttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatggatggacatctactggggatccatatgctaatgtcggtgaagcaggacttacgtttga

SEQ ID NO: 614 - protein, 87 aa, Zea mays
  misc_feature: Ceres CLONE 223981-F
MLSAEASDALVEIKPGEIGMVSGIPEEHLRRKVLIYSPARTASQQGSGKVGRWKINFLSTQKWENPLMDGHLLGIHMLMSVKQDLRL

SEQ ID NO: 615 - DNA, 506 bp, Zea mays
  misc_feature: Ceres CLONE 223997-F
  misc_feature: Encodes the peptide sequence at SEQ ID NO. 616
  misc_feature (379)..(379): n is a, c, t, g, unknown, or other
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcmcttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggngcaggagctgcccggcgactgcggactctcgctgtcctacaacatcacccccgacatcgactgcgacaagatcgaatgaagggataatgttccctttaccagaatccatacgacgggatggtgatgt

SEQ ID NO: 616 - protein, 119 aa, Zea mays
  misc_feature: Ceres CLONE 223997-F
  misc_feature (28)..(115): Pfam Name: Tryp_alpha_amyl Pfam Description: Protease inhibitor/seed storage/LTP family
  misc_feature (40)..(40): Xaa is any aa, unknown, or other
  misc_feature (94)..(94): Xaa is any aa, unknown, or other
MKTTSSGIAVVLLVAMLAVHSALADISCSDVLNDLSPCLXFLQGKAAKPSESNNQCCDGVRALYAAADTRPDRQATCRCLKAAYVQVHAVLSAXQELPGDCGLSLSYNITPDIDCDKIE

SEQ ID NO: 617 - DNA, 395 bp, Zea mays
  misc_feature: Ceres CLONE 224051-F
  misc_feature: Encodes the peptide sequence at SEQ ID NO. 618
acatttcgactctcaactcccaaggtccctttttttttctcgatctggaagcgccgcagtagcagccatggacgtgagcggacaggcggtaaggcgaaaaagggcgcggcggggcgcaaggccggcgggcgacgaagaagtcggtgtcgcggtcctccagggccgggctgcagttccmcgtcagccgcgtcggrcgtacctcaaaaagggccggtacgcgcabgtaggcacgggtgcccccgtctacctcgccgccgtcctggagtacctcgcggccgaggtgctcgagctcgccggcaacgcgcaagggacaacaaggaagacgcgcatcattccgcgcmaagtgctcctcgcmatccgcaacgacgagggagctcgggcaagctsctggccgg

SEQ ID NO: 618 - protein, 109 aa, Zea mays
  misc_feature: Ceres CLONE 224051-F
  misc_feature (26)..(100): Pfam Name: Histone Pfam Description: Core histone H2A/H2B/H3/H4
  misc_feature (43)..(43): Xaa is any aa, unknown, or other
  misc_feature (52)..(52): Xaa is any aa, unknown, or other
  misc_feature (92)..(92): Xaa is any aa, unknown, or other
  misc_feature (107)..(107): Xaa is any aa, unknown, or other
MDVSGQAVRRKRARRGARPAGDEEVGVAVLQGRAAVPRQPRRXYLKKGRYAXVGTGAPVYLAAVLEYLAAEVLELAGNAQGTTRKTRIIPRXVLLAIRNDEGARASXWP

SEQ ID NO: 619 - DNA, 468 bp, Zea mays
  misc_feature: Ceres CLONE 224055-F
  misc_feature: Encodes the peptide sequence at SEQ ID NO. 620
  misc_feature (423)..(423): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgacgaagaagtcggtgtcgcggtcctccagggccgggctgcagtatccccgtcagccgcgtcagggcgtacctcaaaaagggccggtacgcgcabgttaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacgggggngttcctccccaacatccacactgtgctcctccccaagaaggtggc

SEQ ID NO: 620 - protein, 132 aa, Zea mays
  misc_feature: Ceres CLONE 224055-F
  misc_feature (32)..(101): Pfam Name: Histone Pfam Description: Core histone H2A/H2B/H3/H4
  misc_feature (6)..(6): Xaa is any aa, unknown, or other
  misc_feature (53)..(53): Xaa is any aa, unknown, or other
MDVSGXAGRRRRARPGARPAGDEEVGVAVLQGRAAVSPSAASGRTSKRAGTRXLGTGAPVYLAAVLEYLAAEVLELAGNAARDNKKTRIIPRHVLLAIRNDEELGKLLAGVTIAHGGVPPQHPHCAPPQEGG

SEQ ID NO: 621 - DNA, 153 bp, Zea mays
  misc_feature: Ceres CLONE 224094-F
aaaaagagaaaagcgcmscatgaagactactagctcgggcattgcagtcgtcctactggtggccatgctggcagtccattccgcgattggccgacatctcrtgctcmgacgtgctcaacgaactgtcgccagtgcctgcccttcctgcagggc

SEQ ID NO: 622 - DNA, 398 bp, Zea mays
  misc_feature: Ceres CLONE 224153-F
  misc_feature: Translation starting site: 151
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
atatcttcttcttggtccgccgtctccactccgcgttccctggctccctgcgttgcgtcttgggggagagagagaagtgggagacccgcgagaggctgccgtgtagggactagggaccgtagagtaagcgacasraggagtgagagggggatggccgggatcgggccgatcagacargactgggagccggtggttgtgcggaagaaggcacccaccgccgctgccaagaaggatgagaaggccgtcaacgccgcgcgccgctccggnnnagtatcgagaccatgaagaagtacaacgctggtatgaacaaggcggcgtccagcggcacatccctcaacaccaagcgcctcgacgatgacacagagaacctcgcccatgagcgagttccaagtgacctg

SEQ ID NO: 623 - DNA, 176 bp, Zea mays
  misc_feature: Ceres CLONE 224155-F
cagagtttccgtgccgtagcaacagacaagggagagttgggagactagcgcaacaggacagcgcacggaaagcgaggggaggggaaacggagagggcgcatcggacggcggcgagatgctagcggtgttcgatcccacggtggccaagtgcccggaggtctccgcagccccccggt

SEQ ID NO: 624 - DNA, 432 bp, Zea mays
  misc_feature: Ceres CLONE 224194-F
  misc_feature: Encodes the peptide sequence at SEQ ID NO. 625
  misc_feature (370)..(370): n is a, c, t, g, unknown, or other
awagaaaaaggaaattttcttgggcgttcttcggcttcgttgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaagccaaaatccaggacaagggagggattcccccagatcaacagcgactgatattcgctgggcaagcagctggaggatggacgcamgctggctgaactacaacatccaaaaggggtcaactcttcatttggtcctcaggcttargggtggaacatgatcaaggtccaaactctcactggggaagngatcgagatcgacattgaacccactggactcgattgacaggatcaaggagcgtgttgaagag

SEQ ID NO: 625 - protein, 57 aa, Zea mays
  misc_feature: Ceres CLONE 224194-F
  misc_feature (6)..(58): Pfam Name: ubiquitin Pfam Description: Ubiquitin family
  misc_feature (55)..(55): Xaa is any aa, unknown, or other
MQIFVKTLTGKTITLEVESSDTVDNVKAKIQDKGGIPPDQQRLIFAGQAAGGWTXAG

SEQ ID NO: 626 - DNA, 293 bp, Zea mays
  misc_feature: Ceres CLONE 224207-F
  misc_feature: Encodes the peptide sequence at SEQ ID NO. 627
  misc_feature (137)..(137): n is a, c, t, g, unknown, or other
aatacatttcgactctcaactcccaaggtccctttttttttctcgatctggaagcgccgcagtagcagccatggacgtgagcggacaggcggtaaggcgaagaagggcgcggcggggcgcaaggccggcgggccgancgaagaagtcggtgtcgcggtcctccagggccgggctgcaattccccgtcagccgcgtcgggcggtacctcaaaaagggccggtacgcgcabgtagggcacgggtgccccgtctacctcgccgccgtcctggagtacctcgcggccgaggtgctcg

SEQ ID NO: 627 - protein, 74 aa, Zea mays
  misc_feature: Ceres CLONE 224207-F
  misc_feature (23)..(23): Xaa is any aa, unknown, or other
  misc_feature (53)..(53): Xaa is any aa, unknown, or other
MDVSGQAVRRRRARRGARPAGRXKKSVSRSSRAGLQFPVSRVGRYLKKGRYAXVGHGCPVYLAAVLEYLAAEVL

SEQ ID NO: 628 - DNA, 399 bp, Zea mays
  misc_feature: Ceres CLONE 224236-F
  misc_feature: Encodes the peptide sequence at SEQ ID NO. 629
tccgttcacaccctgtgcgcgcgggctctcttcgtcgtgcggcaactgcgcgaccgccgacgcccgacggcatkgtgcaccaggtcttcgtcgaccccttcgcaaggcctcggttccatccttcgccggavvccgcccgtcaacaggacttgatctactactcactagcggtgtagaggcgaagagaagaacttgaccatgagcagcataggcacaggttacgatttgtctgtcacgactttctccccagatggtcgtgtcttccaggtcgagtatgccaccaaggccgtcgacaacagcgggacttgttgtggggatcaagtgcaaagattgggcattgtcctggggtgtcggagaagctkggtaacctcaaagatgatgctggaaggwtcaaaccga

SEQ ID NO: 629 - protein, 67 aa, Zea mays
  misc_feature: Ceres CLONE 224236-F
  misc_feature: SWISSPROT Homolog: EC 3.4.25.1 Proteasome endopeptidase complex
  misc_feature (55)..(55): Xaa is any aa, unknown, or other
MSSIGTGYDLSVTTFSPDGRVFQVEYATKAVDNSGTCCGDQVQRLGIVLGCRRSXVTSKMMLEGSNR

SEQ ID NO: 630 - DNA, 481 bp, Zea mays
  misc_feature: Ceres CLONE 224238-F
  misc_feature: Pfam Name: ELFV_dehydrog Pfam Description: Glutamate/Leucine/Phenylalanine/Valine dehydrogenase
  misc_feature: SWISSPROT Homolog: EC 1.4.1.3 Glutamate dehydrogenase (NAD(P)(+))
atgcgctacagtggtttgtagtttagtctactcaacccatggtgttgaaacttgaccatacttgtctcaatgagactttggagtgaaccaaatgagcttatgttcctatatgactactagctagaagttagagcctagatgatggctgcttctgttggcgtgaaagctcgagtgctcctaaatggtcgtcgtattagctgatacgacatcgacccgatgcaatagataatattgtttacacgcgcgagtccaaaattgttggctttgggtcggagcagttaacgcgagaagtgtattttatcacttctgagtgcaamcttttttttattatttttycgagcttctgcctcttgcatatgttgtagattctcgtcgagaagggagtagtagtattacctgatatctatgctaattcaggtggtgtggtcgttagctactttaattgagtgagttcagaacattcaaggtttcatgtgggccg

SEQ ID NO: 631 - DNA, 291 bp, Zea mays
  misc_feature: Ceres CLONE 224275-F
  misc_feature: Encodes the peptide sequence at SEQ ID NO. 632
aggcctcccctccctcctccccgtcgccaaccawcctccaacccbbagccgatcgcgtcggagatgctgggcgtcgcgcggaggcggctcggatccggatgcgtgctcgcccagctggcgcaggcctccgccccgccgccgctcccgccaggacctactccgccgcggccaaggagataactgtacgggaagcattgaataccgcattagatgaagaaatgtcaggcagacccttctgttttcttgaatgggagaagaggttkgcgaaataccaaggtgcatacaagatat

SEQ ID NO: 632 - protein, 64 aa, Zea mays
  misc_feature: Ceres CLONE 224275-F
  misc_feature: SWISSPROT Homolog: EC 1.2.4.1 Pyruvate dehydrogenase (acetyl-transferring)
  misc_feature (55)..(55): Xaa is any aa, unknown, or other
MRARPAGAGLRPAAAPARTYSAAAKEITVREALNTALDEEMSGRPFCFLEWEKRXAKYQGAYKI

SEQ ID NO: 633 - DNA, 317 bp, Zea mays
  misc_feature: Ceres CLONE 224305-F
  misc_feature: Encodes the peptide sequence at SEQ ID NO. 634
  misc_feature (183)..(183): n is a, c, t, g, unknown, or other
accagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggccgctccatccgcagccccgngcagcgccgtggtggccaagtacggcgacaagagcgtctactttgaacctcggcgacatcggcaacacaccggacagtgggacctctacggctctgacgcgccctcgacctacaacccgctacagagcaagttc

SEQ ID NO: 634 - protein, 85 aa, Zea mays
  misc_feature: Ceres CLONE 224305-F
  misc_feature (5)..(85): Pfam Name: PSI_PsaH Pfam Description: Photosystem I reaction centre subunit VI
  misc_feature (41)..(41): Xaa is any aa, unknown, or other
MASLAAVSVKPVAIKGLAGSSISGRKLAVARPSAAPSAAPXSAVVAKYGDKSVYFEPRRHRQHTGQWDLYGSDAPSTYNPLQSKF

SEQ ID NO: 635 - DNA, 219 bp, Zea mays
  misc_feature: Ceres CLONE 224315-F
  misc_feature (79)..(79): n is a, c, t, g, unknown, or other
  misc_feature (80)..(80): n is a, c, t, g, unknown, or other
ccgcacaaacgcgtcgcatccgctccacaggatcctctgcgccaccgcaaccgtgtgaccgcccgtgctctgccggcgnncccgatccgccgacccgtcccagccccgctcgcagccatgtcgccgtcggagccgacgcgggaggagagcgtgtacatggccaagcttgcggasaggcggasgagtacgaggagatggtcgagttcatggagcgcgtcg

SEQ ID NO: 636 - DNA, 483 bp, Zea mays
  misc_feature: Ceres CLONE 224329-F
  misc_feature: Encodes the peptide sequence at SEQ ID NO. 637
  misc_feature (255)..(255): n is a, c, t, g, unknown, or other
atcatcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgamgccccgagggccgtcttccccagcatcgtggggcgcccgcgccacactggtgtcatggtcgggatggggcanaaggacgcctacgtcggtgacgacggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgaccagatcatgttcgag

SEQ ID NO: 637 - protein, 124 aa, Zea mays
  misc_feature: Ceres CLONE 224329-F
  misc_feature: SWISSPROT Homolog: EC 2.7.10.2 Non-specific protein-tyrosine kinase
  misc_feature (25)..(25): Xaa is any aa, unknown, or other
  misc_feature (49)..(49): Xaa is any aa, unknown, or other
MPRISSPSSATTELAWSRLGSPATXPRGPSSPASWGARATLVSWSGWGXRTPTSVTTAQSKRGILTLKYPIEHGIVSNWDDMEKIWHHTFYNELRVAPEEHPVLLTEAPLNPKANREKMTRSCS

SEQ ID NO: 638 - DNA, 497 bp, Zea mays
  misc_feature: Ceres CLONE 224410-F
  misc_feature: Encodes the peptide sequence at SEQ ID NO. 639
acacatcaccagcgcacagctctcctcatcggcgcacccgagctcgccctctccttcctcatcgaggcccgagtcctgctctgatggcgactgacgtggctgagactcccgcgccgwrkvbgtggatgcggcccctgaggcgcccgcggacaccccggcggcgcatgcatgttgacgcgaacgcgagccaaggccaagaaggccacagcgccgaagaagcgcgccascccgacccatccgccgtacgccgagatggtctcggaggcgatcgcgtcgctcaaggagaggacggggtccagcagctttgctattgccaagttcttggaggacaagcacaaggacaagctcccgcccaacttccgcaagcttctgaacgttcagctcaagaagctcgtcgccggcggcaaggctgaccaaggtgaagaactcgtacaagctgtcgtccgccaccaagccaaaggccgccccgaagaagaccaagaccggcgtgaagaagc

SEQ ID NO: 639 - protein, 109 aa, Zea mays
  misc_feature: Ceres CLONE 224410-F
  misc_feature (22)..(86): Pfam Name: Linker_histone Pfam Description: linker histone H1 and H5 family
  misc_feature (20)..(20): Xaa is any aa, unknown, or other
MLTRTRAKAKKATAPKKRAXPTHPPYAEMVSEAIASLKERTGSSSFAIAKFLEDKHKDKLPPNFRKLLNVQLKKLVAGGKADQGEELVQAVVRHQAKGRPEEDQDRREE

SEQ ID NO: 640 - DNA, 158 bp, Zea mays
  misc_feature: Ceres CLONE 224417-F
  misc_feature (74)..(74): n is a, c, t, g, unknown, or other
  misc_feature (119)..(119): n is a, c, t, g, unknown, or other
  misc_feature (143)..(143): n is a, c, t, g, unknown, or other
acgctagctgaaccctagccggcggatctccgcgggcggcagtcaggagtggaggcgtkgtcgcacgggcgagntcgcaataggagaggctcagagagatkgggcggccttacgcggtnaaggggcggaagaagaagcgcaantcgaggaggcggcgg

SEQ ID NO: 641 - DNA, 391 bp, Zea mays
  misc_feature: Ceres CLONE 224424-F
  misc_feature: Translation starting site: 74
  misc_feature (318)..(318): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcabkttaggcacgggtgccccgtctacctcgccgccgtcctggagtacctcgcggccgaggtgctcgagctcgccggcaacgcscaaggggncaacaagaagacgcgcatcattccgcgccamgtgctcctcgccatccgcaacgacgaggagytcggcaagctg

SEQ ID NO: 642 - DNA, 372 bp, Zea mays
  misc_feature: Ceres CLONE 224473-F
  misc_feature: Encodes the peptide sequence at SEQ ID NO. 643
  misc_feature (171)..(171): n is a, c, t, g, unknown, or other
  misc_feature (172)..(172): n is a, c, t, g, unknown, or other
  misc_feature (304)..(304): n is a, c, t, g, unknown, or other
  misc_feature (351)..(351): n is a, c, t, g, unknown, or other
atcattagawaacgacgtctcgccgttcttcgtcttcagatctagggttctctcgtgctctgttctcatcttctgctcgctggtgtcccctctctctcacccatggcttcggcggcggcggcaactcaggtggggacttacttcctgcggaactactacaacctgctgcannaggcccccgatgtcgtccacccagttctacagcgacsagcaccatggtmcgcgtcgacgacctcaccggcacgaccgcggctgccaacaacatgatggacatacactcggtcatcatgtctttgaacttcancccaattgagatcaagactgccaattttgtgaactcatggggcgatngggtgctagttatggtctctg

SEQ ID NO: 643 - protein, 52 aa, Zea mays
  misc_feature: Ceres CLONE 224473-F
  misc_feature (30)..(30): Xaa is any aa, unknown, or other
  misc_feature (46)..(46): Xaa is any aa, unknown, or other
MVRVDDLTGTTAAANNMMDIHSVIMSLNFXPIEIKTANFVNSWGDXVLVMVS

SEQ ID NO: 644 - DNA, 152 bp, Zea mays
  misc_feature: Ceres CLONE 224498-F
  misc_feature (43)..(43): n is a, c, t, g, unknown, or other
gacacacgccgctgctccaagaaaccaccgcctagcccaaccnhacaagcgcgcgaggcaggagagagagagagagagagaggcggggagcaaaacaatggaggggaaagaggaggacgtgcgcctgggcscaacaagttctcggagcgcca

SEQ ID NO: 645 - DNA, 721 bp, Zea mays
  misc_feature: Ceres CLONE 224525-R
  misc_feature (459)..(459): n is a, c, t, g, unknown, or other
  misc_feature (579)..(579): n is a, c, t, g, unknown, or other
  misc_feature (580)..(580): n is a, c, t, g, unknown, or other
caaattgggtaccgggccccccctcgaggtcgacggtatcgataagcttttttttttttttttttgttcatattatttctttatttttccggtcaattgtccatgtaacaagggatgtaccatggttcacttttgacataatatcatctttgtataattgtttcgctgggtctgaataagcaaacgggctaaaaccgatcatgtcatgtggagcaactgcttgaagttgatgggcgtagtgtattgggccggcccatcgcagaaagcctgggctctgagcgccgcggcccgctcagaagggtgcacgctgtcccagaagtagtaaaggccgcggtcggcgcagagcgtcacgttcagcgcgcagggcgcctcggcgcctagccggccgccgccgcagcacgcgttggcgacgtccgtgaaccccgacgccagcgggtgggctaaggtgtccgccatgangccgagcgagtcggccaggcagtaggagaggccggcagcccggaacctagaggagggggacgcgatgcctgctagcaggtagcgcagcgcgacgttgaagccgggcgcgaagccgttccnngtctacgggccacgcgcccgtggggttcaagcaccgctcctacgggcagccaccctggggagccccacgtttgaaaacggccagcttcccacgccccaaccggtgaagcccctgaagcgcgccaataatttggaaaaaagc

SEQ ID NO: 646 - DNA, 245 bp, Zea mays
  misc_feature: Ceres CLONE 224530-F
gttccctttcgtggactgttttggaaggcgttgcgatgagacgctgcggtggcggcggcgaggagtgcatccctcggcgatgagcagaatcaccaccggatcttaatctcccttgcctcgtttgcggcgagcttgcgctgtcggcggcggcgcaccccccctccccttcccccggtgcttccgtctgctggctggactcagttcttccaactcggcccttaacaagaaagaacgacgaccatgcc

SEQ ID NO: 647 - DNA, 93 bp, Zea mays
  misc_feature: Ceres CLONE 224545-F
aataagaaaaatactcccgtgttcttcgaccggcggcggtggtgcgamgaggcggtaagggagacgagatgagggggacgaagcggccgctcg

SEQ ID NO: 648 - DNA, 147 bp, Zea mays
  misc_feature: Ceres CLONE 224558-F
atgggtttcctcctcccgccgccacttgccgccccacgagcccattcccctcagcccttcaccatctccggcggccgcagtggcatcagcagctccggctcacgcgcagtgaaggaacgacaatatggcgaccatcgtaaacacgac

SEQ ID NO: 649 - DNA, 164 bp, Zea mays
  misc_feature: Ceres CLONE 224562-F
ctttttccaaaccggcaaatcctcagatccgccccctcctccgcctccgcctcctgtaccctcacgcggtgcttccacagccctcccacctccgaatccagatccgccgccaccaactcctgcttctcacctcctaggctgcttcgcgcgacaacctccgcgag

SEQ ID NO: 650 - DNA, 231 bp, Zea mays
  misc_feature: Ceres CLONE 224564-F
  misc_feature (98)..(98): n is a, c, t, g, unknown, or other
akaaaagagaaggtggaagaacagcaggagagtcggaggaagcaagcttgcccatacgctggtacttatgtgctgatactactgcagccgcgcysagnagaagaggagtgggagcacgtggagccaaaggggcgattctttgcttggccttcatttctcgcctcttcccgcatctcgagttgtcgtgattaacaagacagcaagacctcggcggcgggcaaacagtcgagc

SEQ ID NO: 651 - DNA, 155 bp, Zea mays
  misc_feature: Ceres CLONE 224573-F
  misc_feature (146)..(146): n is a, c, t, g, unknown, or other
ctcaaacaaaaaccctagccgccgcgccgccccgctcyctagtggtgctccctcccccaccactgcagctccgtcccggcggccccaagagttgcggcgaggatgaacgtgaagggcggcacggattccggtacccccgccgggcncagcgcgct

SEQ ID NO: 652 - DNA, 301 bp, Zea mays
  misc_feature: Ceres CLONE 224580-F
  misc_feature: Translation starting site: 62
  misc_feature: Pfam Name: Exo_endo_phos Pfam Description: Endonuclease/Exonuclease/phosphatase family
  misc_feature (52)..(52): n is a, c, t, g, unknown, or other
  misc_feature (53)..(53): n is a, c, t, g, unknown, or other
  misc_feature (122)..(122): n is a, c, t, g, unknown, or other
gttcggttccttctcgtaccgagccgcgggtagccagccaaccgccgacgcnncacaagcgatgaagcgcttcttccagccagtgcccaaggacggctccccgtcaaagaagcggctagcgngtgctgctgaaccgggcgacggccccacatcagccggtgccgccaccssctggcggggatgtagaggggaggcccaccgaggagccgttcaagttcctgacgtggaacgccaacagcctgctcctccggatgaagagcgactggcctgctttctcgcagctcctcgcccgccttgaccc

SEQ ID NO: 653 - DNA, 262 bp, Zea mays
  misc_feature: Ceres CLONE 224587-F
  misc_feature: Encodes the peptide sequence at SEQ ID NO. 654
  misc_feature (113)..(113): n is a, c, t, g, unknown, or other
aaacaaagaaagaaaaaatcgagaggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagcgcgcggcggcgaagcccaacgccaagaactcccaggacgggctcaccccggagcagcgccgcgagagggacaagaaagctctggaggagaaggcggccaag

SEQ ID NO: 654 - protein, 46 aa, Zea mays
  misc_feature: Ceres CLONE 224587-F
  misc_feature (1)..(46): Pfam Name: 4F5 Pfam Description: 4F5 protein family
MTRGNQRDRDRERAAAKPNAKNSQDGLTPEQRRERDKKALEEKAAK

SEQ ID NO: 655 - DNA, 201 bp, Zea mays
  misc_feature: Ceres CLONE 224595-F
agaacaggcctatgttcccatcgagtcgagtcgagacgagaccgtcctccgcccgagtctcgctcgctagctagggtttccaccaatggcggcgccaccacctcccgccgcgtrhccggcgcgcgcgcaacatggacgacgagaacctaaccttcgagacctccccgggggtcgaggtcgtcagcaagcttcgacccagat

SEQ ID NO: 656 - DNA, 136 bp, Zea mays
  misc_feature: Ceres CLONE 224613-F
gcaaacaccccgtccactgcacagccaattccccatcgcgatargcccgttcgcacgaattcactgctctgctttcaccccccgcattcgaaccttcacccccgatcttgatcgaatcgaaggctgcggcggcgat

SEQ ID NO: 657 - DNA, 478 bp, Zea mays
  misc_feature: Ceres CLONE 224698-F
  misc_feature: Encodes the peptide sequence at SEQ ID NO. 658
  misc_feature (73)..(73): n is a, c, t, g, unknown, or other
  misc_feature (81)..(81): n is a, c, t, g, unknown, or other
acaacaacaacaaccatctccaacgcagcaagcagacagaaggacaggcaggcagcgagtgcaaccgcgaganatcagcrntgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtcgcaaggacatggaaggtagaggcgatgccaacgttcgtgctggtcaaggatgggaaggaggtaggccgtgtgattggggctaagaaggacgagcttgagakgaagatcaggatgttcgtcacgtcatctttcctcgt

SEQ ID NO: 658 - protein, 158 aa, Zea mays
  misc_feature: Ceres CLONE 224698-F
  misc_feature (48)..(150): Pfam Name: Thioredoxin Pfam Description: Thioredoxin
  misc_feature: SWISSPROT Homolog: EC 1.8.1.9 Thioredoxin-disulfide reductase
  misc_feature (24)..(24): Xaa is any aa, unknown, or other
  misc_feature (27)..(27): Xaa is any aa, unknown, or other
  misc_feature (147)..(147): Xaa is any aa, unknown, or other
NNNNHLQRSKQTEGQAGSECNREXSAXGSFFSTLVTPPPAADDPNCAVVAAHSKATYDEQWAAHKSSSKLMVIDFSASWCGPCRFIEPAFKELASRFTDAIFVKVDVDELAEVARTWKVEAMPTFVLVKDGKEVGRVIGAKKDELEXKIRMFVTSSFL

SEQ ID NO: 659 - DNA, 329 bp, Zea mays
  misc_feature: Ceres CLONE 224725-F
  misc_feature (36)..(36): n is a, c, t, g, unknown, or other
  misc_feature (109)..(109): n is a, c, t, g, unknown, or other
  misc_feature (110)..(110): n is a, c, t, g, unknown, or other
  misc_feature (133)..(133): n is a, c, t, g, unknown, or other
gtcacagcgagtaccgagtaggagcaaccgcttgcntcagacgcacactgacggagagtgatcactgatttctggtcatggcaaccgtaactgaggawgttgctccggnngtcaccgtctccgaggagccggndccggaagcggcgaaggaggtggtggagaagccggagaggggaagaagcccgacgaggagggtgacgagaggaagaaggccgaccccgccgccgagaaggagaagaaggcgaggaagccgcggacagggaagcccaagtccgccgggctgcaccacccgccctatttcgagatgatcaaggaggcgatcctgtcgc

SEQ ID NO: 660 - DNA, 609 bp, Zea mays
  misc_feature: Ceres CLONE 224759
  misc_feature: Encodes the peptide sequence at SEQ ID NO. 661
gtgggtcgtgctcgtgcagctctaggctttttttgaggaagcggtaagcgcggagggaggacgggagagagagataggcgtgccttcgtcgtccgtgccggtgcgtggcgtggtggccgtgccgaccgtccgtccaccccctctctcttcccggcgccggcgacagcgggagggactccctgggaggaatggcsgtggtgagggctccgctcggcgcggtggcggtggccgctctcgtcgtcgccatcttcatgccggccgccgcagcggcgcaggcaccggcgcccgcgcccaccagcgacggcacatcaatcgacctggggatcgcgtacatccttatgctggtggccctggtgctcacctacctgatccacccgctggacgcgtcctccccctacaagctcttttaatctctgctccttttcgtttggtcatgcggttatgggtgctataggaattttaggtgcgcgagatgtttaggtgaggttgggaggtttagaatgatgatgattgcaatcatttgatcttggtatgtatccaaggctccaagccgttggtgttctgattggtttgtaattgtatcggattccatcaaaaaaaaaaaaaaaa

SEQ ID NO: 661 - protein, 73 aa, Zea mays
  misc_feature: Ceres CLONE 224759
  misc_feature (9)..(62): Pfam Name: DUF1070 Pfam Description: Protein of unknown function (DUF1070)
  misc_feature (2)..(2): Xaa is any aa, unknown, or other
MXVVRAPLGAVAVAALVVAIFMPAAAAAQAPAPAPTSDGTSIDLGIAYILMLVALVLTYLIHPLDASSPYKLF

SEQ ID NO: 662 - DNA, 93 bp, Zea mays
  misc_feature: Ceres CLONE 224768-F
  misc_feature (43)..(43): n is a, c, t, g, unknown, or other
  misc_feature (44)..(44): n is a, c, t, g, unknown, or other
agccaactgcgcgcgtcggcgttaccccttcctcctcgacgcnnctgccgtgagcgggatcatccgcctgaaccgggtcgaccgcttcgttcc

SEQ ID NO: 663 - DNA, 359 bp, Zea mays
  misc_feature: Ceres CLONE 224783-F
  misc_feature: Translation starting site: 74
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctrcagttccccgtcagccgcgtcgggcgtacctcaaaaagggccggtacgcgcabgttaggcacgggtgcccccgtctacctcgccgccgtcctggagtacctcgcggcccgagtgctcgagctcgccggcaacgcscaagggacaacaagaagacgcgcatcattcmgcgccacgtgctcctcg

SEQ ID NO: 664 - DNA, 474 bp, Zea mays
  misc_feature: Ceres CLONE 224807-F
  misc_feature: Translation starting site: 304
  misc_feature (376)..(376): n is a, c, t, g, unknown, or other
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttngaggtggtggcagcagtaggggcagaaggcagcgaaggggagaggatgtggttcatcctctgaaggtttctctggaggatttgtacaatggcacatcg

SEQ ID NO: 665 - DNA, 140 bp, Zea mays
  misc_feature: Ceres CLONE 224824-F
  misc_feature (14)..(14): n is a, c, t, g, unknown, or other
  misc_feature (97)..(97): n is a, c, t, g, unknown, or other
tctcctgccgccgncggcgstcccgctcccagctcgtgttccgcttcttgcagccgtcgccgcgaagctccaragaamttccgtcaacatggggaanacacgtggtatgggagccgggcgcaactcaagaaccamcgcag

SEQ ID NO: 666 - DNA, 768 bp, Zea mays
  misc_feature: Ceres CLONE 224840-R
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (285)..(285): n is a, c, t, g, unknown, or other
nnnnnnnnnnnnnnnnnnnnnnnnnnnnnnnnnnnnnnnnttttnnnnnnnnnnnnnnnnnnnnnnnnttttnnnnntttttccaatgggtaccgggccccccctcgaggtcgacggtatcgataagcttttttttttttttttttggcttagaaatgtacattcatattcatatatatagagagagacaagaagattgttcaacagggtaggatacatcagtatagggcaatttgccgtatcaagtcacgtcccagggcccacccatcaaacagacgctaatcncaaacagtttggggtggggcagctcgggcgacactgcgacagaagcttagatggatctaccttctctgtacacgccggaagggtcggcgttctggacgatccacgggtgttcaagaaccttgtggagaggcagccgctgcgccgagctcttgaccagcatctgaagaaatcagtcctttgcggcaggtgaaacgaatgggtttcagtggggaacttcaagtcgactttcactatcccttctgtagggtttctgagtgcgtccttaacctttcaaaaaggtgggaaccccccctaagggaaaccctttgccccagaaacacccagggccttccttattattcaaaccagggggaaaaccaggttctggcccttctccccacccatttttccaggggggggcgggggtaaaatcccaaaagtttccccccccacaataggtccccgcgcccccttcccgcctttttaaaaaagggggtgtggccc

SEQ ID NO: 667 - DNA, 164 bp, Zea mays
  misc_feature: Ceres CLONE 224853-F
ctctttccaaaccggcaaatcctcagatccgccccctcctccgcctccgcctcctgtaccctcacgcggtgcttccacagccctcccacctccgaatccagatccgccgccaccaactcctgcttctcacctcctaggctgcttcgcgcgacaacctccgcgag

SEQ ID NO: 668 - DNA, 223 bp, Zea mays
  misc_feature: Ceres CLONE 224870-F
  misc_feature: Encodes the peptide sequence at SEQ ID NO. 669
  misc_feature (58)..(58): n is a, c, t, g, unknown, or other
ctcacttcctctccctccctcactcggccaaagctgactacagcctacaagcgavttnagaagagctcttcccgatagccatggccaagcccccgcttcaaacggctgcgatcatcctcctcgtactcctctcggccgcgtcgtgcctccacaccgtcgatgccgccactttagggttctgttggggcaagtgcagcgttcggtgcgcgggggcgaccgcggg

SEQ ID NO: 669 - protein, 47 aa, Zea mays
  misc_feature: Ceres CLONE 224870-F
MAKPPLQTAAIILLVLLSAASCLHTVDAATLGFCWGKCSVRCAGATA

SEQ ID NO: 670 - DNA, 447 bp, Zea mays
  misc_feature: Ceres CLONE 224885-F
  misc_feature: Encodes the peptide sequence at SEQ ID NO. 671
  misc_feature (315)..(315): n is a, c, t, g, unknown, or other
  misc_feature (390)..(390): n is a, c, t, g, unknown, or other
aggatttgcaacccatttctctcctcgactcccacaacacggtccgtacggtaaagagagagaaggtgggagtggaatcgacaggggaaaaccaagcctgcgtttcagagacaactcaggcggcgcgatggcgatggcggcgctgcgacsgaggggaggcgcctcctcctctcccaccaccgtccccaacccgtcttcggcggccgcttccgctgcggtgacgsgatcctccgccatgtcgcaaccggagatggctccacttggtgcacgttctatttcaactcaagttgtgaggaaccggatgaagagtatcanaaacatccagaagatcacaaaggctatgaagatggttgcagcatcaaagcttcgggctgttcagacgaggactgnwaattcacgcggcttgtggcagccgttcaccgcccttcttggggacgctcctagtgt

SEQ ID NO: 671 - protein, 106 aa, Zea mays
  misc_feature: Ceres CLONE 224885-F
  misc_feature: SWISSPROT Homolog: EC 3.6.3.14 H(+)-transporting two-sector ATPase
  misc_feature (8)..(8): Xaa is any aa, unknown, or other
  misc_feature (33)..(33): Xaa is any aa, unknown, or other
  misc_feature (63)..(63): Xaa is any aa, unknown, or other
  misc_feature (88)..(88): Xaa is any aa, unknown, or other
MAMAALRXRGGASSSPTTVPNPSSAAASAAVTXSSAMSQPEMAPLGARSISTQVVRNRMKSIXNIQKITKAMKMVAASKLRAVQTRTXNSRGLWQPFTALLGDAPS

SEQ ID NO: 672 - DNA, 284 bp, Zea mays
  misc_feature: Ceres CLONE 224916-F
  misc_feature: Encodes the peptide sequence at SEQ ID NO. 673
  misc_feature (192)..(192): n is a, c, t, g, unknown, or other
aaaaacctctgctcgggcctagggtttcctcccagtcgtcatcgcttggcgtccgctcagcccgccgccagagagttcaggagagtttcgagaagctgaaatggctcctaaagctgctcctgccaagaagggtgatgccaagacccaggccttgaaggttgccaaggctgtgaagatctgggtcagtaaaanagaccaagaagatccgcacgtcctgacatttcaccgccccaagaccctgaagaaggctagggaccccagtacccaagaatcagcactaccgg

SEQ ID NO: 673 - protein, 61 aa, Zea mays
  misc_feature: Ceres CLONE 224916-F
  misc_feature (31)..(31): Xaa is any aa, unknown, or other
MAPKAAPAKKGDAKTQALKVAKAVKIWVSKXDQEDPHVLTFHRPKTLKKARDPSTQESALP

SEQ ID NO: 674 - DNA, 292 bp, Zea mays
  misc_feature: Ceres CLONE 224940-F
  misc_feature: Encodes the peptide sequence at SEQ ID NO. 675
  misc_feature (73)..(73): n is a, c, t, g, unknown, or other
aattccttcactgccagtcttgcatcccgtccccgtccgcgccggccgacgccgccttttcgtccccgcgtcntcgcgtctccactgagcgtgcgtgtcaccggcgggaggcaagggcaggcggtggtggcgatggcgtccgctgacsgcgcttggsgggatcgctcctccawccgcgtcatccccgacttccccaagccagggatcatgttccaggacatcacgacgttgctgctcgatcccaaggcgttccgtgacaccatcgacctctttgtcgagcggtacaaggacc

SEQ ID NO: 675 - protein, 53 aa, Zea mays
  misc_feature: Ceres CLONE 224940-F
  misc_feature: SWISSPROT Homolog: EC 2.4.2.7 Adenine phosphoribosyltransferase
  misc_feature (6)..(6): Xaa is any aa, unknown, or other
  misc_feature (9)..(9): Xaa is any aa, unknown, or other
  misc_feature (14)..(14): Xaa is any aa, unknown, or other
MASADXAWXDRSSXRVIPDFPKPGIMFQDITTLLLDPKAFRDTIDLFVERYKD

SEQ ID NO: 676 - DNA, 256 bp, Zea mays
  misc_feature: Ceres CLONE 224947-F
  misc_feature: Encodes the peptide sequence at SEQ ID NO. 677
  misc_feature (129)..(129): n is a, c, t, g, unknown, or other
  misc_feature (186)..(186): n is a, c, t, g, unknown, or other
gaygcgcaacccaaagcaaacgcaccggctcgagccaatccaccacccagccatgcctcccaagcgcaagttccccggcgacgattgctccctgccgcggggtccccgaggaagacgcggacatggttnctgctgctgctgcagggaagcgggcaacggagcctgctccggcgaaggcagtgccgnccaagaaggaagacgaggcggcggttgccgagttgaaagggaggaagaggggcaagaaggaagccgaggc

SEQ ID NO: 677 - protein, 83 aa, Zea mays
  misc_feature: Ceres CLONE 224947-F
  misc_feature (42)..(42): Xaa is any aa, unknown, or other
  misc_feature (61)..(61): Xaa is any aa, unknown, or other
ATQSKRTGSSQSTTQPCLPSASSPATIAPCRGVPEEDADMVXAAAAGKRATEPAPAKAVPXKKEDEAAVAELKGRKRGKKEAE

SEQ ID NO: 678 - DNA, 469 bp, Zea mays
  misc_feature: Ceres CLONE 224971-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctga

SEQ ID NO: 679 - DNA, 448 bp, Zea mays
  misc_feature: Ceres CLONE 225013-F
  misc_feature: Encodes the peptide sequence at SEQ ID NO. 680
  misc_feature (72)..(72): n is a, c, t, g, unknown, or other
  misc_feature (73)..(73): n is a, c, t, g, unknown, or other
  misc_feature (193)..(193): n is a, c, t, g, unknown, or other
  misc_feature (217)..(217): n is a, c, t, g, unknown, or other
  misc_feature (418)..(418): n is a, c, t, g, unknown, or other
atttttttcttccccatcttggagaagaagaaggcccgacgccctcgccgctgccaccaaaatcgcacgcgnnccccaaagatccccaaaccctacacccgcccgccggscactcggggaccgtcgaatcgagcaggttgacggaggagaggaagcctcgaagatgttccggaaccagtacgacaccgacgtnhcgacatggagcccccaggggcgnctgttccaggtggagtacgccatggaggccgtcaagcagggctcagcctgcgtcgggctccggtccagcacccacgccgtcctcgccgccgtcaacaagcccgcctccgagctctcctcctaccagcggaaggtgttccgcgtcgctgaccacgccggggtcgcgctcgccggcctcaccgccgacggcgcgttctctcgngattcctccgcaacgagtgcatcaaccact

SEQ ID NO: 680 - protein, 95 aa, Zea mays
  misc_feature: Ceres CLONE 225013-F
  misc_feature: SWISSPROT Homolog: EC 3.4.25.1 Proteasome endopeptidase complex
  misc_feature (11)..(11): Xaa is any aa, unknown, or other
MFRNQYDTDVXTWSPQGRLFQVEYAMEAVKQGSACVGLRSSTHAVLAAVNKPASELSSYQRKVFRVADHAGVALAGLTADGAFSRDSSATSASTT

SEQ ID NO: 681 - DNA, 411 bp, Zea mays
  misc_feature: Ceres CLONE 225048-F
  misc_feature: SWISSPROT Homolog: EC 2.7.7.6 DNA-directed RNA polymerase
  misc_feature (96)..(96): n is a, c, t, g, unknown, or other
  misc_feature (257)..(257): n is a, c, t, g, unknown, or other
  misc_feature (258)..(258): n is a, c, t, g, unknown, or other
cagtttcctaccttcctctcgtcccagcagccgcaagccaaaaccctagcaagcaaaccaccggagcagcggcgctcgcgcgggcggacattgcgnacgacgattacaacgaaatcgacatgggctatgaggatgagcctccagaacctgagattgaggaaggggccgaagaagagcttragaacaacgaagatgcccctgatgatgtcataggtggagagggtgaagataaggaacaggaaaagaccaagcgtgannaaaacaacaaaatatatgacaaagtatgaacgtgcgcgcattcttggtacacgagccttgcagataagcatgaatgctccagtcatggttgagcttgagggagaaactgaccctcttgagattgcgatgarggagcttagagcgcgcaagata

SEQ ID NO: 682 - DNA, 444 bp, Zea mays
  misc_feature: Ceres CLONE 225077-F
  misc_feature: Encodes the peptide sequence at SEQ ID NO. 683
  misc_feature (385)..(385): n is a, c, t, g, unknown, or other
attatttggcctccgtcagagaggggagaaagacccgttcgaggcggcggcgatgtcggggcgcggcaagggcggcaagggtctgggcaagggtggagccaagcgccaccgaaaggtctccgcgacaacatccagggcatcaccaagccggcgatccggagctggctcggaggggcggcgtgaagcsattctcggggctcatctacgaggagacccgcggcgtgctcaagatcttcctcgagaacgtcatccgcgacgccgtcacctacaccgagcacgcgcgccgcaagaccgtcaccgccatggatgtcgtctacgcgctcaagsscaggggccgcaccctctacggcttcggaggctaggcgctcttcgtagctsgggaatncttagggtgatacgtctctgtcggctgtgggtcgtagtgttgctgcgttcctggatgta

SEQ ID NO: 683 - protein, 119 aa, Zea mays
  misc_feature: Ceres CLONE 225077-F
  misc_feature (41)..(110): Pfam Name: Histone Pfam Description: Core histone H2A/H2B/H3/H4
  misc_feature (62)..(62): Xaa is any aa, unknown, or other
  misc_feature (109)..(109): Xaa is any aa, unknown, or other
YLASVREGRKTRSRRRRCRGAARAARVWARVEPSATERSPRQHPGHHQAGDPELARRGGVKXFSGLIYEETRGVLKIFLENVIRDAVTYTEHARRKTVTAMDVVYALKXRGRTLYGFGG

SEQ ID NO: 684 - DNA, 222 bp, Zea mays
  misc_feature: Ceres CLONE 225137-F
  misc_feature: SWISSPROT Homolog: EC 2.7.4.3 Adenylate kinase
aaacctagaaccctcttcccccgcgatggccgcaggagcggcggcgtctcgcggcgcgcgcgtccgaacgtgctagtgacggggacgccggggacgggaagacgaccacgtgctcgctccttgccgacgccgcmstccgccacgtcaacatcggcgacctagtccgcgagaagagccttcacgacggctgggacgccgacctcgagtgccatgtcatcaacg

SEQ ID NO: 685 - DNA, 340 bp, Zea mays
  misc_feature: Ceres CLONE 225146-F
  misc_feature (63)..(63): n is a, c, t, g, unknown, or other
  misc_feature (64)..(64): n is a, c, t, g, unknown, or other
  misc_feature (258)..(258): n is a, c, t, g, unknown, or other
tcgcgccgccacttccctcccgacccactatcccaaaaccgtagcgccctcgcmtgctcgccnngccgtcgttgcgagctccccatcttcctccgtcaaccatggcgacccagatcagcaagaagaagaagttcgtcagcgaggcgtgttctacgsaggctcaatgagatgmtgacgcgggactcgcggaggacggctactccggcgtggaggtgcgcgtcacaccgatgcgcacggagatcatcatccgcgccamgnacgcagaacgtstcggcgagaagggccgcagatcagggagctcacgtctgtcgtccagaagaggttcaacttccccgagaac

SEQ ID NO: 686 - DNA, 452 bp, Zea mays
  misc_feature: Ceres CLONE 225178-F
  misc_feature: Translation starting site: 160
  misc_feature (247)..(247): n is a, c, t, g, unknown, or other
atcacaattcactccactcatcttttcgcgtttagaacctctaaaatttcccccactcgccagtcgcagcagcacctgtagccataggacgccagcggascacggtagcaaggggaagaaggagtgcggccgggcgcaaggyaggctkgccccaggaagatgtcggtgacgcggtccgtcaaggcmgggctgcagttccccgatcggccggatcgggcgctacctgaagamgggccggtacgcgcancgttgggcactggcgcccccgtctacctcgccgccgtcctggagtacctcgccgccgaggttctggagttggcaggggaacgcggcgaaagacaacaagaagacgcgcatcatcccgcgccacgtgctcctggcgatccgcaacgacgagggagctcgggaagctgctggcaggcgtcaccatcgcgcacggggccgtcctcccc

SEQ ID NO: 687 - DNA, 386 bp, Zea mays
  misc_feature: Ceres CLONE 225194-F
  misc_feature (200)..(200): n is a, c, t, g, unknown, or other
  misc_feature (242)..(242): n is a, c, t, g, unknown, or other
  misc_feature (246)..(246): n is a, c, t, g, unknown, or other
acaattcactccactcatcttttctcgtttagaacctctaaaatttcccccactcgccagtcgcagcagcacctgtagcagtcatcggacgccagcggascggtagcaaggggaagaagggggcggccgggcgcaagdvaggcggccccaggaagaagtcggtkamgcggtccgtcaaggacgggctgcagttccccgtnggccggatcgggcgctacctcaagamgggccggtacgcvcanmgtnggcactggcgcccccgtctacctcgccgccgtcctggagtacctcgccgccgaggttctsgagttggcagggaacgcggcgaaagacaacgaagaagacgcgcatcatcccgggccacgtgctccttggcgatccgcaac

SEQ ID NO: 688 - DNA, 432 bp, Zea mays
  misc_feature: Ceres CLONE 225210-F
  misc_feature: Translation starting site: 79
  misc_feature: Pfam Name: Metallothio_2 Pfam Description: Metallothionein
atttgcatctgagttcctgattgttgtattccagtttcttctgtgagttttgtgggatcgcgaggaagaactagaaggatgtcgtgctgcggaggcaactrcgggtgcggcgccggctgcaagtgcggcacggctgcggagggtgcaagatgtacccggacatggctgagcaggatgaccaccactacccagactctcatcatgggtgttgcaccgtccaagggcgggttcgaggcggccgcgtagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttrtgttttgttcgagtcagtcagacagtcagccgcgt

SEQ ID NO: 689 - DNA, 155 bp, Zea mays
  misc_feature: Ceres CLONE 225226-F
  misc_feature (74)..(74): n is a, c, t, g, unknown, or other
  misc_feature (75)..(75): n is a, c, t, g, unknown, or other
aacaacagcgaacacatctcctcgcatttcttcccatccgatccccccttcgcaaccaaaaccccaactcgccnngcatcgatggcgcccaaggccgagaagaaacccgcggcgaagtatatrhyggcggaggaggagcccgcggccgagaaggc

SEQ ID NO: 690 - DNA, 455 bp, Zea mays
  misc_feature: Ceres CLONE 225305-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctacgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggact

SEQ ID NO: 691 - DNA, 1564 bp, Zea mays
  misc_feature: Ceres CLONE 225377
  misc_feature: Encodes the peptide sequence at SEQ ID NO. 692
ctatcatcgagtcatcgttcagagacagaggctggtcgatcgtcggtgactgatggcgatggcggcggcgcaattggaggcggaggaggagctgcggctggaactggaggcggtggcggcggtgtacggagacgacgtccgcgtgctccgcgacctcccaccgcacctcttcgtccacgtgcggccccgcaccgccgacgacacctcgcagcagttcgtggagctctttcttggcattaaagcatcttcacagtatccgaaggaaccaccacatatttatgctgtggaaagtaagggccttgatgagaaccgacagatatatcttatcaccagcatccagaacaaggcaaacgaactttcaaactgtccaatgcttgtgacgttatgtgaggaagctggagagatcctctcgaacatgaatcatccagcaggggattgtccattgtgtctatatcctttaatgggagaggataaggttggctcggagttgccatttatgaagttgatgtcatgctaccattgcttccacagtgactgcattatgagatggtgggaatggctccaacatggtgacacaaacccaaaggagcccaatactggagacaagcattataatgtgaatcagccaagaggattttgtcctgtttgccgcaaagtgttcgatgagaaggatattgagcatgttcgtgatttgttgggtgacaatacttccaggctggcatcactaacagttgaccttggtgaagatgaaaaggaattgctccattccgaggctgagcaaaacaggagaaaaagaatcgagtcacttgttaatctgcagcaagaactaaacggcctgattgaaccaaagaaagaccttgccatacaaccaggaatgtacgtttccgttcctcccagcacgccagacacagctgaagaagagaatgctgatcccagccaaggcacggctacttcgacctcagaaactgagcaacgtggccaggcaagcaacgccagcagcaacaagccgaagaatccaggccatcgaaggagaaacagagctaatgcatcaagacgacagcctcacggccagggccagccagctaggcagcagtggcagaggaaagaagcaggcacttcacaccaataaaacaacatcgaagcaacgaggaggatgtgacctgtgagttgtttttgtcggctatgtacatcaatgtcgtgccttgctttcgtctcataataattgcgagccatggtatgacaatgttttggcgctgctatggaagttccatgcaagtgatactctggaaagaaccctgcaccggattctatgggagtagtataaagcacatgcatgcttggctagtacatacaatatctgattttttgtgtgtgtgtcattgccaggtactatgttcaaactgattgtccatagtcagaaaagcaactgattacactgtttgttactctttgagttgcatcatgtgtttgaaatacatacattacagcttaggtcatgtgggacattacaatataaagcactgcatgcagaatttgcaggggtcggctaaaaaaaaaaaaaaaa

SEQ ID NO: 692 - protein, 358 aa, Zea mays
  misc_feature: Ceres CLONE 225377
  misc_feature (9)..(119): Pfam Name: RWD Pfam Description: RWD domain
MAMAAAQLEAEEELRLELEAVAAVYGDDVRVLRDLPPHLFVHVRPRTADDTSQQFVELFLGIKASSQYPKEPPHIYAVESKGLDENRQIYLITSIQNKANELSNCPMLVTLCEEAGEILSNMNHPAGDCPLCLYPLMGEDKVGSELPFMKLMSCYHCFHSDCIMRWWEWLQHGDTNPKEPNTGDKHYNVNQPRGFCPVCRKVFDEKDIEHVRDLLGDNTSRLASLTVDLGEDEKELLHSEAEQNRRKRIESLVNLQQELNGLIEPKKDLAIQPGMYVSVPPSTPDTAEEENADPSQGTATSTSETEQRGQASNASSNKPKNPGHRRRNRANASRRQPHGQGQPARQQWQRKEAGTSHQ

SEQ ID NO: 693 - DNA, 247 bp, Zea mays
  misc_feature: Ceres CLONE 225469-F
  misc_feature: SWISSPROT Homolog: EC 2.1.1.104 Caffeoyl-CoA O-methyltransferase
  misc_feature (133)..(133): n is a, c, t, g, unknown, or other
aatccagcaatacccgagtacccgacgcgctacgtagttctattgccgcgcaccccagatctccaggagggactcgttcgttcagctaactacactgcacgcaatggccaccacggcgaccgaggcggcgcgncgcaggagcagcaggccaacgsaacggcgagcagaagacgcggcactccgaggtcggccacaagagcctgctcaagagcgacgacctctaccagtacatcctggacacgagcgt

SEQ ID NO: 694 - DNA, 261 bp, Zea mays
  misc_feature: Ceres CLONE 225471-F
  misc_feature (72)..(72): n is a, c, t, g, unknown, or other
  misc_feature (147)..(147): n is a, c, t, g, unknown, or other
  misc_feature (225)..(225): n is a, c, t, g, unknown, or other
gaggcagaaaagggcggataaactgcttgaactggaagcgaccctagtccaaaccaccgcaccgacaccganhccgagccccgccgcgccgsctacctccgctcctctcttcgcccctgccggcgtcgaggccgaagcgaaggcgangcatgcatcacgaccccaaccccttcgacgagggcagcgcgaggacaaccccttctcaaatggaggagccggassccnaagcagcagtacggcttccggccgactgagcccgtc

SEQ ID NO: 695 - DNA, 228 bp, Zea mays
  misc_feature: Ceres CLONE 225475-F
  misc_feature: Pfam Name: Ribosomal_L2 Pfam Description: Ribosomal Proteins L2, RNA binding domain
agccgcaccgcgctcacttccgcaccctcttcccgccgcgccgccgccgccgccgcttcctccccgccgccgggcaagatgggtcgcgtgatccgcgcgcastaatgggtgcgggatccgtgttcaagtcccacacccaccaccgcaatggccccgccggttccgctccctcgacttcggcgagcgcaacgggtacctcaagggcgtagtcaccgacgtgatccacga

SEQ ID NO: 696 - DNA, 119 bp, Zea mays
  misc_feature: Ceres CLONE 225491-F
  misc_feature: Encodes the peptide sequence at SEQ ID NO. 697
  misc_feature (70)..(70): n is a, c, t, g, unknown, or other
ctccggttaatcccccatcgccaggagcccaggactcgcagccagcccttcacattattcdcgcgcgcanaacggccgtagcgtgtgggtggcgtcgcgtgcggtctcttggtgccggt

SEQ ID NO: 697 - protein, 39 aa, Zea mays
  misc_feature: Ceres CLONE 225491-F
  misc_feature (20)..(20): Xaa is any aa, unknown, or other
  misc_feature (23)..(23): Xaa is any aa, unknown, or other
PVNPPSPGAQDSQPALHIIXARXTAVACGWRRVRSLGAG

SEQ ID NO: 698 - DNA, 381 bp, Zea mays
  misc_feature: Ceres CLONE 225492-F
  misc_feature: Encodes the peptide sequence at SEQ ID NO. 699
  misc_feature (320)..(320): n is a, c, t, g, unknown, or other
ggaggcggagagccacaggaggaggagctcgagggacgacgaccagctgaattaggactggagggggcagacgacgtcgtcgtaagcggcagcagcaggagaagggaagactcaaacgagggatctccgagagakgagtgtggtaggcaggaagaaagaataaggcgagccgagagccatatcgcatggaggcggcgatggatctgatgcggcggatgssaaccgggagcgcggagacggcgctcaacgcgctgctctccctcctccccgaccactccctcgacctcctctcccaggtcgacctcccgctccagggtttncatggataaggagagcctgaaggwawtacattctatgcgaatataaccgtgaatgctgact

SEQ ID NO: 699 - protein, 47 aa, Zea mays
  misc_feature: Ceres CLONE 225492-F
  misc_feature (12)..(12): Xaa is any aa, unknown, or other
  misc_feature (45)..(45): Xaa is any aa, unknown, or other
MEAAMDLMRRMXTGSAETALNALLSLLPDHSLDLLSQVDLPLQGXHG

SEQ ID NO: 700 - DNA, 221 bp, Zea mays
  misc_feature: Ceres CLONE 225504-F
  misc_feature: Encodes the peptide sequence at SEQ ID NO. 701
actcatacatttcgactctcaactcccaaggtccctttttttttctcgatctggaatcgccgcagtagcagccatggacgtgagcggasaggcggtaaggcgaagaagggcgcggcggggcgcaaggccggcgggcgacgaagaagatcggtgtcgcggtcctccagggccgggctgcagttccccgtcagccgcgtcgggcgtacctcaaaaagggccgg

SEQ ID NO: 701 - protein, 73 aa, Zea mays
  misc_feature: Ceres CLONE 225504-F
  misc_feature (30)..(30): Xaa is any aa, unknown, or other
THTFRLSTPKVPFFFSIWNRRSSSHGRERXGGKAKKGAAGRKAGGRRRRSVSRSSRAGLQFPVSRVGRTSKRA

SEQ ID NO: 702 - DNA, 228 bp, Zea mays
  misc_feature: Ceres CLONE 225506-F
  misc_feature: Translation starting site: 74
actcatacatttcgactctcaactcccaaggtccctttttttttctcgatctggaagcgccgcagtagcagccatggacgtgagcggasaggcggtaaggcgaagaagggcgcggcggggccaaggccggcgggcgaccgaagaaktcggtgtcgcggtcctccagggccgggctgcagttccccgtcagccgcgtcgggcgttacctcaaaaagggccggtacgcgc

SEQ ID NO: 703 - DNA, 226 bp, Zea mays
  misc_feature: Ceres CLONE 225734-F
  misc_feature: Pfam Name: Ribosomal_S9 Pfam Description: Ribosomal protein S9/S16
  misc_feature (25)..(25): n is a, c, t, g, unknown, or other
  misc_feature (160)..(160): n is a, c, t, g, unknown, or other
atatacgccgccatcttcgcaagcnaccgcaaccgaagcccgccttcgccgccgccgcctctgcgatccccgcaaggtcgcaaacatgtctaccgtgctccagcgcccgacccccggcacgtccagtgcttcggccgcaagaagacggctgtggcgcrcnctacaccaagccggggcgcgggctgatcaaggtgaacggcgtcccgattgagctcatcaggccgga

SEQ ID NO: 704 - DNA, 204 bp, Zea mays
  misc_feature: Ceres CLONE 225735-F
  misc_feature (138)..(138): n is a, c, t, g, unknown, or other
aytcatacatttcgactctcaactcccaaggtccctttttttttctcgatctggaagckccgcagtagcagccatggacgtgagcggacaggcggtaaggcgaagaagggcgcggcggggcsaaggycggcgggcgancgaagaagtcggtgtcgcggtcctccagggccgggctgcagttccccgtcagccgcgtcgggcggt

SEQ ID NO: 705 - DNA, 381 bp, Zea mays
  misc_feature: Ceres CLONE 225746-F
  misc_feature: Encodes the peptide sequence at SEQ ID NO. 706
actctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgarctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgmggasacaatgttcacctggtcactgttcctgccgctaagcccttggcgagtgggct

SEQ ID NO: 706 - protein, 67 aa, Zea mays
  misc_feature: Ceres CLONE 225746-F
  misc_feature (49)..(49): Xaa is any aa, unknown, or other
  misc_feature (50)..(50): Xaa is any aa, unknown, or other
MKKSSAHDGLVKGLREAAKAIEKHAAQLCVLAEDCDQPDYVKLVKALCXXTMFTWSLFLPLSPWRVG

SEQ ID NO: 707 - DNA, 252 bp, Zea mays
  misc_feature: Ceres CLONE 225784-F
  misc_feature: Translation starting site: 64
  misc_feature (126)..(126): n is a, c, t, g, unknown, or other
  misc_feature (201)..(201): n is a, c, t, g, unknown, or other
aacaacaacaacccgcayaacggcacgattctyctcctccgtccgcgtmtctcggtttcggcgatgtcggggcgcggcaagggcggcaaggggctgggcaagggcggcgcaagcgcaccgcaagyntggcgcgacaacatccagggcatcacgaagccggcgatccgtagmtggccaggaggggcggcgtcaacgcatttntgggctcatytacgaggagacccgcggcgtgctcaagatyttcctcgagaa

SEQ ID NO: 708 - DNA, 411 bp, Zea mays
  misc_feature: Ceres CLONE 225827-F
  misc_feature: Pfam Name: Subtilisin_N Pfam Description: Subtilisin N-terminal Region
  misc_feature (310)..(310): n is a, c, t, g, unknown, or other
  misc_feature (313)..(313): n is a, c, t, g, unknown, or other
  misc_feature (322)..(322): n is a, c, t, g, unknown, or other
  misc_feature (354)..(354): n is a, c, t, g, unknown, or other
acagattagctaccacggcaccgcagcccggacggctataaagacgaggcccacctcgaaatcgacggcgatgaagaagaccagttcccctctcctgatcgtcctgttcctcacagcagcagccatggcggccgagcggagaagcaggcggcccccgcggcacaggagacggccgtacacatcgtgtacgttgaccgccccgaggacgccgaccctgaggagttccacatccgcaccctcacccccgtcctcggcagcgaacagaaggccagggacgcakgctctaccactacaagaacgccgccagcgnttnatccgcganstcaccccccagcaggtcaaggatctcaaggngcagccaggtgttctcccaggttgtgccgagccagacttaccagcttacatggtcct

SEQ ID NO: 709 - DNA, 232 bp, Zea mays
  misc_feature: Ceres CLONE 225829-F
acagctgaaasagtccaaaacgcagaagctgcactgcatacatcgagctaactatctgcagcgatttctcgctcctgctgcgtcgccgtgtcggtgcattctcgctgtcgccgcgacamcagcgccaccgcscggcatggctgcacgaggaggccatggccacgggccgctggtcrcagagggtgcaagggtagcgccctccgcgtccacctgggctgccgacaagsgtcgc

SEQ ID NO: 710 - DNA, 178 bp, Zea mays
  misc_feature: Ceres CLONE 225840-F
  misc_feature: Encodes the peptide sequence at SEQ ID NO. 711
  misc_feature (95)..(95): n is a, c, t, g, unknown, or other
gtttaatcaatccttcaagcgcaabtgcctcctcctcgtcgtccggtcgtgagaagggatggcgggccgtggcaaggctatcggcgctggcgccnggaagaaggcaacgtcgaggagctccaaggccggactccagttccccgtcggcaggaattgccaggttcctcaaggcgggcaa

SEQ ID NO: 711 - protein, 40 aa, Zea mays
  misc_feature: Ceres CLONE 225840-F
  misc_feature (13)..(13): Xaa is any aa, unknown, or other
MAGRGKAIGAGAXKKATSRSSKAGLQFPVGRNCQVPQGGQ

SEQ ID NO: 712 - DNA, 423 bp, Zea mays
  misc_feature: Ceres CLONE 225846-F
  misc_feature: Translation starting site: 179
  misc_feature (78)..(78): n is a, c, t, g, unknown, or other
  misc_feature (79)..(79): n is a, c, t, g, unknown, or other
ctctagccaaaaccctagcagccgcccggtgctccctctctgcagatctcccttcgcagccgccgaggaaccccttcnnagcgcggaagatggctgaacaggaggccccagtcgtrgttgaggcaccaaccccagttcttggggagcctatggacttgatgactgctctgcrctmgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggmtgggctttgcaagattgactctgagggcarggcaaggaaggtt

SEQ ID NO: 713 - DNA, 155 bp, Zea mays
  misc_feature: Ceres CLONE 225851-F
  misc_feature: Encodes the peptide sequence at SEQ ID NO. 714
agttgaattcatctctgccctagcaccagccatggcgamgcagcttcttctctgtttcctactcgccgcctccgcgccgctaatcgtcgccacggccatgaaatccggggacgtgtcggagctccagatcggcgtcaagtacaagccggartcat

SEQ ID NO: 714 - protein, 41 aa, Zea mays
  misc_feature: Ceres CLONE 225851-F
  misc_feature: SWISSPROT Homolog: EC 5.2.1.8 Peptidylprolyl isomerase
  misc_feature (3)..(3): Xaa is any aa, unknown, or other
MAXQLLLCFLLAASAPLIVATAMKSGDVSELQIGVKYKPES

SEQ ID NO: 715 - DNA, 716 bp, Zea mays
  misc_feature: Ceres CLONE 225899
  misc_feature: Encodes the peptide sequence at SEQ ID NO. 716
acaaaattctgctgattgggctccccgctcgacccaaaccctctcgctcccgttggcggtgccggtgcggcgaggtgaccacggcggcggaagaatggcgaaaggcagcgggctgatctgggcgacggcggaggatctggcgcggaataggccggtggtgctgtcgctgtacaggcagattctgcgggccctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttggtttcatgttgcatcagcattttgttttgagtgttgtcaaagccagaattagtaatatgtttcatgtgtacccttttcaaacttcatcaagaatgggtgtgctctggatattttgtcgggaatgatatgaaatacttaagctaaaaaaaaaaaaaaaa

SEQ ID NO: 716 - protein, 143 aa, Zea mays
  misc_feature: Ceres CLONE 225899
  misc_feature (53)..(129): Pfam Name: Ribosomal_L14e Pfam Description: Ribosomal protein L14
MAKGSGLIWATAEDLARNRPVVLSLYRQILRALVVIVDVVDQNRALVDAPDMVRCQINFKRLSLTDIKIDIKRVPKKSTLIKAMEEADVKTKWENSSWGKKLIVQKRRAALSDFDRFKVMLARIKRGGAIRQELAKLKKASTA

SEQ ID NO: 717 - DNA, 98 bp, Zea mays
  misc_feature: Ceres CLONE 225908-F
  misc_feature (53)..(53): n is a, c, t, g, unknown, or other
aaaataataagaaaaatactcccgtgttcttcgaccggcggcggtggtgcgangaggcggtaagggagacgagatgagggggacgaagcggccgctcg

SEQ ID NO: 718 - DNA, 466 bp, Zea mays
  misc_feature: Ceres CLONE 225929-F
  misc_feature: Encodes the peptide sequence at SEQ ID NO. 719
  misc_feature (175)..(175): n is a, c, t, g, unknown, or other
agcgcaccaatcccatcctccacccaatcgaaggacctagcgagcggcasscggcgcgatcggagaagatggtgcgcaaggcgaaggttgagttcgacgagcagccgccggataacttcgacccgaagaacccgtatgccgacccggtggcgatgctcgartaccgggaacaccndgtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgccgcccgcctgaactccacgagcccaagaagacccgtcaaggcggagtagcgggcgctgctgcctwgcttctcagtgctgctgttcctggattggagaggtgatctgacactttccatttgagtttgaatgaa

SEQ ID NO: 719 - protein, 104 aa, Zea mays
  misc_feature: Ceres CLONE 225929-F
  misc_feature (36)..(36): Xaa is any aa, unknown, or other
MVRKAKVEFDEQPPDNFDPKNPYADPVAMLEYREHXVREKWIQIETAKIIRERLRWCYRIEGINHHQKCRHLVDQYLEATRGVGWGKDAARLNSTSPRRPVKAE

SEQ ID NO: 720 - DNA, 136 bp, Zea mays
  misc_feature: Ceres CLONE 225958-F
gaaaagaactagagcatcccgtggagagaaggcggcggcasgctgtgggagatgtcaatcctgtgggagaagagcgcgggttagcgatggctggttcggcggamgcgtgactcgaagmccttcttwttcacgttcg

SEQ ID NO: 721 - DNA, 472 bp, Zea mays
  misc_feature: Ceres CLONE 226018-F
  misc_feature: Translation starting site: 86
ctagccaaaaccctagcagccgcccggtgctccctctctgcagatctcccttcgcagccgccgaggaaccccttcaccgcggaagatggctgaacaggaggccccagtcgtggttgaggcaccaaccccagttcttggggagcctatggacttgatgactgctctgcagctcgtgawgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgagggcc

SEQ ID NO: 722 - DNA, 209 bp, Zea mays
  misc_feature: Ceres CLONE 226059-F
  misc_feature: Encodes the peptide sequence at SEQ ID NO. 723
  misc_feature (29)..(29): n is a, c, t, g, unknown, or other
  misc_feature (140)..(140): n is a, c, t, g, unknown, or other
acacgcgaatcctcaaatctgcccttgcngccgccaccgcccgatccaggtctgcagactgctccctcctcmtctccgctccgaatggcccgcacgaagcagacggcgcgcaagtcgaccggcrgcaaggcgccgcggtnacagctggccaccaaggcrgcgcgcwagtcggcaccggccacgcggcgtgaagaagccgcaccgcttcc

SEQ ID NO: 723 - protein, 41 aa, Zea mays
  misc_feature: Ceres CLONE 226059-F
  misc_feature (14)..(14): Xaa is any aa, unknown, or other
  misc_feature (19)..(19): Xaa is any aa, unknown, or other
  misc_feature (28)..(28): Xaa is any aa, unknown, or other
MARTKQTARKSTGXKAPRXQLATKAARXSAPATRREEAAPL

SEQ ID NO: 724 - DNA, 202 bp, Zea mays
  misc_feature: Ceres CLONE 226121-F
  misc_feature (115)..(115): n is a, c, t, g, unknown, or other
  misc_feature (147)..(147): n is a, c, t, g, unknown, or other
atcaccaatcagtcagtcacagctcacagcaaacaccgcgaagcgcccccgctcccaaacccgaccgagcaaagcgcaaagccccccaaccgcggatcaatccgcagcatcgatnggcgcccaaggcggagaaaaagccggcggcanagaagcccgcggaggaggagcccgctgaccmgagaaggcggagaaggctccggca

SEQ ID NO: 725 - DNA, 137 bp, Zea mays
  misc_feature: Ceres CLONE 226143-F
atcacaattcacagcgctcaagttctcgcgcccacagccaaatttttctccactcaatcgcggcataagctgcactgcagcatcggacgccagcggascggtaagcaaggcgaagaagggggcggctggrcgcaagg

SEQ ID NO: 726 - DNA, 462 bp, Zea mays
  misc_feature: Ceres CLONE 226146-F
  misc_feature: Translation starting site: 91
  misc_feature: Pfam Name: CHCH Pfam Description: CHCH domain
  misc_feature (178)..(178): n is a, c, t, g, unknown, or other
gtttgtgtccttagggtttagggttctctgctcattcgttcgccacctcgccccaagacgtctcgctagggtttcgccacagccgccgccatgcctcgccgcaagcttaggaaggtccgcggctcacgcccggctccacatgctgctccagtgaggaacccaccacagcctgcgcgcnmggctcgtcctccagctcctgttcgtgatggtggtggtggctccattcttggaggaattgggtccaccattgcttaaggtatgccatttggtacgagtagtgccatggcacacagggctgttgatgctgtaatgggtctccggactgttcggcatgagattgttcatctcagaagctgctgctgctgcccctcctgctccagtgatgaacgctaatgcttgcagcatccattctaaggctttccaagattgtcttaacaactatggcagtgagatcagcaagtg

SEQ ID NO: 727 - DNA, 168 bp, Zea mays
  misc_feature: Ceres CLONE 226188-F
chttttcgcagctccaggctccagcgcacagccgccgccgtttcttcatcttcttcgcagagccggcgctccatcttcggctccctcccttaacttgcgactacggcacgcaggcrgcggcggcggcgctgtggactcgggatctcagtgacggcatcagmggcttcc

SEQ ID NO: 728 - DNA, 487 bp, Zea mays
  misc_feature: Ceres CLONE 226196-F
  misc_feature: Translation starting site: 126
  misc_feature: Pfam Name: Ribul_P_3_epim Pfam Description: Ribulose-phosphate 3 epimerase family
  misc_feature: SWISSPROT Homolog: EC 5.1.3.1 Ribulose-phosphate 3-epimerase
aacaaaccaaatcgcttaccgcccccgaagcgtctcggttcgcatagcagagctgctcttgcaacaagccaaacaacccagtggctgctagcagagacaggggatagattgaragaggcgcgcagatggcgacgcgtcgtcgtcgctttgctccagcttcgcctccctgcargaccgcctccatcggccacccccgtgcatcgcctcctccacgcccaggaaggcattccatgtgagggcatcagctcgggttgacaagttctcaaagagtgacatcatcgtgtccccttcgattctgtctgcaaactttgcgavktggtgatcaggtaaaagctgtggaggtggcaggatgcgactggattcatgttgatgtcatggatgggcgctttgtgcaaacatcacaattggacccttggttgttgatgctctgcgtccagtgactgatcttccgttggatgtacatctygatgattgtgggaactgagca

SEQ ID NO: 729 - DNA, 159 bp, Zea mays
  misc_feature: Ceres CLONE 226225-F
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
acnnncccattcgagccagccagccagccagccagccgcttgggcgccatctctctagagcttcgtaccctcgaagaagatccgghdcggcccaataaacacccggctcactacagactcgcagatggccggcctcaggatgaagttcgtcgccgtaac

SEQ ID NO: 730 - DNA, 348 bp, Zea mays
  misc_feature: Ceres CLONE 226228-F
  misc_feature: Encodes the peptide sequence at SEQ ID NO. 731
aattttcctccacttcccaaaccctaccggcggcgcacgagcatcacaaccaccgcccgaagatggtgaagtttctcaagcccggcaaggccgtaatcctcctccagggcaggttcgccggccggaagssgtgatcgtgcgcgtkttcgaggagggcacccgcgaccgtccctatggcactgcctcgtcgccggcctggccaagtaccccaagaaggtgatccgcaagactccgccaagaagacggccaagaagtcccgcgtcaagtgtttcatcagctcgtcaatttcactcacctcatgcccacccgctacacccttcgacgtcgatttcaaagacgtcgcctcgg

SEQ ID NO: 731 - protein, 58 aa, Zea mays
  misc_feature: Ceres CLONE 226228-F
MALPRRRPGQVPQEGDPQDSAKKTAKKSRVKCFISSSISLTSCPPATPFDVDFKDVAS

SEQ ID NO: 732 - DNA, 244 bp, Zea mays
  misc_feature: Ceres CLONE 226241-F
  misc_feature: Encodes the peptide sequence at SEQ ID NO. 733
  misc_feature (186)..(186): n is a, c, t, g, unknown, or other
atataatttgtytctcgtgcctcgttgcgtctttgtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctasttgcgtaasanattccaagaagatggagggtatctctcactccaagtacttctgcgagttttgtgggaa

SEQ ID NO: 733 - protein, 43 aa, Zea mays
  misc_feature: Ceres CLONE 226241-F
  misc_feature (21)..(21): Xaa is any aa, unknown, or other
  misc_feature (24)..(24): Xaa is any aa, unknown, or other
  misc_feature (25)..(25): Xaa is any aa, unknown, or other
MTKRTKKAGIVGKYGTRYGAXCVXXSKKMEGISHSKYFCEFCG

SEQ ID NO: 734 - DNA, 169 bp, Zea mays
  misc_feature: Ceres CLONE 226244-F
csgccagcyactccaaacacttgckccgccactgcctcacaggtaaggccgccatggtctccggttcgggcgtgtgcgcgamrtcggttggtggacgcgcgccaccacatgctgggccgtctctcctcgatcatagccaaggagctgcttcaatgggcagaaggtggtc

SEQ ID NO: 735 - DNA, 375 bp, Zea mays
  misc_feature: Ceres CLONE 226252-F
  misc_feature: Encodes the peptide sequence at SEQ ID NO. 736
  misc_feature (61)..(61): n is a, c, t, g, unknown, or other
  misc_feature (62)..(62): n is a, c, t, g, unknown, or other
  misc_feature (267)..(267): n is a, c, t, g, unknown, or other
  misc_feature (365)..(365): n is a, c, t, g, unknown, or other
atcaatctcgttgtccgttgtactctctctctctattcgttccccgcctcaccccgagccnnccgtctcgctagggtttcgccgccgccgccgccatgcctcgccgcagctcaggaaggtctgccccacgcccagctccccgtgctgctccagtgaggaacccgccacagccagcacgccaggctcctcctccagctcctgttcgacatggtggtggctccatgtttggaggaattgggtccaccattgctcaakgtatggcgtttngcacgggtagtscatggcmacagggctgttgatgctgtattaggtccccgggaccatttcagcatgagacttgttgcctcagragctgctgctgctgnccctgaccct

SEQ ID NO: 736 - protein, 67 aa, Zea mays
  misc_feature: Ceres CLONE 226252-F
  misc_feature (54)..(54): Xaa is any aa, unknown, or other
  misc_feature (58)..(58): Xaa is any aa, unknown, or other
  misc_feature (62)..(62): Xaa is any aa, unknown, or other
  misc_feature (64)..(64): Xaa is any aa, unknown, or other
MPRRSSGRSAPRPAPRAAPVRNPPQPARQAPPPAPVRHGGGSMFGGIGSTIAQXMAFXTGSXWXQGC

SEQ ID NO: 737 - DNA, 180 bp, Zea mays
  misc_feature: Ceres CLONE 226343-F
  misc_feature (102)..(102): n is a, c, t, g, unknown, or other
atccctcacacgatctctcccctacggctaacccggattgccgtctcaggctcgggatccgggcgctcgcggcgatggacggcggcggcggcgctggcggcnggagggggagctcacggcgcaggagacagcgctctacgaccgccagatccgcgtctggggcgtcgatgcccagcaaga

SEQ ID NO: 738 - DNA, 124 bp, Zea mays
  misc_feature: Ceres CLONE 226355-F
  misc_feature: Encodes the peptide sequence at SEQ ID NO. 739
  misc_feature (67)..(67): n is a, c, t, g, unknown, or other
  misc_feature (68)..(68): n is a, c, t, g, unknown, or other
aacaaagcaaagcaggcctccgrmtccctgaactgacttcagaagtcaccaacgcacccagcacagnngaagaccctcgccggacgctcgctctcgccggggacaactcaatcccgaggccagg

SEQ ID NO: 739 - protein, 40 aa, Zea mays
  misc_feature: Ceres CLONE 226355-F
  misc_feature (8)..(8): Xaa is any aa, unknown, or other
  misc_feature (22)..(22): Xaa is any aa, unknown, or other
QSKAGLRXPELTSEVTNAPSTXEDPRRTLALAGDNSIPRP

SEQ ID NO: 740 - DNA, 272 bp, Zea mays
  misc_feature: Ceres CLONE 226406-F
  misc_feature (18)..(18): n is a, c, t, g, unknown, or other
  misc_feature (110)..(110): n is a, c, t, g, unknown, or other
  misc_feature (205)..(205): n is a, c, t, g, unknown, or other
ccacaacaccagaatccncgaatcacagacgcgtctatctcagcttgctgcactgcactaccctgccctgccatcatatcgtacgtgagcccggccgagcgagasmgggnaggaggcatggctgctccgaagctcgcgacgctggcgctggccgtgctcctggcggcgaccrgtggtggctcccccggccgcggtgcgcgcgsgnatgtcgtgctccaccgtgtacagcacgctgatgccgtgcctgccgttcgtccagatgggcggggcca

SEQ ID NO: 741 - DNA, 335 bp, Zea mays
  misc_feature: Ceres CLONE 226435-F
  misc_feature: Encodes the peptide sequence at SEQ ID NO. 742
  misc_feature (63)..(63): n is a, c, t, g, unknown, or other
awagaaaaacggtgagctagaaacttccaaatcgaacggcacacaaaaatcacaacccggaanggaccagcagcgcaaaggtgagcgagctttccttcggaactctcgtgctcacctcatccgtccgacaaatccacacgaatcctctgattcagagcagggtgttvgcattgatcagacgcctgccatggcggatcagttcgtggattcggcgaacaatgtgatcattkaggaggtgaacaagggcctgawcccaggaatggtggttctgcttgtggttgcaagcttcctgctgctcttctttgtggggaactatgcgctgtatgtgtatkcgc

SEQ ID NO: 742 - protein, 48 aa, Zea mays
  misc_feature: Ceres CLONE 226435-F
  misc_feature (15)..(15): Xaa is any aa, unknown, or other
  misc_feature (22)..(22): Xaa is any aa, unknown, or other
MADQFVDSANNVIIXEVNKGLXPGMVVLLVVASFLLLFFVGNYALYVY

SEQ ID NO: 743 - DNA, 381 bp, Zea mays
  misc_feature: Ceres CLONE 226437-F
  misc_feature: Encodes the peptide sequence at SEQ ID NO. 744
  misc_feature (19)..(19): n is a, c, t, g, unknown, or other
  misc_feature (111)..(111): n is a, c, t, g, unknown, or other
  misc_feature (112)..(112): n is a, c, t, g, unknown, or other
  misc_feature (122)..(122): n is a, c, t, g, unknown, or other
  misc_feature (298)..(298): n is a, c, t, g, unknown, or other
gaaacggcggccgaggcsnaagcttctcactggccgcaagcaaaccgaacgaacccaaccgaagcgagastgagcaaggcagaggcggcgtgaccggcgatggagcggctnngcggatcttnggcgcctccggatggggcagccgccgacggactcgccgctgctcgattcctmcgagcaggtctacatctcctccctagcgcttctcaagatgctcaagcacgggagggctggggtgcccatggaggtcatggggcctcatgctcggcgagttmgtcgacgactacaccgtcaggtncgtcgagtcttcgccatgccgcagagcgggactggtgtmagcgtcgaggccgtagaccacgtcttccagacaaacatgcttga

SEQ ID NO: 744 - protein, 82 aa, Zea mays
  misc_feature: Ceres CLONE 226437-F
  misc_feature (14)..(14): Xaa is any aa, unknown, or other
  misc_feature (48)..(48): Xaa is any aa, unknown, or other
MGQPPTDSPLLDSXEQVYISSLALLKMLKHGRAGVPMEVMGPHARRVXRRLHRQVRRVFAMPQSGTGVSVEAVDHVFQTNML

SEQ ID NO: 745 - DNA, 151 bp, Zea mays
  misc_feature: Ceres CLONE 226451-F
atttttttcatttaccacaccctgctctcgctcttgttgtgacggtcgattcgcttgtacaaggtagcaaccttgagatccagccaagatccagccatgagggagattctccacatccagggtggacagtgcggcaaccagatcgrttcca

SEQ ID NO: 746 - DNA, 270 bp, Zea mays
  misc_feature: Ceres CLONE 226457-F
  misc_feature (193)..(193): n is a, c, t, g, unknown, or other
actcgcattcgtcactcgtccctctcccctctctcccccaaggccccaacccacttgagcgagccctagagaaggcaaaagccatggcgtccttggttgttcgtgccgccgggccgcsccgccgccgcccgtcttccctccctccgtcctcgccgcaacggcagcggggtgatctccggcttgagggtcggancagggcactacggcgcgcggctcgstytggcttcgtccacagcttctcacaaagagttcaagatcgcctgccttact

SEQ ID NO: 747 - DNA, 1039 bp, Zea mays
  misc_feature: Ceres CLONE 226517-R
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
  misc_feature (1039)..(1039): n is a, c, t, g, unknown, or other
cacaaaaaagacatagagggaaaatatataaaaaaggacgaagaagcgcagaggggaggggtgntnnnnnanttttatttttttttttcaattgggtacgggccccccctcgaggtcgacggtatcgataagcttttttttttttttttttgtatcttaactgattgagttaaacgcaagctgaaacatcacatcgggatactacctactaaaaggacagaggggaaacagggctgtgcaaatgccatcaatcacgaaggtgatggccagagaaccattatactgaaagcttctgtggctcatggctagcagaactgaatctgtcaagcataagcagtggcgtacagacggttagattcggccatgtcactctcctcgccttccactcctaaaaactgagacgtctttccactcgaaacagctcctttcaaagagcaaacttctcttcgagaaaaagcctttctcgaaccctctccctcaaaaggggggttggcatagcccaaccccaccccctctggggcctgcctatcgaaaacctaattttttttgaaaattgggggaaaatggcccattttttcccaatcccccggccaaattttttaaaaagaggtgaaaaaaaatttttgggcttggggggcaacccctttaaaaccctcttttccccacaaaatggaggagaaccttgagccaagaaaccccaatattttgccccaaagatataaaattggggggagggccccccataaattcgcccctccgccacacctctgtgaaaaacactatctcttttataccccgccggaaaatatggaaaaaaacacactgtgttgcccttcccctggtgcctacataggagggccgccatcctttctctcttgtagagaatggcgccccttctcctttatgaggaatattgtggggaaagaggttttttcaacacccctttttgggggggacttaaaggcccttctgggggagggaccttccacccgtttctcctaaaaatatataaagcccctttttttcaggggaaaaacan

SEQ ID NO: 748 - DNA, 486 bp, Zea mays
  misc_feature: Ceres CLONE 226612-F
  misc_feature: Translation starting site: 99
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacagcaggccacgtgccgttgcctcaaggcggcctacgttcaggtccacgctgtgctctccgcggmgcaggagctgcccggcgactgcggcctctcgctgtcctacaacatcacccccgacatcgactgcgacaagatcgaatgaagggatactgttccctttaccagaatcca

SEQ ID NO: 749 - DNA, 456 bp, Zea mays
  misc_feature: Ceres CLONE 226624-F
  misc_feature: Encodes the peptide sequence at SEQ ID NO. 750
aataaaccctaaggggctgcggctcgtatataaaccagcaccactcatccgtcgccccacggaagtctcggcggcgcggcgtgcttgtkatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagatgtcgcacagcgctgcaaggagcttggcattactgcactgcacattaagcttcgtgccaccggagcaacaagaccaaga

SEQ ID NO: 750 - protein, 105 aa, Zea mays
  misc_feature: Ceres CLONE 226624-F
  misc_feature (28)..(105): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALHIKLRATGATRPR

SEQ ID NO: 751 - DNA, 178 bp, Zea mays
  misc_feature: Ceres CLONE 226628-F
  misc_feature (90)..(90): n is a, c, t, g, unknown, or other
  misc_feature (91)..(91): n is a, c, t, g, unknown, or other
atcacccaaaacacaagtagggttaggaaggcggcggccagcgacgagagcgcgagaggaggaggggtcggccatgacggggaaggcganncagaagcacacagcgaaggagatcgccgcgaagatcgacgcggcacgacgaaccggggcggcggcaaggccgggcaggcggacmggc

SEQ ID NO: 752 - DNA, 418 bp, Zea mays
  misc_feature: Ceres CLONE 226682-F
  misc_feature: Encodes the peptide sequence at SEQ ID NO. 753
  misc_feature (138)..(138): n is a, c, t, g, unknown, or other
  misc_feature (205)..(205): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctagcagttccccgtcagccgcgtcgggcgtnacctcaaaaagggccggtacgcgcabgtaggcacgggtgccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctsctggccggcgtcaccatcgcccacgg

SEQ ID NO: 753 - protein, 138 aa, Zea mays
  misc_feature: Ceres CLONE 226682-F
  misc_feature (52)..(124): Pfam Name: Histone Pfam Description: Core histone H2A/H2B/H3/H4
  misc_feature (29)..(29): Xaa is any aa, unknown, or other
  misc_feature (46)..(46): Xaa is any aa, unknown, or other
  misc_feature (68)..(68): Xaa is any aa, unknown, or other
  misc_feature (77)..(77): Xaa is any aa, unknown, or other
SYISTLNSQGPFFFSIWKRRSSSHGRERXGGKAKKGAAGRKAGGRXKKSVSRSSRAGLAVPRQPRRAXPQKGPVRAXRHGCPVYLAAVLEYLAAEVLELAGNAARDNKKTRIIPRHVLLAIRNDEELGKLLAGVTIAH

SEQ ID NO: 754 - DNA, 408 bp, Zea mays
  misc_feature: Ceres CLONE 226788-F
  misc_feature: Translation starting site: 239
  misc_feature (119)..(119): n is a, c, t, g, unknown, or other
  misc_feature (165)..(165): n is a, c, t, g, unknown, or other
aaccgagacaccgcgtgckaaccaagcagaccacagcaagaagcgtagtcgtcgccggaaggaaaggcgcggasaagatgtcgtggcaggcgtacgtcgatgagcacctgatgtgcgangatcgaaggacaacatctcagcgccgccgccatcgtcggtcacgmncaggcgcttrggcsagtccgagagcttccccgagttaaagcctgaggaggttgctggtatcatatgacttttgatgaacctggtactcttgcaccaactggtctttttcgttggaggtacaaagtacatggtgatccaaggtgaacctggagttgtcatccgaggaaagaagggcactggggggcattactatcaagaaaaccggcatgtccttgattattgggtgtctacgacgagccaatt

SEQ ID NO: 755 - DNA, 142 bp, Zea mays
  misc_feature: Ceres CLONE 226805-F
  misc_feature (62)..(62): n is a, c, t, g, unknown, or other
  misc_feature (63)..(63): n is a, c, t, g, unknown, or other
aaattagatagagctcgccgagcaagcaagcaagccaactcggccgtccgaacgaaagckannggccaaactcactcgctaaacgctcccgttctcctccgcctgcccccaccggctccccttgtacacgagcgccggagac

SEQ ID NO: 756 - DNA, 398 bp, Zea mays
  misc_feature: Ceres CLONE 226815-F
  misc_feature: Encodes the peptide sequence at SEQ ID NO. 757
  misc_feature (379)..(379): n is a, c, t, g, unknown, or other
atttcatttaccacaccctgctctcgctcttgttgtgacggtcgattcgcttgtacaagctagcaaccttgagatccagccaagatccagccatgagggagattctccacatccagggtggacagtgcggcaaccagatcggttccaagttctgggaggtcgtctgcagacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtcgcaccgggccgtacgsaraatcttccgccccgacaacttcgtcttcggccagtctggngcggggaacaactgggcca

SEQ ID NO: 757 - protein, 36 aa, Zea mays
  misc_feature: Ceres CLONE 226815-F
  misc_feature (17)..(17): Xaa is any aa, unknown, or other
  misc_feature (31)..(31): Xaa is any aa, unknown, or other
MDLEPGTMDSVAPGRTXNLPPRQLRLRPVWXGEQLG

SEQ ID NO: 758 - DNA, 251 bp, Zea mays
  misc_feature: Ceres CLONE 226828-F
  misc_feature: Encodes the peptide sequence at SEQ ID NO. 759
  misc_feature (155)..(155): n is a, c, t, g, unknown, or other
  misc_feature (165)..(165): n is a, c, t, g, unknown, or other
atcttcctctgcgcttcgcccacacgctccagccgcttcaccgcgccgccaccgccaccgcgaggatgccgttcaagaggttcgtggagatcgggcgcgtrgccctggtgaactacgggaaggactatggccgtctcgtcgtcatcgtagaktgngtcgaccagnacagggcacattgtggatgcccctgatatggtcaggtgccaggtgacttcaagcggctctcacttactgacatcaagattgacatc

SEQ ID NO: 759 - protein, 41 aa, Zea mays
  misc_feature: Ceres CLONE 226828-F
  misc_feature (29)..(29): Xaa is any aa, unknown, or other
  misc_feature (30)..(30): Xaa is any aa, unknown, or other
  misc_feature (34)..(34): Xaa is any aa, unknown, or other
MPFKRFVEIGRVALVNYGKDYGRLVVIVXXVDQXRAHCGCP

SEQ ID NO: 760 - DNA, 665 bp, Zea mays
  misc_feature: Ceres CLONE 226835-R
  misc_feature (665)..(665): n is a, c, t, g, unknown, or other
cgaattgggaccgggccccccctcgaggtcgacggtatcgataagctttttttttttttttaaccaaaattagattatcgattttatcaggtcaacgttcctatcaatacttactacgtggaaaatacacaattacacagtataatcgcgccactgcagtttaatgggatcaacgatcacaagaaagcaaatcaaagatttattctgagtgacatttccatccctcaagcatcagcgataaacaagttgccatggatttgcttaacaattaattgcatcggcaaaacaaacataaaactgcacatcagcttcaaattcactgagttgatggcgtgcaacattgtttgctagaagtagcacacttggaatcaatttgcacgcttcttctcacttgagtacgcatagtactctttgccgttgtcaactctggtcgtattgccgccaatgtccagcacagcagatgtgaaagccagacaggagcctccgatgagggctgactgaatactctttcctctgtagccgcacacagaagctccggcgacaaacgcaccgacggccccgttggcgaactcgcgcttcttgcgctggctctgcacgaactgctcgacgcctatgtagaggcccccgatggtggcgaaggaggccccataggtgccgcacatctn

SEQ ID NO: 761 - DNA, 464 bp, Zea mays
  misc_feature: Ceres CLONE 226863-F
  misc_feature: Encodes the peptide sequence at SEQ ID NO. 762
ctggacgggctcgcttctgccgctccgscttgtgcgtgggtgaagtgctggtgctggtgcgggaagcgtcgccaaacctagcgggtgcagaccttggtgggggagcgaggagtcgaaacaagaaccatgagtgaaacagggcacactgtacaagtcactaacctctcgagcagagtatctgaaagtgatctttatgagttctttttgttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaattgaatacacgagctatcaatcatgccagtacaacactactcc

SEQ ID NO: 762 - protein, 112 aa, Zea mays
  misc_feature: Ceres CLONE 226863-F
MSETGHTVQVTNLSSRVSESDLYEFFLFSGPIEHVELIRSGEYGATAYVTFKERFALETAVLLSGATIVDQPVCITYWGQPEETFNFWDRPTWEVEEEIEYTSYQSCQYNTT

SEQ ID NO: 763 - DNA, 175 bp, Zea mays
  misc_feature: Ceres CLONE 226872-F
agagccgcagcagcacactcccgcagtagcagcagccgccgccgccgccgcccagccgcagaaacaggaggaagatgccggcggggcacgggcttcggtcgcggacccgcmtggtatcgcgcggccgttccgcaagaagggttacatcccgctcaccacgtacctgcgcacctac

SEQ ID NO: 764 - DNA, 203 bp, Zea mays
  misc_feature: Ceres CLONE 226945-F
  misc_feature (51)..(51): n is a, c, t, g, unknown, or other
  misc_feature (52)..(52): n is a, c, t, g, unknown, or other
atcaccaatcagtcagtcacagctcacagcaaacaccgcgamscgcccccnntcccaaacccgaccgagcaaagcgcaaagccccccaaccgcggatcaatccgcagcatcgatggcgcccaaggcggagaaaaagccggctggyagagaagcccgctggaggaggagcccgctgacacgakaaggcggagaaggctccggca

SEQ ID NO: 765 - DNA, 450 bp, Zea mays
  misc_feature: Ceres CLONE 226947-F
  misc_feature: Translation starting site: 210
  misc_feature: SWISSPROT Homolog: EC 2.7.10.2 Non-specific protein-tyrosine kinase
  misc_feature (100)..(100): n is a, c, t, g, unknown, or other
  misc_feature (108)..(108): n is a, c, t, g, unknown, or other
  misc_feature (109)..(109): n is a, c, t, g, unknown, or other
  misc_feature (114)..(114): n is a, c, t, g, unknown, or other
  misc_feature (115)..(115): n is a, c, t, g, unknown, or other
ccctcttccatagcatagcagagcaggcgcaccgcacacctcactgccgctcccttctcgtctcgtctcctctcctctcmtcggcggatccggmaccganycaccgcnnctctnntcgttccttccgccggaatcgctgctccwctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggacacgggtgtgatggttggaatgggccagaaggacgcctatgtaggtgacgaggcacagtcaaaaagaggtatcttgaccttgaagtaccccattgascacggtatcgtgaacaactg

SEQ ID NO: 766 - DNA, 151 bp, Zea mays
  misc_feature: Ceres CLONE 226980-F
  misc_feature (28)..(28): n is a, c, t, g, unknown, or other
  misc_feature (66)..(66): n is a, c, t, g, unknown, or other
  misc_feature (67)..(67): n is a, c, t, g, unknown, or other
  misc_feature (108)..(108): n is a, c, t, g, unknown, or other
aacagcgaacacatctgcttcgcatttnttcccatcccccttcgcaacccaaaccccaactcgctnngcatcgatggcgcccaaggccgagaagaagcccgcggcganagaagccggcggaggaggagcccgcggctgagaaggcgcccgc

SEQ ID NO: 767 - DNA, 198 bp, Zea mays
  misc_feature: Ceres CLONE 226988-F
  misc_feature: Encodes the peptide sequence at SEQ ID NO. 768
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtc

SEQ ID NO: 768 - protein, 66 aa, Zea mays
  misc_feature: Ceres CLONE 226988-F
  misc_feature (30)..(30): Xaa is any aa, unknown, or other
  misc_feature (47)..(47): Xaa is any aa, unknown, or other
THTFRLSTPKVPFFFSIWKRRSSSHGRERXGGKAKKGAAGRKAGGRXKKSVSRSSRAGLQFPVSRV

SEQ ID NO: 769 - DNA, 451 bp, Zea mays
  misc_feature: Ceres CLONE 226991-F
  misc_feature: Encodes the peptide sequence at SEQ ID NO. 770
  misc_feature (39)..(39): n is a, c, t, g, unknown, or other
  misc_feature (233)..(233): n is a, c, t, g, unknown, or other
gtcgttctcgcgtctggagcagggcgcggacgagggcgncagggggagggcgatggaattctgcccggtgtgtgggattctgctgcagatcgatccgggcaccgataggccaccgcctgckcctcttctgccccgtctgcccctacgtctgccccatcctgaacaagatcgtgaagaaggcgaggttggtcaaaaaggaggtggagcccatctccagcacggcggatgagatnaaatcggcccctaagaccgcagttacatgccaaagatgcaaccatggagaagcatacttcaagcagatgcagattcgatcagctgatgaaccgatgacaacaatatacaggtgttgcaaagaagaaatgccagcatgaatggagagaggactgaccatagcattcgcactttrcttacacttcgctccctgtgcttcttcagttttgaagtgttggga

SEQ ID NO: 770 - protein, 122 aa, Zea mays
  misc_feature: Ceres CLONE 226991-F
  misc_feature (85)..(121): Pfam Name: TFIIS_C Pfam Description: Transcription factor S-II (TFIIS)
  misc_feature: SWISSPROT Homolog: EC 2.7.7.6 DNA-directed RNA polymerase
  misc_feature (13)..(13): Xaa is any aa, unknown, or other
  misc_feature (40)..(40): Xaa is any aa, unknown, or other
  misc_feature (77)..(77): Xaa is any aa, unknown, or other
RSRVWSRARTRAXGGGRWNSARCVGFCCRSIRAPIGHRLXLFCPVCPYVCPILNKIVKKARLVKKEVEPISSTADEXKSAPKTAVTCQRCNHGEAYFKQMQIRSADEPMTTIYRCCKEEMPA

SEQ ID NO: 771 - DNA, 153 bp, Zea mays
  misc_feature: Ceres CLONE 227004-F
  misc_feature (31)..(31): n is a, c, t, g, unknown, or other
  misc_feature (69)..(69): n is a, c, t, g, unknown, or other
  misc_feature (70)..(70): n is a, c, t, g, unknown, or other
  misc_feature (110)..(110): n is a, c, t, g, unknown, or other
aacaacagcgaacacatctgcttcgcatttnttcccatcccccttcgcaacccaaaccccaactcgctnngcatcgatggcgcccaaggccgagaagaagcccgcggganagaagccggcggaggaggagcccgcggctgaksaaggcgcccg

SEQ ID NO: 772 - DNA, 397 bp, Zea mays
  misc_feature: Ceres CLONE 227015-F
  misc_feature: Encodes the peptide sequence at SEQ ID NO. 773
  misc_feature (370)..(370): n is a, c, t, g, unknown, or other
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttngcgagtrggctgggctttgcaaggatt

SEQ ID NO: 773 - protein, 73 aa, Zea mays
  misc_feature: Ceres CLONE 227015-F
  misc_feature (50)..(50): Xaa is any aa, unknown, or other
  misc_feature (64)..(64): Xaa is any aa, unknown, or other
  misc_feature (67)..(67): Xaa is any aa, unknown, or other
MKKSSAHDGLVKGLREAAKAIEKHAAQLCVLAEDCDQPDYVKLVKALCAXTMFTWSLFLPLRPXASXLGFARI

SEQ ID NO: 774 - DNA, 471 bp, Zea mays
  misc_feature: Ceres CLONE 227024-F
  misc_feature: Translation starting site: 88
ctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctkagggg

SEQ ID NO: 775 - DNA, 463 bp, Zea mays
  misc_feature: Ceres CLONE 227035-F
  misc_feature: Encodes the peptide sequence at SEQ ID NO. 776
  misc_feature (84)..(84): n is a, c, t, g, unknown, or other
aaggtccaagcctccaaggctgctcccagcaactcgtttctttcttcgagagagggcaaaaaccggcaaggggagcgagvaagnagtctcgagagcaagggagcgcggtgacgtcatcgttttccaaggtttctcgatcggctgctatggcgaccagggcggcgtcgagattcmctgcagcgcrrctccctgtcttccggcggcaaggtcctcagcgagaggagaaggccgcggagaaagtgtacatcaagaaaatggaacaagagaagctggagaagctcgcacgcaagggccccagctcaggagagcaagcttcgtcgactacagtctctgcagcaagtgatgtgaaggctggggctgggcaacggagtcagcgtctgcaaacgtgtcaaccgacaagaacaggaactacgctgtcctggcaggcacaattgctgctctgagtggcctgggttggtatcta

SEQ ID NO: 776 - protein, 98 aa, Zea mays
  misc_feature: Ceres CLONE 227035-F
  misc_feature (10)..(10): Xaa is any aa, unknown, or other
  misc_feature (13)..(13): Xaa is any aa, unknown, or other
MATRAASRFXAAXLPVFRRQGPQREEKAAEKVYIKKMEQEKLEKLARKGPSSGEQASSTTVSAASDVKAGAGQRSQRLQTCQPTRTGTTLSWQAQLLL

SEQ ID NO: 777 - DNA, 386 bp, Zea mays
  misc_feature: Ceres CLONE 227037-F
  misc_feature: Encodes the peptide sequence at SEQ ID NO. 778
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggct

SEQ ID NO: 778 - protein, 69 aa, Zea mays
  misc_feature: Ceres CLONE 227037-F
  misc_feature (50)..(50): Xaa is any aa, unknown, or other
MKKSSAHDGLVKGLREAAKAIEKHAAQLCVLAEDCDQPDYVKLVKALCAXTMFTWSLFLPLRPLASGLG

SEQ ID NO: 779 - DNA, 150 bp, Zea mays
  misc_feature: Ceres CLONE 227058-F
atcaaagcaagccatgtggaggagggctttasgatggtcctgttcatggctggcgccgcgctgctcgccggggctgccggsccggsgcgcacaggggcgtgttggagcatcatcacccggcccatgttccagagcatgctgagccaccgc

SEQ ID NO: 780 - DNA, 455 bp, Zea mays
  misc_feature: Ceres CLONE 227067-F
  misc_feature: Encodes the peptide sequence at SEQ ID NO. 781
ctttttttgtattcgtcttgctccagccgccgtcggatcggatccgatcaaagcaagcagcagcagccggctcctcctccgcctcccgcagcagccacaccccgtccgtyaccagaggaagaggaggaggatgtcgggatcgaaggtgtacacccttgaggaggtggccaagcacaacaccaaggacgactgctggctcgtcatcggcggcaaggtgtacaatgtgaccaagtttctggaggaccaccctggagatgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatca

SEQ ID NO: 781 - protein, 108 aa, Zea mays
  misc_feature: Ceres CLONE 227067-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGDDDVLLSSTAKDATDDFEDVGHSTTARAMMDEYLVGEIDAATIPSKVKYTPPKQPHYNQDKTPEFVI

SEQ ID NO: 782 - DNA, 479 bp, Zea mays
  misc_feature: Ceres CLONE 227081-F
  misc_feature: Translation starting site: 248
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgggtccagtcgtccttctccatggtcacccccagctccgccgtgttccaggtgatcgtcggtgctgttgttggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtgggtggtttg

SEQ ID NO: 783 - DNA, 91 bp, Zea mays
  misc_feature: Ceres CLONE 227130-F
  misc_feature (23)..(23): n is a, c, t, g, unknown, or other
ctgaagtttcggcggcggcgtangtagcggcggtctcaaccccaggcgagctcggctccggtcacccgtcgatccacgcaaacatgtcgag

SEQ ID NO: 784 - DNA, 444 bp, Zea mays
  misc_feature: Ceres CLONE 227171-F
  misc_feature: Encodes the peptide sequence at SEQ ID NO. 785
  misc_feature (239)..(239): n is a, c, t, g, unknown, or other
  misc_feature (240)..(240): n is a, c, t, g, unknown, or other
gtctgttcttcggcctccatccccgcagagagagaaagagggagctctagacggggaggctcccaaatcgatatttttcrcatctgttcgttmtmcgamgmggcggcgaatctragaacccctcgctgagtggaggcggcgagtccgtgatggtcgrcggccggcgggcgcagacatgcacaaccgctcctcctcctccgccgccgctgcgtcgtcgttgccgctctcccccgccgacnnttcctgcgcgtgaaggacggcgtggacggaatgatcaagtacgtcgccaacgagccctccgtcgkgctctacttcgtccagcagcacgcccgggcttccatgcccctcctcctcgacgtcaagggtaagctcgtagaaagactcgcgaggtgacattgcacactgaagacatggaggattctatttgcgctgtgagatccmatg

SEQ ID NO: 785 - protein, 40 aa, Zea mays
  misc_feature: Ceres CLONE 227171-F
  misc_feature (12)..(12): Xaa is any aa, unknown, or other
MIKYVANEPSVXLYFVQQHARASMPLLLDVKGKLVERLAR

SEQ ID NO: 786 - DNA, 431 bp, Zea mays
  misc_feature: Ceres CLONE 227187-F
  misc_feature (55)..(55): n is a, c, t, g, unknown, or other
  misc_feature (56)..(56): n is a, c, t, g, unknown, or other
  misc_feature (111)..(111): n is a, c, t, g, unknown, or other
  misc_feature (112)..(112): n is a, c, t, g, unknown, or other
  misc_feature (413)..(413): n is a, c, t, g, unknown, or other
acagaaccctgcaactgcaagctaaggagagtgtgatcaccaacagctagtgctnntcccccttccttccatccatccatggcatgcgtcvrccttctcagkwkctgychnnttgccagaagagcaaagatcaacaccaggtccaggggcagcagcagtagcgtggcgaaggggtcaccaccaccagccttccagttccagtgcagggcgtcgactttcgcggcggacaccagcctccggtcgagctggacgagaaccccgaggcgatcatctcgggggcgtggccgggaactgctccctcctcagctacgacgacctccgcgcctamctcgagtcgcaggagacggcggcccaggcagacgatcagcgtggcgtggcgctcctgagcgagaccatgtccacacccgtgctanwtkgccacagcagaccag

SEQ ID NO: 787 - DNA, 323 bp, Zea mays
  misc_feature: Ceres CLONE 227193-F
  misc_feature: Encodes the peptide sequence at SEQ ID NO. 788
  misc_feature (28)..(28): n is a, c, t, g, unknown, or other
acggcggcttccggctcgtgcgcgcgcngtgttccgggcgagaagagctgccaagggatggaggcgctgaggaagcaggcgagcaakttcaaggagcaggtcgccaagcagcagcrggctgttatagagcaattcagtactactggctatgagcggtcagattccattgtaattgatgaggttgaactacagrgacatcaacagcttgagaaattgtatacttctactcgttctgtaagggwtttccagaggggacatrkttagagcagctgaaggtttggtgtmtattggaaacaaacatattraagtgggaacaaaatttt

SEQ ID NO: 788 - protein, 67 aa, Zea mays
  misc_feature: Ceres CLONE 227193-F
  misc_feature (10)..(10): Xaa is any aa, unknown, or other
  misc_feature (20)..(20): Xaa is any aa, unknown, or other
  misc_feature (46)..(46): Xaa is any aa, unknown, or other
  misc_feature (62)..(62): Xaa is any aa, unknown, or other
MEALRKQASXFKEQVAKQQXAVIEQFSTTGYERSDSIVIDEVELQXHQQLEKLYTSTRSVRXFQRGH

SEQ ID NO: 789 - DNA, 188 bp, Zea mays
  misc_feature: Ceres CLONE 227205-F
  misc_feature: Encodes the peptide sequence at SEQ ID NO. 790
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaatggcgcggcggggcgcaaggccggcgggcgancgaagaagtcggtgtcgcggtcctccagggccgggctgcagttccccgt

SEQ ID NO: 790 - protein, 62 aa, Zea mays
  misc_feature: Ceres CLONE 227205-F
  misc_feature (30)..(30): Xaa is any aa, unknown, or other
  misc_feature (47)..(47): Xaa is any aa, unknown, or other
THTFRLSTPKVPFFFSIWKRRSSSHGRERXGGKAKNGAAGRKAGGRXKKSVSRSSRAGLQFP

SEQ ID NO: 791 - DNA, 441 bp, Zea mays
  misc_feature: Ceres CLONE 227222-F
  misc_feature: Pfam Name: SRF-TF Pfam Description: SRF-type transcription factor (DNA-binding and dimerisation domain)
  misc_feature (80)..(80): n is a, c, t, g, unknown, or other
  misc_feature (175)..(175): n is a, c, t, g, unknown, or other
  misc_feature (348)..(348): n is a, c, t, g, unknown, or other
aacccatctcctgagtcctgcctgcgctcgcctcagctcctttcttccccgccccttggcttttgcttggttgcatcggncmggtcgagccggaraggaaaagctagctactagctaccagctctcggccggcggtggtagtmatgcctgcagctggrgttagctgcaaggrttnggagctagccatagggaggggtcgggtggagctgaagcgatcgagaacaagatcaaccgccagtcaccttcgmhaagcgccgcaacggcctgctcaagaaggcgtacgagctctccgtgctctgcgacgmhgaagtcgcgctcatcatcttctccaaccgcggcaagctctangagttctgcagcggacagagcatcaccaaaacacttgagaggtatgaaaaaaacadttatggaggaccagatactdctgtacagaacaaggag

SEQ ID NO: 792 - DNA, 457 bp, Zea mays
  misc_feature: Ceres CLONE 227231-F
  misc_feature: Encodes the peptide sequence at SEQ ID NO. 793
cccgttcacttctctttggcccgaaaccgagagctagtgcttgattcggtcgtttttgggcaccgaacacgttcttggagaccgccgccgccrcmctacttccagtcccagctgctcaggtctccatcggcctcgagccctttagccggcgacgagcactcacaacaccagaggtgtaacaatgtcttcttcaatggaatcgtcataccttcctgctacaactgagtcattagcccaagctcaagaggctaaggatgcttcagagtccatttcaatcctttaccgtgtcattcaggacccatcttcttctgctgatgcactgagaacaaaagaagttgcaattacaaatcttacaaactacctcactaaagaaaacagagctgaggagctgcgtaatcttttgacccagctcagaccattttttgcagttattcctaaggcaaagactgcaaaaatt

SEQ ID NO: 793 - protein, 92 aa, Zea mays
  misc_feature: Ceres CLONE 227231-F
MSSSMESSYLPATTESLAQAQEAKDASESISILYRVIQDPSSSADALRTKEVAITNLTNYLTKENRAEELRNLLTQLRPFFAVIPKAKTAKI

SEQ ID NO: 794 - DNA, 142 bp, Zea mays
  misc_feature: Ceres CLONE 227315-F
  misc_feature: Encodes the peptide sequence at SEQ ID NO. 795
  misc_feature (60)..(60): n is a, c, t, g, unknown, or other
agaatacccccaccagcaggcggccccctcttactccacgaccaccaccgtcttctggcngtacgcgactcgccgcagaaagagagccgaggacggcagcgacctctcgctggcgtcggatatggatctcgacgccgacgcg

SEQ ID NO: 795 - protein, 47 aa, Zea mays
  misc_feature: Ceres CLONE 227315-F
  misc_feature (20)..(20): Xaa is any aa, unknown, or other
EYPHQQAAPSYSTTTTVFWXYATRRRKRAEDGSDLSLASDMDLDADA

SEQ ID NO: 796 - DNA, 124 bp, Zea mays
  misc_feature: Ceres CLONE 227322-F
  misc_feature (30)..(30): n is a, c, t, g, unknown, or other
  misc_feature (74)..(74): n is a, c, t, g, unknown, or other
aacaacagcgaacacatctcctcgcatttnttcccatccgatccccccttcgcaaccaaaaccccaactcgccnhgcatcgatggcgcccaaggccgagaagaaacccgcggcgaagaakccgg

SEQ ID NO: 797 - DNA, 418 bp, Zea mays
  misc_feature: Ceres CLONE 227326-F
  misc_feature: Encodes the peptide sequence at SEQ ID NO. 798
  misc_feature (2)..(2): n is a, c, t, g, unknown, or other
anagaaaaacggtgagctagaaacttccaaatcgaacggcacacaaaaatcacaacccggaadggaccagcagcgcaaaggtgagcgagctttccttcggaactctcgtgctcacctcatccgtccgacaaatccacacgaatcctctgattcagagcagggtgttggcattgatcagacgcctgcyatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagatgaagaagccggtgtcgaagagggaagctgaagagggaaagctgaagcagggggtctctgcg

SEQ ID NO: 798 - protein, 77 aa, Zea mays
  misc_feature: Ceres CLONE 227326-F
  misc_feature (10)..(77): Pfam Name: S1FA Pfam Description: DNA binding protein S1FA
  misc_feature: The sequence is a functional homolog of SEQ ID NO 1769 in the 11/479,226 US patent application
  misc_feature: The sequence is a functional homolog of SEQ ID NO 2604 in the 10/374,780 US patent application
  misc_feature: The sequence is a functional homolog of SEQ ID NO 960 in the 10/225,066 US patent application
MADQFVDSANNVIIEEVNKGLNPGMVVLLVVASFLLLFFVGNYALYVYAQKTLPPKMKKPVSKREAEEGKLKQGVSA

SEQ ID NO: 799 - DNA, 125 bp, Zea mays
  misc_feature: Ceres CLONE 227345-F
  misc_feature (32)..(32): n is a, c, t, g, unknown, or other
  misc_feature (70)..(70): n is a, c, t, g, unknown, or other
  misc_feature (71)..(71): n is a, c, t, g, unknown, or other
aaacaacagcgaacacatctgcttcgcatttnttcccatcccccttcgcaacccaaaccccaactcgctnngcatcgatggcgcccaaggccgagaagaagcccgcggcgagagaagccggcgga

SEQ ID NO: 800 - DNA, 411 bp, Zea mays
  misc_feature: Ceres CLONE 227361-F
  misc_feature: Encodes the peptide sequence at SEQ ID NO. 801
attccacctgcttggtccatcagcagcgagcgaacagggaaaaaggagaggccgagaagcgctttasattaaagactggtgcacccgtagcggcacggcatggcggccacggcgtactccgtggcgctcctcggcggcgcacstgccggccgccctcctccctcggcgcmsagcgtgtgccaccagcagcttcgcctccaagacgcgccgaggctctccctgcaccgtgccagggccgcttccgaggacacgtcggcctccggsgggcgacgagctcatcgaagacctcaaggcaaagtgggacgccgttgaggacaagcccaccgtcctcctgtacggcggcggcgctcgktgggcsctaatggttgacgtccgttgttgtcggcggccatcaacgccgtgccgctgctc

SEQ ID NO: 801 - protein, 70 aa, Zea mays
  misc_feature: Ceres CLONE 227361-F
  misc_feature (15)..(15): Xaa is any aa, unknown, or other
  misc_feature (24)..(24): Xaa is any aa, unknown, or other
MAATAYSVALLGGAXAGRPPPSAXSVCHQQLRLQDAPRLSLHRARAASEDTSASGGRRAHRRPQGKVGRR

SEQ ID NO: 802 - DNA, 201 bp, Zea mays
  misc_feature: Ceres CLONE 227365-F
  misc_feature: Encodes the peptide sequence at SEQ ID NO. 803
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggckcaaggycggcgggcgancgaagaagtcggtgtcgcggtcctccagggccgggctgcagttccccggtcagccgcgtcgg

SEQ ID NO: 803 - protein, 67 aa, Zea mays
  misc_feature: Ceres CLONE 227365-F
  misc_feature (30)..(30): Xaa is any aa, unknown, or other
  misc_feature (41)..(41): Xaa is any aa, unknown, or other
  misc_feature (43)..(43): Xaa is any aa, unknown, or other
  misc_feature (47)..(47): Xaa is any aa, unknown, or other
THTFRLSTPKVPFFFSIWKRRSSSHGRERXGGKAKKGAAGXKXGGRXKKSVSRSSRAGLQFPGQPRR

SEQ ID NO: 804 - DNA, 244 bp, Zea mays
  misc_feature: Ceres CLONE 227375-F
aacaacaccagaatccgcgaatcacagacgcgtctatctcagcttgctgcactgcactaccctgccctgccatcatatcgtacgtgagcccggccgagcgagasmgggagaggcatggctgctccgaagctcgcgacgctggcgctggccgtgctcctggcggcgaccgtggtaggctcccccggccgcggtgcgcgcgggaatgtcgtgctccaccgtgtacagcacgctgatgccgtgcctg

SEQ ID NO: 805 - DNA, 205 bp, Zea mays
  misc_feature: Ceres CLONE 227389-F
  misc_feature: Encodes the peptide sequence at SEQ ID NO. 806
atacatttcgactctcaactcccaaggtcccttttttttctcgatctggaagcgccgcagtagcagccatggacgtgagcggasaggcgggaaggcgaagaagggcgcggccgggcbwatgycggcgggcgacgaagaagtcggtgtcgcggtcctccagggccgggctgcagttccccgtcagccgcgtcgggcgtacctcaaa

SEQ ID NO: 806 - protein, 45 aa, Zea mays
  misc_feature: Ceres CLONE 227389-F
  misc_feature (6)..(6): Xaa is any aa, unknown, or other
  misc_feature (17)..(17): Xaa is any aa, unknown, or other
MDVSGXAGRRRRARPGXCRRATKKSVSRSSRAGLQFPVSRVGRTS

SEQ ID NO: 807 - DNA, 238 bp, Zea mays
  misc_feature: Ceres CLONE 227432-F
  misc_feature: Encodes the peptide sequence at SEQ ID NO. 808
  misc_feature (182)..(182): n is a, c, t, g, unknown, or other
gatctggaagcgccgcagtagcatccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcanttaggcacgggtgcccccgtctacctcgccgccgtcctggagtacctcgcggccga

SEQ ID NO: 808 - protein, 79 aa, Zea mays
  misc_feature: Ceres CLONE 227432-F
  misc_feature (14)..(14): Xaa is any aa, unknown, or other
  misc_feature (61)..(61): Xaa is any aa, unknown, or other
IWKRRSSIHGRERXGGKAKKGAAGRKAGGRRRSRCRGPPGPGCSSPSAASGVPQKGPVRAXRHGCPRLPRRRPGVPRGR

SEQ ID NO: 809 - DNA, 423 bp, Zea mays
  misc_feature: Ceres CLONE 227465-F
  misc_feature: Translation starting site: 57
  misc_feature: Pfam Name: DUF1751 Pfam Description: Eukaryotic integral membrane protein (DUF1751)
aaggcaacaagggagaagtagatctgcatctgckagaggaggcagcgggggtggtgatgatggagagccagccgctgcaggccccgacggccacggctccgcccccggatctgcggascagccggagccccgccggccgtcatccccggcaaggagttcacgcgcacctgcaaggcctcgtcgtcgtgctcatcggaggatacgtgctgctccagctcctcccttcgtcgctcaactacctcgccatcatcccatccaagacaatcccctatgtatgggaccgttttcactgctggttacatcgagcaagtcctcccaggggccattggcagttctcttggtcttctcttttgtggaaaggacattgaaccagcatggggccgcaaggaattcttgaagttcattattttgatcaactccgtc

SEQ ID NO: 810 - DNA, 648 bp, Zea mays
  misc_feature: Ceres CLONE 227466-R
  misc_feature (479)..(479): n is a, c, t, g, unknown, or other
caattgggtaccgggccccccctcgaggtcgacggtatcgataagcttttttttttttttttttcagcaacgtgcatgggtcatcgtccattctttgatgagcagagcaggcacatgaatttcagaacactaatttacaatttaaactaactttacatgaacatatatgatggaagcaaacaagatagaactcgctccaattaatctgaacgcgtgctgcagatccttccaatgatatatcatctgtctctctctcgatctctactgcaacccgatgtggctgttgagcagcagctgctgctgctggttcaagttcaagaacgggttgttgctgctgtagccgtacccgtacccgtactgatggaagaagccgccgctactgttactgttactgctactcgggctgtgcacgaactgctgctggctgtcgcggtagctggtcgccgttgcggtgccgaaatggccgccatgcctcaatncactctggccggcggccgcggcttgatcttcttggcactgaagctgtggccggccgcatcatcaaggtggtggaagaaggacggcggttcagcggccccgtactagtgcacggcaggttctcgcttcctcttgttgacacacttggtgtctgctggcgacgacctgagt

SEQ ID NO: 811 - DNA, 631 bp, Zea mays
  misc_feature: Ceres CLONE 227487-R
  misc_feature: Translation starting site: 456
ccaattgggtaccgggccccccctcgaggtcgacggtatcgataagcttttttttttttttttttggatgtacaaagagaaccaatagtgttactcgacaagtacagttataatatgatcctaggtactttattaatttccatcctcagttttttgtggttgatgttttcaccactagcaacaaatttggcatggaaaggagctggagcaatgcatgcattgtagtgagccacaaaatataaatcccaaaatataaattcaacaacattgcctgctcaaaggcatgcaatcccaaacatagtagcttatatgaaaaacactcaaggaataaataaaatggagccgaagggggacccagagcttagaagcacttccgatgaacaatcccaggtcctgactcgtcatactcagcctttgagatccacatctgttggaaggtgctcagggaggcaaggatggatcctcctatccagacactgtatttcctctcaggcggtgccaccaccttgattttcatgctgctcggcgcaagggcagtgatctccttgctcatacggtccgcaataccagggaacatggtcgtgccaccactgagcacaatgttaccatacaagtccttcctgatgtcgaa

SEQ ID NO: 812 - DNA, 140 bp, Zea mays
  misc_feature: Ceres CLONE 227516-F
cacagaccacgccacgttcgcaattacagagatctagagagagagagagagagagagagagggcakatctacgctagagcgacagagccacaaccaccgcgagagggacagtccagtattgtggtggcgctcgggcccgg

SEQ ID NO: 813 - DNA, 320 bp, Zea mays
  misc_feature: Ceres CLONE 227536-F
  misc_feature: Encodes the peptide sequence at SEQ ID NO. 814
aagcaagaacagctgtcgatccaattgtyacttgctctccctccaacaagctaattaaggccggtcgtcatccctcttctagctcgttttattatccatggcggaggagaagcaccaccaccaccacctgttccaccataagaaggacgaggagcaggaggagctgctcgccggcggggttacggcgagtccgcsagttacacggaggccacggtgacggaggtggtgtccacgggcgagaacgagtacgacgagtacaaggaggagaagcagcataagcacaagcagcacctcggcgaggccggcgccatcgcsccggg

SEQ ID NO: 814 - protein, 39 aa, Zea mays
  misc_feature: Ceres CLONE 227536-F
  misc_feature (33)..(33): Xaa is any aa, unknown, or other
MAEEKHHHHHLFHHKKDEEQEELLAGGVTASPXVTRRPR

SEQ ID NO: 815 - DNA, 490 bp, Zea mays
  misc_feature: Ceres CLONE 227614-F
  misc_feature: Encodes the peptide sequence at SEQ ID NO. 816
aaaagaaaaacggtgagctagaaacttccaaatcgaacggcacacaaaaatcacaacccggaawgggaccagcagcgcaaaggtgagcgagctttccttcggaactctcgtgctcacctcatccgtccgacaaatccacacgaatcctctgattcagagcagggtgttggcattgatacagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctctgcgccgggagagtaaacggccatgctgccgatcctcccgtccagagctcctattcacatgattattaaagaa

SEQ ID NO: 816 - protein, 80 aa, Zea mays
  misc_feature: Ceres CLONE 227614-F
  misc_feature (10)..(80): Pfam Name: S1FA Pfam Description: DNA binding protein S1FA
MADQFVDSANNVIIEEVNKGLNPGMVVLLVVASFLLLFFVGNYALYVYAQKTLPPKKKKPVSKKKLKREKLKQGVSAPGE

SEQ ID NO: 817 - DNA, 308 bp, Zea mays
  misc_feature: Ceres CLONE 227618-F
ctagccgcactgcgctcatttctgcatccccctcccgccgcgccgcctcaccgccgccggagaagatgggtcgcgtgatccgcgcgcastaaagggtgcggggtccatgttcaagtcccacacccaccaccgcaaggccccgccgctttccgctccctcgacttcggcgagcgcaacgggtacctcaagggcgtcgtcaccgastcatccacgaccccggccgtggcgcgccgctcgccaaggtcactttccgccacccattcaggtacaagcaccagaaggagctctttgtcgcagccgagggcatg

SEQ ID NO: 818 - DNA, 481 bp, Zea mays
  misc_feature: Ceres CLONE 227649-F
  misc_feature: Encodes the peptide sequence at SEQ ID NO. 819
  misc_feature (111)..(111): n is a, c, t, g, unknown, or other
atttttcgaccgccgccgcccccagtccccgatccgaagctgtgcctcgtaccatttcgatccaatggcgccgacgtcgaagctgtcgacgggcatcaagcgcgcttcsgntcgcacacgtaccatcgccgtgggctgtgggccatcaaggcaagaacggcggcgcttccccaaggccgacaaggcgcccgccgaccgtggaacccaagttctaccctgccgacgacgatcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttcaagatcaatggagtaccgatccgccgtgtgaaaccagacctaatgtcattgctacatcaaccaaagttgacatctctgggtgttgatg

SEQ ID NO: 819 - protein, 160 aa, Zea mays
  misc_feature: Ceres CLONE 227649-F
  misc_feature (37)..(37): Xaa is any aa, unknown, or other
IFRPPPPPVPDPKLCLVPFRSNGADVEAVDGHQARFXSHTYHRRGLWAIKARTAALPQGRQGARRPWNPSSTLPTTIKPRVPSTRKPKPTKLRSSITPGTVLILLAGRFMGKRVVFLKQLKSGLLLISGPFKINGVPIRRVKPDLMSLLHQPKLTSLGVD

SEQ ID NO: 820 - DNA, 481 bp, Zea mays; identical to SEQ ID NO: 818
  misc_feature: Ceres CLONE 227649-F2
  misc_feature (111)..(111): n is a, c, t, g, unknown, or other

SEQ ID NO: 821 - DNA, 730 bp, Zea mays
  misc_feature: Ceres CLONE 227695-R
  misc_feature: SWISSPROT Homolog: EC 1.11.1.6 Catalase
cgattgctgtcgcggccccgcctcgaggtcgacggtatcgataagtgttttttttggttttgaaggaaactgcacatggccatattcatatttagcaaccgatcaacaactggctactgagtgagattaacgactagacacggggtgtttcttatcgcaagtttggaactctgaagaagaaggaagcgtctaataattgtcacgtcgtgacctctcggatctggaccgtcagtcatacttcctgctgcgagcaaacggggcatcgaacgaggccgttctcgttacagacggcgcaagtgcggaagccgctgccgcccttggcgctgcaccctccgcaaccgttgccgcacttgcaaccggaaccgcaaccacagttgcctccgcagcacgacatcctctctctctcgacctcgcaaacgagaacacggatgaactgaaccaaccaaactcacattcgcagtttttcgattacgatgttctaggtaatgggctcgtgcgaattcctgcagcccgggggatccactatttctacaacggccaccaccgcggaggagctccagcttatgatccctttagtgaaggttaattgcacgcttggcgtaatcatggtcatagctgtttcgtgtgtgaaattgatatccgctcacgattccacacaacatacgcagctgaaacataaagtgtatagtctggcgtgcctaatgagtgagctaactcacattaatgcgcg

SEQ ID NO: 822 - DNA, 384 bp, Zea mays
  misc_feature: Ceres CLONE 227736-F
  misc_feature: Encodes the peptide sequence at SEQ ID NO. 823
  misc_feature (149)..(149): n is a, c, t, g, unknown, or other
aacccattccccaattcagtatcaggcctttgcgaattgcgacacggagagcgggaagaggaaactcgaaactcggcgagcgggatggcaaccggcccggagcacgtggcggcggcggtcgaggagacgccggagaagaaggcggccanacaaccgagctccccgcaccctacaggctggacgaagaaggttgctccaactcgaggtggacgatttgaggttatttttgtttccccaactggtgaggaagttaagagcaagagacagctaacccagtacctgaaagctcatcctggagggcctgcatcctcagagttcgattggggaacagtgatactcccagacgctcagcacgcttgawcgagaaggtcaaggcaactgaga

SEQ ID NO: 823 - protein, 91 aa, Zea mays
  misc_feature: Ceres CLONE 227736-F
  misc_feature (18)..(88): Pfam Name: MBD Pfam Description: Methyl-CpG binding domain
  misc_feature (22)..(22): Xaa is any aa, unknown, or other
MATGPEHVAAAVEETPEKKAAXQPSSPHPTGWTKKVAPTRGGRFEVIFVSPTGEEVKSKRQLTQYLKAHPGGPASSEFDWGTVILPDAQHA

SEQ ID NO: 824 - DNA, 418 bp, Zea mays
  misc_feature: Ceres CLONE 227744-F
  misc_feature: Encodes the peptide sequence at SEQ ID NO. 825
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrmatcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaagg

SEQ ID NO: 825 - protein, 109 aa, Zea mays
  misc_feature: Ceres CLONE 227744-F
  misc_feature (25)..(106): Pfam Name: Ribosomal_L7Ae Pfam Description: Ribosomal protein L7Ae/L30e/S12e/Gadd45 family
  misc_feature (28)..(28): Xaa is any aa, unknown, or other
  misc_feature (80)..(80): Xaa is any aa, unknown, or other
MAEQEAPVVVEAPTPVLGEPMDLMTALXIVMKKSSAHDGLVKGLREAAKAIEKHAAQLCVLAEDCDQPDYVKLVKALCAXTMFTWSLFLPLRPLASGLGFARLTLRARQ

SEQ ID NO: 826 - DNA, 430 bp, Zea mays
  misc_feature: Ceres CLONE 227758-F
  misc_feature: Encodes the peptide sequence at SEQ ID NO. 827
cagacttccagcatctccgctccggctgcgctctgccttgctttcctgctacctgctctagcgcgasatgcgaggtacggcggccgatctggcggcgcaggcggagggctcggccggggccggcaagtcggcgccgaacatggggaggggccgggtcgagctcaagcgatcgagaacaagatcaaccgccagtcaccttcgccaagcgccgcaacggcctgctcaagaaggcgtacgagctctcggtgctctgcgacgccgaggtcgcgctcatcatcttctccaaccgcgcaactctacgagttctccagcacgcagagcatgccaaaaacacttgaaaagtaccaaaaatgcagttttgcagggcctggaacagcactccagaatagagagaatsgagcaactgaaaagtagccgcaatgagtacctc

SEQ ID NO: 827 - protein, 111 aa, Zea mays
  misc_feature: Ceres CLONE 227758-F
  misc_feature (52)..(104): Pfam Name: SRF-TF Pfam Description: SRF-type transcription factor (DNA-binding and dimerisation domain)
  misc_feature: The sequence is a functional homolog of SEQ ID NO 1965 in the 10/412,699 US patent application
  misc_feature (22)..(22): Xaa is any aa, unknown, or other
DFQHLRSGCALPCFPATCSSAXCEVRRPIWRRRRRARPGPASRRRTWGGAGSSSSDREQDQPPVTFAKRRNGLLKKAYELSVLCDAEVALIIFSNRATLRVLQHAEHAKNT

SEQ ID NO: 828 - DNA, 487 bp, Zea mays
  misc_feature: Ceres CLONE 227803-F
  misc_feature: Encodes the peptide sequence at SEQ ID NO. 829
gtcgtactcgcagtctcgcacacacccgtcccgccgtccccatcctcttccggtgtctgtccatcccctccgtcgaccgccgcgtccggccgckcaacccgacctgtgtcaatcgccatgactacctcaaggcgtcttgctgataggaagatatcacgatttgagaagaatatcacaaagaggggctctgttcctgagacagccaagaaggcaaacgattatcctgttggacctattcttcttgggttctttgtcttcgtggttgttggatcatctctctttcagatcatcaagacagcatcaaacgctggtctattctgaggtgaatcagttgacatatgcagtttgtcactagaaactatacaagtgcagggcgtggcttaatgtcgcctttttaatgttgtaccgtggagagttttaagttatatatgtaatgggagtgctaatttaagtcacctgtctgacaggaaagatgttgaagtagtcc

SEQ ID NO: 829 - protein, 67 aa, Zea mays
  misc_feature: Ceres CLONE 227803-F
  misc_feature (1)..(63): Pfam Name: RAMP4 Pfam Description: Ribosome associated membrane protein RAMP4
MTTSRRLADRKISRFEKNITKRGSVPETAKKANDYPVGPILLGFFVFVVVGSSLFQIIKTASNAGLF

SEQ ID NO: 830 - DNA, 470 bp, Zea mays
  misc_feature: Ceres CLONE 227837-F
  misc_feature: Translation starting site: 285
  misc_feature: Pfam Name: eIF-5a Pfam Description: Eukaryotic initiation factor 5A hypusine, DNA-binding OB fold
  misc_feature (379)..(379): n is a, c, t, g, unknown, or other
atcgcttatcatctgcgcctctacatttcttctctctctgctcctccgcctccgcctgatccatccaagacagggatcgccatgtcggawctcggarmgagcaccacttcgaatcgaaggmmgacgctggggcgtccaagacctacmcgcagcaggctggcaccgtccgtaagaacggcttcatcgtcatcaagaaccgtcmmtgcaagttgtggaggtwtctacctccaagactggtaagcawmggccacgchaatgccactttgtcgccatagacatattcaatgggaaaaarmcttgaagatattgttccttcatcamacaactgtgacattccgcatgtgaaccgtactgagtatcagckgattgaatattyctnaggatgghtttgtgagccttcttacttcagatggcaacactaaggatgatcttagactcccahactgatgagactcttgtggcccagatta

SEQ ID NO: 831 - DNA, 398 bp, Zea mays
  misc_feature: Ceres CLONE 227869-F
  misc_feature: Translation starting site: 196
  misc_feature: SWISSPROT Homolog: EC 3.1.3.16 Phosphoprotein phosphatase
  misc_feature (172)..(172): n is a, c, t, g, unknown, or other
gagtcgaggaaaaatctcgcattctcaaaccaggcaaatggaggcatgagctccgccgcctccccgtctctcgccgatctcccccaaaccctagcctcgacctgaccgccagcgggcccgcagccggagaaggagtcggagtcgcccccacccaccctctcctctgccgcgngcggggagcgggcggcggacgagatgccgtcgcacggggatctggaccggcagatcghgcmtgcgcactgcaagtacctgcccgaggcggaggtcaaggcgctctgsagcaggcckaaggccatccttatggaggaatggaacgtggcagcccgtgcgctgccccmgtcaccgtctgcggcgacatccacggccagttctatgacctcatcgagctcttccgcatc

SEQ ID NO: 832 - DNA, 476 bp, Zea mays
  misc_feature: Ceres CLONE 227886-F
  misc_feature: Translation starting site: 115
  misc_feature: Pfam Name: HSP70 Pfam Description: Hsp70 protein
  misc_feature: SWISSPROT Homolog: EC 1.4.1.2 Glutamate dehydrogenase
actctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagttttgcagccg

SEQ ID NO: 833 - DNA, 230 bp, Zea mays
  misc_feature: Ceres CLONE 227923-F
  misc_feature (134)..(134): n is a, c, t, g, unknown, or other
attttccactttcgagcgcagaaacgagagggcaggagcagccgcagtcccggcgatcccgccgccggtcgccctcatacttcctcgtcactgccttcgtttctytttccaacaatcaagatgagccgtggcgntacgcgggttggtcaaagttctctgggttacctctttagaagcggtgagccccccaaaccagcagtggcaccagctaagtgctccacctgctgctg

SEQ ID NO: 834 - DNA, 189 bp, Zea mays
  misc_feature: Ceres CLONE 227925-F
  misc_feature (139)..(139): n is a, c, t, g, unknown, or other
atcttgctctgaacgcattcctcccatctcccaagacctcctcagacccgagaagcgcavkgcggccatggacgccaccggcactggagctggagggaaggcgaagaagggagcggccggtcgcaaggccgcgggcganggaagaagtcggtgacgaggtccgtgaaggccgggmtccagttccccgtc

SEQ ID NO: 835 - DNA, 486 bp, Zea mays
  misc_feature: Ceres CLONE 227970-F
  misc_feature: Encodes the peptide sequence at SEQ ID NO. 836
aattagacggataatatcgtcctccgcgggacaaggcacctcacgagcccttctcgtcctcagatctagcgccgcctccttcaccctgctgctggccgcctggcggcgagctcctcagcgtgcttgtgatgataatgccacaacatcttctacaagcaagatcaggaagaagacaaaaaacgttatagtgaagaggaggggttgattgctgcattcaaaagtgtcggggataccttatccaatgctactgagaaggttgccacaggggacactgatgtgccagatgatctttttatagtttgataaacctttcaggttttgagcagacccacatatctctgtatttcaattatctggtggcgcaccctcacattgctagagccttcaacaagttgtcattcgaccacaagttaatctgggctcgcaatttcgtcagtgaaaagttcctaggagtgtgagggcagttggtaggtaggcttggagggt

SEQ ID NO: 836 - protein, 67 aa, Zea mays
  misc_feature: Ceres CLONE 227970-F
IRRIISSSAGQGTSRALLVLRSSAASFTLLLAAWRRAPQRACDDNATTSSTSKIRKKTKNVIVKRRG

SEQ ID NO: 837 - DNA, 498 bp, Zea mays
  misc_feature: Ceres CLONE 227983-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggmtgctcctgtgtcgtcgtcaaggactacggtgaagaatcttgagggccttyacatagtgcaggagtatgtc

SEQ ID NO: 838 - DNA, 447 bp, Zea mays
  misc_feature: Ceres CLONE 227997-F
  misc_feature: Translation starting site: 179
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtc

SEQ ID NO: 839 - DNA, 431 bp, Zea mays
  misc_feature: Ceres CLONE 228022-F
  misc_feature: Encodes the peptide sequence at SEQ ID NO. 840
  misc_feature (138)..(138): n is a, c, t, g, unknown, or other
  misc_feature (204)..(204): n is a, c, t, g, unknown, or other
  misc_feature (421)..(421): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctgcagttccccgtcagccgcgtcgggcgtnacctcaaaaagggccggtacgcgcabgtarggcacgggtgccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctgggccggcgtcaccatcgcccacgggncgtccctccc

SEQ ID NO: 840 - protein, 143 aa, Zea mays
  misc_feature: Ceres CLONE 228022-F
  misc_feature (52)..(124): Pfam Name: Histone Pfam Description: Core histone H2A/H2B/H3/H4
  misc_feature (29)..(29): Xaa is any aa, unknown, or other
  misc_feature (46)..(46): Xaa is any aa, unknown, or other
  misc_feature (68)..(68): Xaa is any aa, unknown, or other
  misc_feature (76)..(76): Xaa is any aa, unknown, or other
  misc_feature (78)..(78): Xaa is any aa, unknown, or other
  misc_feature (140)..(140): Xaa is any aa, unknown, or other
SYISTLNSQGPFFFSIWKRRSSSHGRERXGGKAKKGAAGRKAGGRXKKSVSRSSRAGLQFPVSRVGRXLKKGRYAXVXHGCPVYLAAVLEYLAAEVLELAGNAARDNKKTRIIPRHVLLAIRNDEELGKLLGRRHHRPRXVPP

SEQ ID NO: 841 - DNA, 387 bp, Zea mays
  misc_feature: Ceres CLONE 228138-F
  misc_feature: Encodes the peptide sequence at SEQ ID NO. 842
gcgtcagacagagaaagccgagattagcggcggcggcgatggcactcccggcgtcaagctccggcctcttccgcttcgtctccccccgcagtcgtccccagtccaccgacatcgtggccgctgcctcctggggagtcttcgccggcaccgccgcttcctacctcgtccagccatttgactggattaagaagactttcttcgataaacctgaaccagaggcatgagtctccaggcagaaaatgctgcaaatctgcaactttggtacaccactttttgtccggggatgatttcctgatgataactcagcaaataatatgagaccctctcgtctttccttgttgattttattcagatgtaggcattcctcttgcatgtaatctttcacga

SEQ ID NO: 842 - protein, 61 aa, Zea mays
  misc_feature: Ceres CLONE 228138-F
MALPASSSGLFRFVSPRSRPQSTDIVAAASWGVFAGTAASYLVQPFDWIKKTFFDKPEPEA

SEQ ID NO: 843 - DNA, 222 bp, Zea mays
  misc_feature: Ceres CLONE 228258-F
  misc_feature (79)..(79): n is a, c, t, g, unknown, or other
attttacgcgaggacggataggacattcggcgttcctaggtaccccgctgcttccgtgctcacctcgcctgcaggsckncagccgctggaagaacacgaagacgacgggagtgcggggtggcgtcgcgctggagcaccactgtagccgccggctaggcctccgcgccgctctccgtrgccaacgcgccgtcatgctttcggcgtcggcgcggcggctgtccg

SEQ ID NO: 844 - DNA, 105 bp, Zea mays
  misc_feature: Ceres CLONE 228327-F
  misc_feature (77)..(77): n is a, c, t, g, unknown, or other
aatctctctmgctttctctagccatgacgctggtgaggatgccttgccgcctctgctgcttcctgctcgtcgtcgcngcctccgccgtctccgggcgggggcgcg

SEQ ID NO: 845 - DNA, 433 bp, Zea mays
  misc_feature: Ceres CLONE 228352-F
  misc_feature: Translation starting site: 75
  misc_feature (2)..(2): n is a, c, t, g, unknown, or other
  misc_feature (422)..(422): n is a, c, t, g, unknown, or other
antcgccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgccaagaaggacctgcaccggttcgtcaagtggcccaaggtcgtgcgtatccagcgccasctcgcatcctcaagcagcgcctcaaggtaccaccggcgctcaaccagttcacccgcaccctcgacaaggaacctcgctacgaacctgtttaagatgcttctcaagtactggcctgaagacaaggctgccaagaaggagaggcttctgaagaggggccaagctgagaatgaanggaaaaactgt

SEQ ID NO: 846 - DNA, 427 bp, Zea mays
  misc_feature: Ceres CLONE 228446-F
  misc_feature: Encodes the peptide sequence at SEQ ID NO. 847
  misc_feature (176)..(176): n is a, c, t, g, unknown, or other
  misc_feature (178)..(178): n is a, c, t, g, unknown, or other
atccagtcgcatctccctctccgaaatcaaggtagcgtacaccgctgcagtttctagagccctctctgccactcgtgatcccactagtcacaatgcctgcyctcgccaagcccgcctcccgcaccgccaagcccgccgcggydcgaagccgaagcctgccgccgccaagccgavsncncaccgctggtgcctcccacccgccttacttcgagatgatcaagggatgctatcacggcgctcaaggagaggaccggctccagctcgcaagcgatcgccaagtatgtgggggacaagcacggcgcttctctgccggccaacttcaagaagatgctttccatccagctccgtgggtccgcagccaagggcaagctcgtgaaggtcaaggcttcgtacaagctctcggacgccgccaagaaggcatccccca

SEQ ID NO: 847 - protein, 33 aa, Zea mays
  misc_feature: Ceres CLONE 228446-F
MLSIQLRGSAAKGKLVKVKASYKLSDAAKKASP

SEQ ID NO: 848 - DNA, 238 bp, Zea mays
  misc_feature: Ceres CLONE 228455-F
  misc_feature (124)..(124): n is a, c, t, g, unknown, or other
  misc_feature (126)..(126): n is a, c, t, g, unknown, or other
  misc_feature (127)..(127): n is a, c, t, g, unknown, or other
  misc_feature (145)..(145): n is a, c, t, g, unknown, or other
acctccgcacaaactcgtcgcttccgctccacaggatcctctgcgccacccacaaccgtgcgaccgtccgtgctgccggcgaccccgatccgccgacccgtcccgtcccaccacaccctacygncnnhcgcagctatgtcgccgncggagccgacgcggggaggagagcgtgtacatggccaagctggcagagcaggcggasggtacgaggagatggtcgagttcatggagcgcgtcg

SEQ ID NO: 849 - DNA, 377 bp, Zea mays
  misc_feature: Ceres CLONE 228468-F
  misc_feature: Translation starting site: 66
  misc_feature: Pfam Name: Ribosomal_S17e Pfam Description: Ribosomal S17
  misc_feature (157)..(157): n is a, c, t, g, unknown, or other
  misc_feature (164)..(164): n is a, c, t, g, unknown, or other
  misc_feature (301)..(301): n is a, c, t, g, unknown, or other
  misc_feature (302)..(302): n is a, c, t, g, unknown, or other
aagcctaccccagccgccgccgccgccaccgccacctgccccagcgcgccgccgccgcagccaccatgggtcgcgtkcgcaccaagaccgtgaagaaracctccaggmaggtgatcgagaagtactactcccgcatgaccctcgacttccacaccancaagaangtgctcgaggaggtmtcgattctgccctcgaagcgcctccgcaacaaggtggctggcthcagtacccacctgatgcgccgcatccagcvggcccagtccggggcatctcgctcaagctgcaggaggaggagcgcganncggcatggacttcgtgccggagaagtccgcgctcgaggtcgaagagatccgcgthgacaaggagaccatggagat

SEQ ID NO: 850 - DNA, 331 bp, Zea mays
  misc_feature: Ceres CLONE 228478-F
  misc_feature: Encodes the peptide sequence at SEQ ID NO. 851
  misc_feature (68)..(68): n is a, c, t, g, unknown, or other
  misc_feature (91)..(91): n is a, c, t, g, unknown, or other
  misc_feature (198)..(198): n is a, c, t, g, unknown, or other
aaaaccttgcccctgctcctcacgccgccgccgccgccgccgtcgccgccaccacatccgtagcgcbnagccgccggagaagaggaggganccaacaccagccaccatgggtcgcgtccgcaccaagaccgtgaagaagacctccaggcaggtgatcgcaragtactactcccgaatgaccctcgacttccacaccancaagaaggtgctggaagaggtctcgatcctcccctcgaagcgcctccgcaacaaggttgccggcttcaccacccacctgatgcgccgcatccagcgggccccgtccgtggcatctcgctcaagctgcaggagg

SEQ ID NO: 851 - protein, 75 aa, Zea mays
  misc_feature: Ceres CLONE 228478-F
  misc_feature (1)..(75): Pfam Name: Ribosomal_S17e Pfam Description: Ribosomal S17
  misc_feature (19)..(19): Xaa is any aa, unknown, or other
  misc_feature (31)..(31): Xaa is any aa, unknown, or other
MGRVRTKTVKKTSRQVIAXYYSRMTLDFHTXKKVLEEVSILPSKRLRNKVAGFTTHLMRRIQRAPSVASRSSCRR

SEQ ID NO: 852 - DNA, 296 bp, Zea mays
  misc_feature: Ceres CLONE 228495-F
  misc_feature (125)..(125): n is a, c, t, g, unknown, or other
  misc_feature (134)..(134): n is a, c, t, g, unknown, or other
  misc_feature (243)..(243): n is a, c, t, g, unknown, or other
aatccgtgcatacatgctcattgctcaccaagggcaagggaggaggagaggacacacagcagtagcgcgaaatkgcggcgatgatgatggatagtaccgcggagaaagacctcgccggcgacscntgcggtgancgggcacgggcaggactttgagcrgtcttgccatgaccaggagcccgccgctgcagatggtgcgagcagcagaggcctagccatcgggcgtttcgtacgggagctgatngtggarggcttagcgtcgttcctgctggtgttctggtccgcggttgcggcgct

SEQ ID NO: 853 - DNA, 465 bp, Zea mays
  misc_feature: Ceres CLONE 228512-F2
  misc_feature: Pfam Name: GASA Pfam Description: Gibberellin regulated protein
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (180)..(180): n is a, c, t, g, unknown, or other
  misc_feature (236)..(236): n is a, c, t, g, unknown, or other
  misc_feature (237)..(237): n is a, c, t, g, unknown, or other
  misc_feature (243)..(243): n is a, c, t, g, unknown, or other
gctctcaaatatctctcaccagtcaccacctcccctcnktttcdnnnncctttggtcaggcaggctcaggcaaaggaggcggccaacagggacgagcgatggcgaccaaggtcatttgcttcctggtgctcgcatccctgctcctcgccgtcgcctttcccgtgtctgctmtgcggcasngttgaagaagggcggcggcggcggaggaggaggcggaggcagtgttagcggaasgnnaggcgncaacctgaatccctgggagtgctcgcccaagtgcgggtcgcggtgctccaagacgcatacaggaaggcctgcctcaccttatgcaacaagtgctgtgccaagtgcctctgcgtgcmaccggggttctacggcaacaagggcgcctgcccctgctacaacaactggaaaaccaagggaaggagggcmcaagtgcccctagaagatccaccgcagctcccgtcc

SEQ ID NO: 854 - DNA, 465 bp, Zea mays; identical to SEQ ID NO: 853
  misc_feature: Ceres CLONE 228512-F
  misc_feature: Encodes the peptide sequence at SEQ ID NO. 855
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (180)..(180): n is a, c, t, g, unknown, or other
  misc_feature (236)..(236): n is a, c, t, g, unknown, or other
  misc_feature (237)..(237): n is a, c, t, g, unknown, or other
  misc_feature (243)..(243): n is a, c, t, g, unknown, or other

SEQ ID NO: 855 - protein, 146 aa, Zea mays
  misc_feature: Ceres CLONE 228512-F
  misc_feature (13)..(13): Xaa is any aa, unknown, or other
  misc_feature (15)..(15): Xaa is any aa, unknown, or other
  misc_feature (16)..(16): Xaa is any aa, unknown, or other
  misc_feature (57)..(57): Xaa is any aa, unknown, or other
  misc_feature (60)..(60): Xaa is any aa, unknown, or other
  misc_feature (78)..(78): Xaa is any aa, unknown, or other
  misc_feature (79)..(79): Xaa is any aa, unknown, or other
  misc_feature (81)..(81): Xaa is any aa, unknown, or other
  misc_feature (120)..(120): Xaa is any aa, unknown, or other
  misc_feature (143)..(143): Xaa is any aa, unknown, or other
LSNISHQSPPPLXFXXLWSGRLRQRRRPTGTSDGDQGHLLPGARIPAPRRRLSRVCXAAXLKKGGGGGGGGGGSVSGXXGXNLNPWECSPKCGSRCSKTHTGRPASPYATSAVPSASACXRGSTATRAPAPATTTGKPREGGXKCP

SEQ ID NO: 856 - DNA, 156 bp, Zea mays
  misc_feature: Ceres CLONE 228521-F
  misc_feature: Encodes the peptide sequence at SEQ ID NO. 857
  misc_feature (44)..(44): n is a, c, t, g, unknown, or other
  misc_feature (45)..(45): n is a, c, t, g, unknown, or other
gctctcaaatatctctcaccagtcaccacctcccctcagcttcnnccacctttggtcaggcaggctcaggcaaaggaggcggccaacagggacgagcgatggcgaccaaggtcatttgcttcctggtgctcgcatccctgctcctcgccgtcgcct

SEQ ID NO: 857 - protein, 51 aa, Zea mays
  misc_feature: Ceres CLONE 228521-F
  misc_feature (15)..(15): Xaa is any aa, unknown, or other
LSNISHQSPPPLSFXHLWSGRLRQRRRPTGTSDGDQGHLLPGARIPAPRRR

SEQ ID NO: 858 - DNA, 156 bp, Zea mays
  misc_feature: Ceres CLONE 228539-F
  misc_feature (62)..(62): n is a, c, t, g, unknown, or other
  misc_feature (63)..(63): n is a, c, t, g, unknown, or other
ttgaaatcaatcgtgttcctcgcctgcacgacgagagcccgagaccaatccagccgccgccnngccttcgcctcgcctartattccctccgatacagaggccgatggagtgcatcgccgagatgccccgcgcgccgctggacagcaggctgcgcaa

SEQ ID NO: 859 - DNA, 476 bp, Zea mays
  misc_feature: Ceres CLONE 228557-F
  misc_feature: Encodes the peptide sequence at SEQ ID NO. 860
  misc_feature (95)..(95): n is a, c, t, g, unknown, or other
  misc_feature (285)..(285): n is a, c, t, g, unknown, or other
  misc_feature (289)..(289): n is a, c, t, g, unknown, or other
  misc_feature (290)..(290): n is a, c, t, g, unknown, or other
ctcttcagtctctccccttcgcggctcccacccaccgcgtgccgccgccctacgccaggtgccccctacgtacgtcgtcatcgtgcccgtggccnccggcgacgaacgcccagcagggggaaagggagagggaggaggaggatgggcgagttcgacgamtactgggcgcgggcagtacaggggcgaccccgcggtcccgcactccgacccgcagcggctcatctccacctggaccggcgcctttgccctcggcgcggccgcctgcgtccaccaccacgcctccgngctnncatcccacctcaagtccctaccggcgactttgcatacatgacattggcccttgatcaaaagcgatggaagaaagcttttgagaaaaagcggcasaagccttaagctcattgttctttccaacttcttgggccagtttggatgagcactgtgtctggtcatcaattgttgggcgcatgaaagcttca

SEQ ID NO: 860 - protein, 109 aa, Zea mays
  misc_feature: Ceres CLONE 228557-F
  misc_feature (32)..(32): Xaa is any aa, unknown, or other
  misc_feature (53)..(53): Xaa is any aa, unknown, or other
  misc_feature (95)..(95): Xaa is any aa, unknown, or other
  misc_feature (97)..(97): Xaa is any aa, unknown, or other
SSVSPLRGSHPPRAAALRQVPPTYVVIVPVAXGDERPAGGKGEGGGGWASSTXTGRGQYRGDPAVPHSDPQRLISTWTGAFALGAAACVHHHASXLXSHLKSLPATLHT

SEQ ID NO: 861 - DNA, 147 bp, Zea mays
  misc_feature: Ceres CLONE 228616-F
  misc_feature (77)..(77): n is a, c, t, g, unknown, or other
  misc_feature (80)..(80): n is a, c, t, g, unknown, or other
gatacagttcggattcagatcgcggccggtgcgaacccacgaaggcacgaacggtagaacccgaccgagcgcggcanmanacctccgatccctgctgcgagcaaggatggcggcggcatgggcagtgctggcggcggtgctcgtcgc

SEQ ID NO: 862 - DNA, 719 bp, Zea mays
  misc_feature: Ceres CLONE 228637-R
ccgggccccccctcgaggtcgacggtatcgataagcttttttttttttttttttctttttttttttttttttttttttttttttttttttttttttttttttttttttttttttttttttttaggggcaagccaaacttatctgtttttacccctttgccccgggggacatcaacccattcacatttaaatagtaccattgaaaatcccccgtagtagtctaactctatgatatcaataatcccaccatagtacataaaatccccaagtatggggttgctatcacctgccgaagaaaaactaaatgtctttgcagtaacaacaacccccctattttgagtccccttatcaaaccgtttggcacgaaatctgaacccccgaatgttaaagggtctatgccttcgtgcaatctctaggggtcctcgagccaaccatctaatatcctcgtcgatgttgtcactaccatcattttcccccttctgcatgaactttacattctgcttctggcgatgttgggctgcctagcccaacgaggacgcatcaatgggcgcatggggtgaccccttgtgttgtgagccacagcgtgggagacataaatcctatataccgatggaaataggaccgcttgatcatcatcaggcacaggcagtgcgagccgccgtcagctcgaaacaaattcctcggtccatttctcaagctcgtcccatttgctcttctgag

SEQ ID NO: 863 - DNA, 287 bp, Zea mays
  misc_feature: Ceres CLONE 228680-F
  misc_feature: Encodes the peptide sequence at SEQ ID NO. 864
  misc_feature (24)..(24): n is a, c, t, g, unknown, or other
  misc_feature (112)..(112): n is a, c, t, g, unknown, or other
  misc_feature (115)..(115): n is a, c, t, g, unknown, or other
  misc_feature (118)..(118): n is a, c, t, g, unknown, or other
  misc_feature (125)..(125): n is a, c, t, g, unknown, or other
aaggagaccgtgcctacgcttttnttctccctccattcattcacacaccacacctcccgaactccgaactacaagtttcgcttctcgtcgcgacgactgggcgagaccgcgncgncgncrcmghnwgagttctttagaaatggctgatggtgaggacatccagcctctwartctgcgacaatggcactggaatggtcaaggctggttttgctggcgacgatgcaccaagggctgttttccctagtattgttggccgtcctcgccacactggtgttatggtagggatg

SEQ ID NO: 864 - protein, 47 aa, Zea mays
  misc_feature: Ceres CLONE 228680-F
  misc_feature: SWISSPROT Homolog: EC 2.7.10.2 Non-specific protein-tyrosine kinase
  misc_feature (8)..(8): Xaa is any aa, unknown, or other
  misc_feature (9)..(9): Xaa is any aa, unknown, or other
MVRTSSLXXCDNGTGMVKAGFAGDDAPRAVFPSIVGRPRHTGVMVGM

SEQ ID NO: 865 - DNA, 395 bp, Zea mays
  misc_feature: Ceres CLONE 228745-F
  misc_feature: Encodes the peptide sequence at SEQ ID NO. 866
atacatttcgactctcaactcccaaggtcccttttttttctcgatctggaagcgccgcagtagcagccatggacgtgagcggasaggcgggaaggcgaagaagggcgcggccgggcgcaaggccggcgggckwtcgaagaagtcggtgtcgcggtcctccagggccgggctgcagttccccgtcagccgcgtcgggcgtacctcaaaaagggccggtacgcgcabgtaggcacgggtgccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctgggccgg

SEQ ID NO: 866 - protein, 109 aa, Zea mays
  misc_feature: Ceres CLONE 228745-F
  misc_feature (36)..(100): Pfam Name: Histone Pfam Description: Core histone H2A/H2B/H3/H4
  misc_feature (6)..(6): Xaa is any aa, unknown, or other
  misc_feature (22)..(22): Xaa is any aa, unknown, or other
  misc_feature (53)..(53): Xaa is any aa, unknown, or other
MDVSGXAGRRRRARPGARPAGXRRSRCRGPPGPGCSSPSAASGVPQKGPVRAXRHGCPVYLAAVLEYLAAEVLELAGNAARDNKKTRIIPRHVLLAIRNDEELGKLLGR

SEQ ID NO: 867 - DNA, 393 bp, Zea mays
  misc_feature: Ceres CLONE 228771-F
  misc_feature: Encodes the peptide sequence at SEQ ID NO. 868
  misc_feature (12)..(12): n is a, c, t, g, unknown, or other
  misc_feature (13)..(13): n is a, c, t, g, unknown, or other
  misc_feature (196)..(196): n is a, c, t, g, unknown, or other
  misc_feature (252)..(252): n is a, c, t, g, unknown, or other
  misc_feature (382)..(382): n is a, c, t, g, unknown, or other
actcgccgcctnntccccactgcctcgtgtggccgtcgtctcccgttcggaacgccaagcccccctccggcgaaatggcccccaagcgaggtggcagggcgmcggtgccggccaagaagaagacggataaagtgacgaaccctctgtttgagaagaggccgaagcagttcggcatmggmggcgcgttgccgccaanagaaggacctgcaccggttcgtcaagtggcccaaggtcgtgcgtatccagcgccanctcgcattctcaagcagcgcctcaaggtaccaccggcgctcaaccagttcacccgcaccctcgacaagaacctcgctacgaacctgtttaagatgcttctcaagtaccggcctgaagacaaggctgccangaaggagaggc

SEQ ID NO: 868 - protein, 106 aa, Zea mays
  misc_feature: Ceres CLONE 228771-F
  misc_feature (10)..(10): Xaa is any aa, unknown, or other
  misc_feature (41)..(41): Xaa is any aa, unknown, or other
  misc_feature (60)..(60): Xaa is any aa, unknown, or other
  misc_feature (103)..(103): Xaa is any aa, unknown, or other
MAPKRGGRAXVPAKKKTDKVTNPLFEKRPKQFGIGGALPPXEGPAPVRQVAQGRAYPAPXRILKQRLKVPPALNQFTRTLDKNLATNLFKMLLKYRPEDKAAXKER

SEQ ID NO: 869 - DNA, 269 bp, Zea mays
  misc_feature: Ceres CLONE 228827-F
  misc_feature: Encodes the peptide sequence at SEQ ID NO. 870
  misc_feature (48)..(48): n is a, c, t, g, unknown, or other
  misc_feature (49)..(49): n is a, c, t, g, unknown, or other
acaccgcacacgcacgcacgaacgcgctcccaccccctcccgccgccnngccgccaaaaccccggcccgactcggcgtcctccgccaacctcctcctgggcagcgcggcgggggatatcggcatcggaggacgtggtgggcaagagcaggggcgacacggccgtcaccaccatcgtcaacctggcggaggaggccaagctcgcgcgcgagggggtcaaggcgcccggccaccagatcctcaccatctcgcaagtcgctcgtcgccggcg

SEQ ID NO: 870 - protein, 89 aa, Zea mays
  misc_feature: Ceres CLONE 228827-F
  misc_feature (17)..(17): Xaa is any aa, unknown, or other
TPHTHARTRSHPLPPPXRQNPGPTRRPPPTSSWAARRGISASEDVVGKSRGDTAVTTIVNLAEEAKLAREGVKAPGHQILTISQVARRR

SEQ ID NO: 871 - DNA, 380 bp, Zea mays
  misc_feature: Ceres CLONE 228836-F
  misc_feature: Translation starting site: 70
  misc_feature: Pfam Name: KOW Pfam Description: KOW motif
  misc_feature: Pfam Name: Ribosomal_L27e Pfam Description: Ribosomal L27e protein family
  misc_feature (133)..(133): n is a, c, t, g, unknown, or other
  misc_feature (247)..(247): n is a, c, t, g, unknown, or other
  misc_feature (366)..(366): n is a, c, t, g, unknown, or other
  misc_feature (377)..(377): n is a, c, t, g, unknown, or other
gacacacctcccaaaccctacactcccggcggcggcggctgcggcgcaagcgggcagcagcatccgaagatggtgaagttcctcaagcccggcaaggccgttatcctcctccagggccgcttcgccggcaggnaggcagttatcgtgcgmgtgttcgaggagggcacccgcgaccgcccctatggccactgcctcgtcgcaggcctcgccaagtacccaaagaaggtgatccgcargactccgccangatgactgcgaagaagtcgcgcgtcaagtgcttcatcaggctcgtcaacttcactcacctcatgcccacccgctacaccctcgacgtcgatttcaggatgtcgccaccggtgggcccgncgcactctctnccc

SEQ ID NO: 872 - DNA, 375 bp, Zea mays
  misc_feature: Ceres CLONE 228861-F
  misc_feature: Encodes the peptide sequence at SEQ ID NO. 873
  misc_feature (224)..(224): n is a, c, t, g, unknown, or other
  misc_feature (225)..(225): n is a, c, t, g, unknown, or other
gtagtcctaggcactttcatctgtggcctctgcgttcgagatcgatctgagctggcaccgtcccacttcgccatggcggaggaccggagccccaagcccatccactgcaaagcggcggtgtgcagagccgccggcrggccactcaccatcgaggagawcgtcgtcgacccgcmgaaagcgtacgagatccgcatccgggtcgtctgcacctcactctgccacanngatatcaccttctggaaagctaaggtggcaccggtgtttccaagaatactagggcatgaggcgtacggggtagtggagagcgtgggggagcacgtggagggcttcgmggcgggggacacgtggtgccgacgttcctggggcagtgcgagc

SEQ ID NO: 873 - protein, 101 aa, Zea mays
  misc_feature: Ceres CLONE 228861-F
  misc_feature (36)..(100): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (22)..(22): Xaa is any aa, unknown, or other
  misc_feature (29)..(29): Xaa is any aa, unknown, or other
  misc_feature (34)..(34): Xaa is any aa, unknown, or other
  misc_feature (51)..(51): Xaa is any aa, unknown, or other
  misc_feature (87)..(87): Xaa is any aa, unknown, or other
MAEDRSPKPIHCKAAVCRAAGXPLTIEEXVVDPXKAYEIRIRVVCTSLCHXDITFWKAKVAPVFPRILGHEAYGVVESVGEHVEGFXAGDTWCRRSWGSAS

SEQ ID NO: 874 - DNA, 474 bp, Zea mays
  misc_feature: Ceres CLONE 228864-F
  misc_feature: Encodes the peptide sequence at SEQ ID NO. 875
gcgtagaggaagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgaggtgagcaggtcggcggacatccgcgcgcagacggcagcggtgtcctccccgtcagtgacccccgcgtcgccgtctggcaagaagaccctccgcaagggcacagcggtcatcaccggcgcgtcgtccggcctcggcctcgccacggcgaaggccctcgcggagacaggcaagtggcacgtcatcatggcctgccgcgacttcctca

SEQ ID NO: 875 - protein, 157 aa, Zea mays
  misc_feature: Ceres CLONE 228864-F
  misc_feature: SWISSPROT Homolog: EC 1.3.1.33 Protochlorophyllide reductase
VEEEERKKKNPAKSSVLRLLTARAVHSPPSQSLAFAARHGAPGGDVLPPLCPLRAQGGVGEGLGVVLGCSSRGGWPQAGHHRSGPTHREVSRSADIRAQTAAVSSPSVTPASPSGKKTLRKGTAVITGASSGLGLATAKALAETGKWHVIMACRDFL

SEQ ID NO: 876 - DNA, 365 bp, Zea mays
  misc_feature: Ceres CLONE 228866-F
  misc_feature: Pfam Name: Usp Pfam Description: Universal stress protein family
  misc_feature (50)..(50): n is a, c, t, g, unknown, or other
  misc_feature (350)..(350): n is a, c, t, g, unknown, or other
aataagcacttgttcatcatcatcagagtaaacacagcagaaccctagcnccgttcctccgacgactcacatcccacccactcacccaccccatggcggccaagctctccaccagcgccgacgccccggcctcggtgcggctctccgcagcagcgcaggcgcctgsattccagccctcctctccgcgcttcttcttctcctcgctggccgggaccaacccggcttcccccgcatcgccgcatcgccattgccgtcgatctctccgacgagtccgccttcgccgtcaagtgggccgtgcagaactacctccgccccggggacgccgtcgtgctgctccacgtgcgccccanctccgttctctacgg

SEQ ID NO: 877 - DNA, 173 bp, Zea mays
  misc_feature: Ceres CLONE 228868-F
  misc_feature (118)..(118): n is a, c, t, g, unknown, or other
ctgcaaaccctagtgcttcccaccgatccatttcagccgccgccgcgcgtasaagcaggagcagcaaggatgccggctggccacgggctgcgctcgcggacgscgacctgttcgcgcnccctttccgcaagaagggctacatcccgctcaccacctacctccgcacctacaag

SEQ ID NO: 878 - DNA, 448 bp, Zea mays
  misc_feature: Ceres CLONE 228923-F
  misc_feature: Encodes the peptide sequence at SEQ ID NO. 879
aktgctgtcatcgccgccgccgccgccccggtttccttcgtaagcccgccgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagawccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttgtcaaactttggtatgacctttaaaacacctgccttgtatgattatttgtgagcctggtggtaakattgcagctatttttgtccaatgatattgatatgttg

SEQ ID NO: 879 - protein, 65 aa, Zea mays
  misc_feature: Ceres CLONE 228923-F
  misc_feature (1)..(65): Pfam Name: Ribosomal_S28e Pfam Description: Ribosomal protein S28e
  misc_feature (35)..(35): Xaa is any aa, unknown, or other
MDTQVKLAVVVKVMGRTGSRGQVTQVRVKFLDDQXRLIMRNVKGPVREGDILTLLESEREARRLR

SEQ ID NO: 880 - DNA, 408 bp, Zea mays
  misc_feature: Ceres CLONE 228932-F
  misc_feature: Encodes the peptide sequence at SEQ ID NO. 881
  misc_feature (244)..(244): n is a, c, t, g, unknown, or other
  misc_feature (258)..(258): n is a, c, t, g, unknown, or other
  misc_feature (260)..(260): n is a, c, t, g, unknown, or other
  misc_feature (362)..(362): n is a, c, t, g, unknown, or other
  misc_feature (394)..(394): n is a, c, t, g, unknown, or other
atgatcacggacgcagaggagaaagggctgattactccaggacgtgagtgttctgattgaaccaactagcggcaacacaggcattggactggccttatatrgctgctgcaagggctacaaacttacactcacaatgmctgcmtccatgagcatggagaggaggatcatattgaagrmttttggtgctgaactwgtccttactgacccactcctgggaatgaaaggagctgtcaagaaagcggangagatacaagcaangncacccaactcgtacatccttcaacaatttgaaaatmcagctaacccaaagattcactatgagactactgggcctgaaatctggagagctacagcaggaaaanttgctggccttgtatctggtatcgggacaggnggtaccatcaccgg

SEQ ID NO: 881 - protein, 91 aa, Zea mays
  misc_feature: Ceres CLONE 228932-F
  misc_feature: SWISSPROT Homolog: EC 2.5.1.47 Cysteine synthase
  misc_feature (2)..(2): Xaa is any aa, unknown, or other
  misc_feature (15)..(15): Xaa is any aa, unknown, or other
  misc_feature (37)..(37): Xaa is any aa, unknown, or other
  misc_feature (42)..(42): Xaa is any aa, unknown, or other
  misc_feature (43)..(43): Xaa is any aa, unknown, or other
  misc_feature (55)..(55): Xaa is any aa, unknown, or other
  misc_feature (77)..(77): Xaa is any aa, unknown, or other
MXASMSMERRIILKXFGAELVLTDPLLGMKGAVKKAXEIQAXXPNSYILQQFENXANPKIHYETTGPEIWRATAGKXAGLVSGIGTGGTIT

SEQ ID NO: 882 - DNA, 176 bp, Zea mays
  misc_feature: Ceres CLONE 228975-F
  misc_feature (123)..(123): n is a, c, t, g, unknown, or other
aatccaattcacaggctcaccacaccaaccaacaagcaaaaattccccaatcctctcgtctccgcggcgaagatgtcggggcgcggcaagggcggcaagggcctgggcaagggcggcgcgaantcaccggaaggtctgcgcgacaacatccaggggatcacgagccggcgatccgg

SEQ ID NO: 883 - DNA, 230 bp, Zea mays
  misc_feature: Ceres CLONE 228976-F
  misc_feature: Pfam Name: Hydrolase Pfam Description: haloacid dehalogenase-like hydrolase
aggcgcaaaagccatcaacctctgtgcagctacaggacagcgtgcttgtgagtggctgttagggtgcttgckttgcgttgcagtgcagaggacactgacggacggcgaagaatcgaagatggaggcgtacgctgctggagccaagttcgactgcttgctgttcgacatggacgamactctgtacccgctgagccatcaacctagcatgccgcaagaacatacaggagtac

SEQ ID NO: 884 - DNA, 310 bp, Zea mays
  misc_feature: Ceres CLONE 229018-F
  misc_feature: Encodes the peptide sequence at SEQ ID NO. 885
  misc_feature (95)..(95): n is a, c, t, g, unknown, or other
  misc_feature (97)..(97): n is a, c, t, g, unknown, or other
  misc_feature (98)..(98): n is a, c, t, g, unknown, or other
atttatcgtttatccacggaacttccggtgccggcgggaccacttgtgcgatccatccctcaccatgtcgtcggagaaggaggcggcgctcgcgngnnctcgatgacagcccaaccatatttgacaagatcatcaaaaaggaaataccttctactgtggtttatgaggacgagaagktactgcctttcaggggacataaaccctcaagctccaacacacattctcatcatccccaaagtcaagggatggactaactcgccttggcaaaggctgaagagaggcacatagaaatactgggctatctcctcta

SEQ ID NO: 885 - protein, 83 aa, Zea mays
  misc_feature: Ceres CLONE 229018-F
  misc_feature (32)..(32): Xaa is any aa, unknown, or other
  misc_feature (59)..(59): Xaa is any aa, unknown, or other
LSFIHGTSGAGGTTCAIHPSPCRRRRRRRSRXLDDSPTIFDKIIKKEIPSTVVYEDEKXLPFRGHKPSSSNTHSHHPQSQGMD

SEQ ID NO: 886 - DNA, 356 bp, Zea mays
  misc_feature: Ceres CLONE 229082-F
  misc_feature: Encodes the peptide sequence at SEQ ID NO. 887
  misc_feature (176)..(176): n is a, c, t, g, unknown, or other
  misc_feature (267)..(267): n is a, c, t, g, unknown, or other
agtgtccgcatttcaaactgggctccataaagttctgtcgcctcgcctgtgacctgtagggtagcagcaggtagcggagggggagagagagagaggggatggattctcaagcgccgcttcgtcctcctctagctttcgcctgcttcatcttcctttgctcatccttctgcgcmvanatgagatgtacgacagggttggtgcggcggcgtcagatggggagagcaggaggatgcggctgcacaccgacgggagccgcggcgacgccancgstgggcctgggtacctctacacccgagcagttgggagatgcacaccccaattctggagcagcggascgagccctggcccaacatcgt

SEQ ID NO: 887 - protein, 58 aa, Zea mays
  misc_feature: Ceres CLONE 229082-F
  misc_feature (29)..(29): Xaa is any aa, unknown, or other
  misc_feature (30)..(30): Xaa is any aa, unknown, or other
  misc_feature (52)..(52): Xaa is any aa, unknown, or other
MYDRVGAAASDGESRRMRLHTDGSRGDAXXGPGYLYTRAVGRCTPQFWSSGXSPGPTS

SEQ ID NO: 888 - DNA, 396 bp, Zea mays
  misc_feature: Ceres CLONE 229119-F
  misc_feature: Encodes the peptide sequence at SEQ ID NO. 889
gcaatctgggagtggtgttaacagcgccgcaccacctcgtgccgtgggaggtcgagctcgtcgatgcgacgctcctcggagarcagcgcctcctcctgcgcggtcttcttcggcgcgagggcgggcgggacggagggcgccgaggaggaggcggtggcggaggagctagggttagggttcgccgccgccgtctgagctgcggcgtcgaggttgctggggtcggaaccggtagcagctgcggcggaattcgcggagggcaccrcgtgccggccttggcgagcagctggcggtgctcgtcgcggcgcttctggagctgcttctgctccagctccgaccgccgcacgaagctcttgctcccgaagtcggccgtcgccgccttccgcttcttctccagtt

SEQ ID NO: 889 - protein, 43 aa, Zea mays
  misc_feature: Ceres CLONE 229119-F
  misc_feature (7)..(7): Xaa is any aa, unknown, or other
MRRSSEXSASSCAVFFGARAGGTEGAEEEAVAEELGLGFAAAV

SEQ ID NO: 890 - DNA, 141 bp, Zea mays
  misc_feature: Ceres CLONE 229149-F
acgccgctgctccaagaaaccaccgccgagcccaaccgcacaagcgcgcgaggcaggagagagagagagaggcggggagcaaaacaatggaggggaaagaggaggacstgcgcctgggcgcaacaagttctcggagcgcca

SEQ ID NO: 891 - DNA, 208 bp, Zea mays
  misc_feature: Ceres CLONE 229162-F
aaccctagccgcactgcgctcatttctgcatccccctcccgccgcgccgcctcaccgccgccggagaagatgggtcgcgtgatccgcgcgcastaagggtgcggggtccgtgttcaagtcccacacccaccaccgcaaggccccgccgctttccgctccctcgacttcgrcgagctcaacgggtacctcacagggcgtcgtcaccgag

SEQ ID NO: 892 - DNA, 459 bp, Zea mays
  misc_feature: Ceres CLONE 229168-F
  misc_feature: Encodes the peptide sequence at SEQ ID NO. 893
ggtgcagtgcaggtgcgggatctctgaatcgctgacgcccagcctcctctgtcatctccctcctcggacctcgccacctcacgcggaaggaggggaagaggaagcgcggagactggaaatcggaccccaaatccgcttcggtctctcgatcggcgagcaggcatgatttatacaaccggctaggatggcctcaaaagctataaaaagaaggcctatcagcgctgagactgataaaacaggggaaaatcaaatggatacagcactgtcagatcctgtaacagaacctcttctaggaaacactcctcaggaagagaaatccaagacatatgagcctattacaaggtcaggtttctgggatgcgacgacacaggagtgtcttcgttggacacatcttttagcagcttttgttgctcaatctgcaagaaaaatagtaaatgttctttactgaatttggatatt

SEQ ID NO: 893 - protein, 87 aa, Zea mays
  misc_feature: Ceres CLONE 229168-F
MASKAIKRRPISAETDKTGENQMDTALSDPVTEPLLGNTPQEEKSKTYEPITRSGFWDATTQECLRWTHLLAAFVAQSARKIVNVLY

SEQ ID NO: 894 - DNA, 209 bp, Zea mays
  misc_feature: Ceres CLONE 229185-F
  misc_feature (138)..(138): n is a, c, t, g, unknown, or other
actcatacatttcgactctcaactcccaaggtccctttttttttctcgatctggaagcgccgcagtagcagccatggacgtgagcggasagggcggtaaggcgaagaagggcgcggcggggcsaaggccggcgggcgncgaagaagtcggtgtcgcggtcctccagggccgrgctgcagttccccgtcagccgcgtcgggcgtacctca

SEQ ID NO: 895 - DNA, 371 bp, Zea mays
  misc_feature: Ceres CLONE 229246-F
  misc_feature (350)..(350): n is a, c, t, g, unknown, or other
  misc_feature (361)..(361): n is a, c, t, g, unknown, or other
ctctagccaaaaccctagcagccgcccggtgctccctctctgcagatctcccttcgcagccgccgaggaaccccttcacagcgcggaagayggctgaacaggaggccccagtcgtggttgaggcaccaaccccagttcttggggagcctatggactctgatgactgctctgcrctccgtgatgaagaagtcaagtgctcatgatggacttgtgaagggtctccgtgaggctcgccaaggccaycgagaagcacgccgctcagctttgsgtgtttgctgaggactgtgaccagccagatcatgtcaagctsgygaaggcactctgcgcggasacaatgttcacctggtcantgttcctccgntaagaccctt

SEQ ID NO: 896 - DNA, 184 bp, Zea mays
  misc_feature: Ceres CLONE 229258-F
ggacgtttccacctccatcaccgctghcggctatgtgcatcgcggcatgggcgtggcactgcaccgacgcaccgcctgcttctgctgttcaatcgcgacgagtatcactccaggccgacgcagccgsgcagtggtgggmggcgggggaggaagccaaggaaatccttggaggcagggaccgagc

SEQ ID NO: 897 - DNA, 372 bp, Zea mays
  misc_feature: Ceres CLONE 229264-F
  misc_feature: Encodes the peptide sequence at SEQ ID NO. 898
cttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatgtgcatsctg

SEQ ID NO: 898 - protein, 98 aa, Zea mays
  misc_feature: Ceres CLONE 229264-F
  misc_feature (1)..(99): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNVH

SEQ ID NO: 899 - DNA, 324 bp, Zea mays
  misc_feature: Ceres CLONE 229267-F
  misc_feature: SWISSPROT Homolog: EC 2.7.10.2 Non-specific protein-tyrosine kinase
  misc_feature (256)..(256): n is a, c, t, g, unknown, or other
attcggcctatcacaaccacttactctcgtgcgctwmtccgtgggagcgaggactctcggccggcgsacggcagggttctcctagatctccggcatcatcagtaacaaatggctgacggtgaagacattcagccccttgtttgtgacaatggaactggcatggtcaaggctsgatttgctgggtgacgatgcgccaagggctgttttcccaagcattgtcggacgcccccgtcacactggtgtgatggttggcatngggcagaaggatgcgtatgttggtgacgaggcccagtccaagaggggtatcctgacttttgaagtasc

SEQ ID NO: 900 - DNA, 438 bp, Zea mays
  misc_feature: Ceres CLONE 229269-F
  misc_feature: Encodes the peptide sequence at SEQ ID NO. 901
  misc_feature (19)..(19): n is a, c, t, g, unknown, or other
  misc_feature (279)..(279): n is a, c, t, g, unknown, or other
  misc_feature (334)..(334): n is a, c, t, g, unknown, or other
ctcccayctttgacactkngcgctccccatccaaacggtactgatccgccggccgccgttccccatttcaaattgcaaacgtgttctccttttccgcctcctcgacgcaactcgtcgccgtcttctccaactcgcacctcgttcctcgccccaccatttgccgctcccgcctacgatgccgacgagtgaggtgtggagcttgtccgattttgaaatcagcaagtacatcgctgagggcaggttcggcaaggtctacctcgcccgcgagaagcagagcgngtacgtggtggcgctcaaggtgatatttaaggcgaaactgaagaagcaccgcttnccacgcgcacctgcgcgggagatcgagatccagcagagtctcgaccaccctaacgtgctccgcctcttcacctggttccacgacgaagagcgagtcgtcctcgt

SEQ ID NO: 901 - protein, 87 aa, Zea mays
  misc_feature: Ceres CLONE 229269-F
  misc_feature: SWISSPROT Homolog: EC 2.7.11.1 Non-specific serine/threonine protein kinase
  misc_feature (35)..(35): Xaa is any aa, unknown, or other
  misc_feature (53)..(53): Xaa is any aa, unknown, or other
MPTSEVWSLSDFEISKYIAEGRFGKVYLAREKQSXYVVALKVIFKAKLKKHRXPRAPAREIEIQQSLDHPNVLRLFTWFHDEERVVL

SEQ ID NO: 902 - DNA, 173 bp, Zea mays
  misc_feature: Ceres CLONE 229277-F
gtgctttctcagaggtgggttggcttctctcccccaccggttcgtgttcaggttctggttcctgggcgagagggaagagatggcggcgtcggacgttgagtaccgttgcttcgttggcggcctcgctcggggccaccgacgaccactccctcaacaacgccttcagcacctac

SEQ ID NO: 903 - DNA, 114 bp, Zea mays
  misc_feature: Ceres CLONE 229292-F
  misc_feature (30)..(30): n is a, c, t, g, unknown, or other
  misc_feature (75)..(75): n is a, c, t, g, unknown, or other
arcaacagcgaacacatctcctcgcatttnttcccatccgatccccccttcgcaaccaaaaccccaactcgcchncatcgatggcgcccaaggccgagaagaaacccgcggcga

SEQ ID NO: 904 - DNA, 447 bp, Zea mays
  misc_feature: Ceres CLONE 229365-F
  misc_feature: Encodes the peptide sequence at SEQ ID NO. 905
  misc_feature (330)..(330): n is a, c, t, g, unknown, or other
  misc_feature (332)..(332): n is a, c, t, g, unknown, or other
aattactcttccccgtgcgccctcgcgaggtcgaacccccaaggcgaggcgacgaaaccctcgccagtccccaactcgaacctcagtcagggcgtgagggagggagagttcgaggaccgaggcggcgtcgggcgagatgaagcttaacgtcaagaccctcaagggcaccaacttcgagatcgaggcgagccccgatgcgtcggttgctgacgtgaagaggatcattgagaccactcagggtcagagtacctaccgggcggaccagcaaatgcttatataccaagggaaaattctcaaggatgagaccactttggaaagcaacggagtbknanggaacagcttccttgttataatgttgtccaaggctaaggcatcgtcgagtggagcttctaccactacttgctgcaaaagctcctgcaacttctggcccaacctgctgccctgtgc

SEQ ID NO: 905 - protein, 103 aa, Zea mays
  misc_feature: Ceres CLONE 229365-F
  misc_feature (6)..(78): Pfam Name: ubiquitin Pfam Description: Ubiquitin family
  misc_feature (65)..(65): Xaa is any aa, unknown, or other
  misc_feature (66)..(66): Xaa is any aa, unknown, or other
MKLNVKTLKGTNFEIEASPDASVADVKRIIETTQGQSTYRADQQMLIYQGKILKDETTLESNGVXXNSFLVIMLSKAKASSSGASTTTCCKSSCNFWPNLLPC

SEQ ID NO: 906 - DNA, 247 bp, Zea mays
  misc_feature: Ceres CLONE 229398-F
  misc_feature (190)..(190): n is a, c, t, g, unknown, or other
atttttcgaccgccgccgcccccagtccccgatccgaagctgtgcctcgtaccatttcgatccaatggcgccgacgtcgaagctgtcgacgggcatcaagcgcgcttcsgttcgcacgcgtaccatcgccgtgggctgtgagccatcaaggccaagaacggcggcgcttcmccaaggccgacaaggcgcncgccrccgtggaacccaagttctaccctgccgacgacgtcaagccccgcgtttccca

SEQ ID NO: 907 - DNA, 476 bp, Zea mays
  misc_feature: Ceres CLONE 229423-F
  misc_feature: Encodes the peptide sequence at SEQ ID NO. 908
acaacaacaacaaccatctccaacgcagcaagcagacagaaggacaggcaggcagcgagtgcaaccgcgagaksattcagcrttgggctccttcttctcgaccttagtgacgccccctccggccgccgacgacccgaactgcgccgtggtggccgcgcactccaaggccacctacgacagagcagtgggcggcccacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtcgcaaggacatggaaggtagaggcgatgccaacgttcgtgctggtcaaggatgggaaggaggtaggccgtgtggattsgggctaagaatggacgagcttgagaggaagatcaggatgttcgtcacgtcatctt

SEQ ID NO: 908 - protein, 70 aa, Zea mays
  misc_feature: Ceres CLONE 229423-F
  misc_feature (1)..(71): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (69)..(69): Xaa is any aa, unknown, or other
MVIDFSASWCGPCRFIEPAFKELASRFTDAIFVKVDVDELAEVARTWKVEAMPTFVLVKDGKEVGRVDXG

SEQ ID NO: 909 - DNA, 232 bp, Zea mays
  misc_feature: Ceres CLONE 229447-F
  misc_feature: Encodes the peptide sequence at SEQ ID NO. 910
  misc_feature (22)..(22): n is a, c, t, g, unknown, or other
  misc_feature (115)..(115): n is a, c, t, g, unknown, or other
atttcgccacgccatggttttntgcagccacctccatctcgcggctgtgctcgcgctcctcaccggctgcgcttmtgcggcgagccggggcgctggttccttcgacccatcccgngtggttcaactctcttggcgccccagggcttcttgcacaagggtttcctgttggatgcrgagtgcgwccacctcatcgcgctggccaaggmcaagctggakaagtctatggtggcgg

SEQ ID NO: 910 - protein, 73 aa, Zea mays
  misc_feature: Ceres CLONE 229447-F
  misc_feature (3)..(3): Xaa is any aa, unknown, or other
  misc_feature (21)..(21): Xaa is any aa, unknown, or other
  misc_feature (54)..(54): Xaa is any aa, unknown, or other
  misc_feature (57)..(57): Xaa is any aa, unknown, or other
  misc_feature (65)..(65): Xaa is any aa, unknown, or other
  misc_feature (68)..(68): Xaa is any aa, unknown, or other
MVXCSHLHLAAVLALLTGCAXAASRGAGSFDPSRVVQLSWRPRASCTRVSCWMXSAXTSSRWPRXSWXSLWWR

SEQ ID NO: 911 - DNA, 181 bp, Zea mays
  misc_feature: Ceres CLONE 229529-F
  misc_feature (120)..(120): n is a, c, t, g, unknown, or other
  misc_feature (123)..(123): n is a, c, t, g, unknown, or other
agccagggtttcttcggaggctttatttatcgtttatccacggaacttccggtgccggcggcgaccacttgtgcgatccatccctcaccatgtcgtcggagaaggaggmggcgctcgcgnggncttcgatgacagcccaaccatatttgacaagatcatcaaaaaggaaatamcttctact

SEQ ID NO: 912 - DNA, 399 bp, Zea mays
  misc_feature: Ceres CLONE 229590-F
  misc_feature: Encodes the peptide sequence at SEQ ID NO. 913
  misc_feature (95)..(95): n is a, c, t, g, unknown, or other
gccgcccccgtctcctctcctctcctctcctccgcatccacggccgcargcagccagccactcgacgatctagtcgtctctctctccccgctctnccgcctcgytgccgcggcttcccgtcggctggaggatgaaggtcacggtcgttgtcccggagcggccgggaggtcktcaagggcggcatcgacctcaaggactcggccaaggtcgcggacctgcaggagggccatccatgccaggactaagaagtattatccttctaggcagcggctcaccctcccccttcaacctggaaaatgcggggaagccagttgtcctcagtccaaaggccagcctgctagaatactgcgagaagggttctgggtcactgacagtggtcttcaaagatttaggggccac

SEQ ID NO: 913 - protein, 55 aa, Zea mays
  misc_feature: Ceres CLONE 229590-F
MPGLRSIILLGSGSPSPFNLENAGKPVVLSPKASLLEYCEKGSGSLTVVFKDLGA

SEQ ID NO: 914 - DNA, 338 bp, Zea mays
  misc_feature: Ceres CLONE 229626-F
  misc_feature: Pfam Name: FAD_binding_6 Pfam Description: Oxidoreductase FAD-binding domain
  misc_feature: SWISSPROT Homolog: EC 1.6.2.2 Cytochrome-b5 reductase
  misc_feature (109)..(109): n is a, c, t, g, unknown, or other
akggattcctaccgagggaggccgcacgcagccatggatttcctgcaggggcaaagcgtcgagaccacagtggccgtcgccgtcgctgtcgccgccgtcgccgcmsccncttcctcctccttcgatccaggaagcccaagggctrcttggatcctgagaacttcaggaagttcaaacttgttgaaaagaagcaaaatragtcataatgtttgccaggttcaagttcgctcttccaactccascttctgtattgggccttcccaatcggtcaacatatcagctgcagaggacaagacgctacaggtgaagaagtaatcaagccttatacccctactaca

SEQ ID NO: 915 - DNA, 213 bp, Zea mays
  misc_feature: Ceres CLONE 229703-F
  misc_feature: Encodes the peptide sequence at SEQ ID NO. 916
  misc_feature (115)..(115): n is a, c, t, g, unknown, or other
accgagacgggaggagaccagcagcagcccatccgaccccccgcctcctcctcctcctcctcccgggttcgcgtgaggctgtgtgctgctgggaggcggcgcgacgcggccattnggaggcggagaagaagccgccggcgttgtccgacgtgggcgcgtgggcgatgaacgtcgtmagctccgtcagcctcatcatggccaacaagcagctca

SEQ ID NO: 916 - protein, 70 aa, Zea mays
  misc_feature: Ceres CLONE 229703-F
  misc_feature (38)..(38): Xaa is any aa, unknown, or other
RDGRRPAAAHPTPRLLLLLLPGSREAVCCWEAARRGHXEAEKKPPALSDVGAWAMNVVSSVSLIMANKQL

SEQ ID NO: 917 - DNA, 964 bp, Zea mays
  misc_feature: Ceres CLONE 229708
  misc_feature: Encodes the peptide sequence at SEQ ID NO. 918
agatttcccaactttttgttcctcgcgccgccgccgccgccgccgtgacggaaggaagaggaggagcaaggagcacgacgcgatgggccactccaacgtgtggaactcgcaccctaagaactacggccctggctcccgcgtctcccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagtccgttgtcctactggagaagctaggattactcctgcttttgagcttcctgcctctcgggtgattcacacttttggccctatatatgatttggacaagcatcctgaggtgtcattaaagaaggcctatgaaaatagcttgaagcttgctaaggataatggcattcagtacatcgcattccctgctatatcttgtggtgtttatcgttatcctcccaaggaagcatcaaaaatagctgtttctaccgcacaaaaattttcagaggatatcaaagaggtgcattttgttctgttctcggacgacctttacaatatatggcgcgagactgcccagcagttgctatcacagtttgagaaatgaatggtccataggcagtttgctagcactagcagttgcccagcagtcgttgtctagtgttgagatgtgagcgccataggcagtttgcctggtgtaataaaaatgggtgtatcagacaacgtttaaatcttgatgaaaccgtgtattgcaaaaaaaaaaaaaaaa

SEQ ID NO: 918 - protein, 239 aa, Zea mays
  misc_feature: Ceres CLONE 229708
  misc_feature: SWISSPROT Homolog: EC 2.4.2.30 NAD(+) ADP-ribosyltransferase
MGHSNVWNSHPKNYGPGSRVSPRWRQRRRGSICATRAFAMAASGFGGGEAFRLSAAPGAGLLKLHKGDITLWSVDCATDAIVNAANERMLGGGGVDGAIHQAAGPELVQACRKVPEVKPGVRCPTGEARITPAFELPASRVIHTFGPIYDLDKHPEVSLKKAYENSLKLAKDNGIQYIAFPAISCGVYRYPPKEASKIAVSTAQKFSEDIKEVHFVLFSDDLYNIWRETAQQLLSQFEK

SEQ ID NO: 919 - DNA, 467 bp, Zea mays
  misc_feature: Ceres CLONE 229715-F
  misc_feature: Encodes the peptide sequence at SEQ ID NO. 920
  misc_feature (118)..(118): n is a, c, t, g, unknown, or other
  misc_feature (377)..(377): n is a, c, t, g, unknown, or other
actagtcaaattttacgtaacttgcgtggttctcttcctgcgacggaagcaaacactgcccgagacatagacagcgggacgtcgagatggccgacggggaggacgccgccgccgcgynctmgccgggccgccatcacagactaccgcaagahgctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggngaagttgacatctggtactcgtgttgtacttgacatgacgaccttgacaataatgcgcactcttccacgggaggtggatcctgtggtata

SEQ ID NO: 920 - protein, 155 aa, Zea mays
  misc_feature: Ceres CLONE 229715-F
  misc_feature (40)..(40): Xaa is any aa, unknown, or other
  misc_feature (41)..(41): Xaa is any aa, unknown, or other
  misc_feature (51)..(51): Xaa is any aa, unknown, or other
  misc_feature (126)..(126): Xaa is any aa, unknown, or other
TSQILRNLRGSLPATEANTARDIDSGTSRWPTGRTPPPRXXRAAITDYRKXLLNCRELESRVGTVRESLKTAKKDFTKTEDDLKSLQSVGQIIGEVLRPLDNERFIVKASSGPRYVVGCRSKVDKXKLTSGTRVVLDMTTLTIMRTLPREVDPVV

SEQ ID NO: 921 - DNA, 440 bp, Zea mays
  misc_feature: Ceres CLONE 229770-F
  misc_feature: Translation starting site: 310
  misc_feature: Pfam Name: Tubulin Pfam Description: Tubulin/FtsZ family, GTPase domain
  misc_feature (337)..(337): n is a, c, t, g, unknown, or other
atttcatttaccacaccctgctctckmtcttgttgtgacggtcgattcgcttgtacaagctagcaaccttgagatccagccaagatccagccatgagggagattctccacatccagggtggacagtgcggcaaccagatcggttccaagttctgggaggtcgtctgckacgagcatargtatcgaccccaccggacgctatgtcggcacctccgacctccagctcgagcgcgtcaatgtctactacaacgaggcctcatgcggccgcttcgtgccgcgcgccgtgctcattgacctcgagcccggcaccatggacagcgtcgcaccgggccgtacgnagtatcttccgccccgacaacttcgtcttcggccagtctggcgcggggaacaactgggcaagggcactacacagagggcgctgagctcatcgactctgtgctt

SEQ ID NO: 922 - DNA, 445 bp, Zea mays
  misc_feature: Ceres CLONE 229795-F
  misc_feature: Encodes the peptide sequence at SEQ ID NO. 923
atcgcctccaccgttctctcttcctctgctcttctctgcctgcytgagctcaccgcacctcgcctcctcaccgcgtttcctccgttaatccggtagaaaatggccgatgccgaggatatccagcccctcgtctgckacaacggaactggcatggtcaaggctgggttcgccggcgacgacgccccgagggccgtcttccccagcatcgtggggcgcccgckcaacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaagg

SEQ ID NO: 923 - protein, 115 aa, Zea mays
  misc_feature: Ceres CLONE 229795-F
  misc_feature (4)..(115): Pfam Name: Actin Pfam Description: Actin
  misc_feature: SWISSPROT Homolog: EC 2.7.10.2 Non-specific protein-tyrosine kinase
  misc_feature (13)..(13): Xaa is any aa, unknown, or other
  misc_feature (41)..(41): Xaa is any aa, unknown, or other
MADAEDIQPLVCXNGTGMVKAGFAGDDAPRAVFPSIVGRPXNTGVMVGMGQKDAYVGDEAQSKRGILTLKYPIEHGIVSNWDDMEKIWHHTFYNELRVAPEEHPVLLTEAPLNPK

SEQ ID NO: 924 - DNA, 142 bp, Zea mays
  misc_feature: Ceres CLONE 229915-F
  misc_feature: Encodes the peptide sequence at SEQ ID NO. 925
  misc_feature (70)..(70): n is a, c, t, g, unknown, or other
  misc_feature (116)..(116): n is a, c, t, g, unknown, or other
agtttccgtgccgtagcaacagacaagggagagtkggagactagcgcaacaggacagcgcacggaaagcnaggggaggggatacggagagggcgcatcggacggcggcgagatctngcggtgttcgatcccacggtggccaa

SEQ ID NO: 925 - protein, 47 aa, Zea mays
  misc_feature: Ceres CLONE 229915-F
  misc_feature (12)..(12): Xaa is any aa, unknown, or other
  misc_feature (24)..(24): Xaa is any aa, unknown, or other
  misc_feature (39)..(39): Xaa is any aa, unknown, or other
SFRAVATDKGEXETSATGQRTESXGRGYGEGASDGGEIXRCSIPRWP

SEQ ID NO: 926 - DNA, 298 bp, Zea mays
  misc_feature: Ceres CLONE 229997-F
  misc_feature: Encodes the peptide sequence at SEQ ID NO. 927
  misc_feature (69)..(69): n is a, c, t, g, unknown, or other
  misc_feature (97)..(97): n is a, c, t, g, unknown, or other
  misc_feature (163)..(163): n is a, c, t, g, unknown, or other
atcactgccaaatcccccagaaaatcaactcctccccaattccacgctgccaccaactcgccgtcctyngcgccaagcaccaaagctccgatggccngmacgaagcagacggcgcgcaagtcgacgggcggcaaggcgccccgcaagcagctggcgaccaagncggcgcgcaagtctacgccggccaccgssgcrtgaagaagccccaccgcttccgccccggcaccgtcgcgctccgggagatccgcaagtaccagaagagcacggagctgctcatctgcaagttgcccttccagcg

SEQ ID NO: 927 - protein, 35 aa, Zea mays
  misc_feature: Ceres CLONE 229997-F
  misc_feature (3)..(3): Xaa is any aa, unknown, or other
  misc_feature (25)..(25): Xaa is any aa, unknown, or other
  misc_feature (34)..(34): Xaa is any aa, unknown, or other
MAXTKQTARKSTGGKAPRKQLATKXARKSTPATXA

SEQ ID NO: 928 - DNA, 457 bp, Zea mays
  misc_feature: Ceres CLONE 229999-F
  misc_feature: Encodes the peptide sequence at SEQ ID NO. 929
acgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgrgcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgttt

SEQ ID NO: 929 - protein, 133 aa, Zea mays
  misc_feature: Ceres CLONE 229999-F
  misc_feature (24)..(133): Pfam Name: Calreticulin Pfam Description: Calreticulin family
  misc_feature (57)..(57): Xaa is any aa, unknown, or other
MMGGRALLLLLVSALLVQIRASDPLLYEPFDEDFEGRWIVSKKDEYQGVWKHAKSDXHEDYGLLVSDKARKYAIIKELDEPVTLNDGTVVLQFEVRLQNGLECGGAYIKYIRPQDAGWDAKEFDNETPYTIMF

SEQ ID NO: 930 - DNA, 393 bp, Zea mays
  misc_feature: Ceres CLONE 230011-F
  misc_feature: Translation starting site: 79
atccacagctcgcatccgatttcccatttcaaatccttcgatcgcacagcgccgcccgccctcacgcagctctctccgatggcgcgcacgaagcagacggcgaggaagtcgaccggcggcaaggcgccgcggaascagctggccaccaaggcggcgcgaaagtcggccccggccaccggcggcgtgaakaagccgcacaggtttcgccccggcaccgtcgcgctccsagattccgcaagtaccagaagagcacggagctgctcatccggaagctgcccttccagcggctggtgcgggagatcgcgcaggacttcaagaccgacctccggtttccagtcctccgccgtcgccgcgctgcaggaggccgccgagscgtaacctggtggggtctct

SEQ ID NO: 931 - DNA, 485 bp, Zea mays
  misc_feature: Ceres CLONE 230065-F
  misc_feature: Encodes the peptide sequence at SEQ ID NO. 932
awagaaaaacggtgagctagaaacttccaaatcgaacggcacacaaaaatcacaacccggaaaggaccagcagcgcaaaggtgagcgagctttccttcggaactctcgtgctcacctcatccgtccgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctctgcgccgggagagtaaacgggccatgctgccgatcctcccgtccagagctcctattcacatgattattaaa

SEQ ID NO: 932 - protein, 80 aa, Zea mays; identical to SEQ ID NO: 816
  misc_feature: Ceres CLONE 230065-F
  misc_feature (10)..(80): Pfam Name: S1FA Pfam Description: DNA binding protein S1FA

SEQ ID NO: 933 - DNA, 464 bp, Zea mays
  misc_feature: Ceres CLONE 230115-F
  misc_feature: Translation starting site: 141
caaacctctcctggcacgagatcacgcttctcgtcggatcgaacagctagggtttccaagatgttwygggcgcgcgccgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatagtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaat

SEQ ID NO: 934 - DNA, 473 bp, Zea mays
  misc_feature: Ceres CLONE 230133-F
  misc_feature: Encodes the peptide sequence at SEQ ID NO. 935
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatacaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacatggcacatc

SEQ ID NO: 935 - protein, 137 aa, Zea mays
  misc_feature: Ceres CLONE 230133-F
  misc_feature (13)..(71): Pfam Name: DnaJ Pfam Description: DnaJ domain
MFGRAPKKSDNTRYYEILGVSKDASQDDLKKAYRKPPYKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYMAH

SEQ ID NO: 936 - DNA, 349 bp, Zea mays
  misc_feature: Ceres CLONE 230142-F
  misc_feature: Encodes the peptide sequence at SEQ ID NO. 937
  misc_feature (96)..(96): n is a, c, t, g, unknown, or other
  misc_feature (97)..(97): n is a, c, t, g, unknown, or other
  misc_feature (262)..(262): n is a, c, t, g, unknown, or other
attccacccgcttcccccagccgcacgaaaccctaacgccgccgccgcttcacaggtaagccgccgtcatggtctccggttccggcgtatcgcganncgttggtggacgcgcgccaccacatgctgggccgcctgtcgtcgattatcgccaaggaactgctcaatgggcagaaggtggtcgtcgtccgctgcgaggagatctgtatstcgggtggactcgtacgccagaagwtgaagtacctccgctttctccgcaagcggntgaacaccargccatcccatgggcccatccacttccgcgccccgtccaagatcctgtgacgcaccatccgcgggatgattccgcaca

SEQ ID NO: 937 - protein, 66 aa, Zea mays
  misc_feature: Ceres CLONE 230142-F
  misc_feature (1)..(67): Pfam Name: Ribosomal_L13 Pfam Description: Ribosomal protein L13
  misc_feature (29)..(29): Xaa is any aa, unknown, or other
  misc_feature (38)..(38): Xaa is any aa, unknown, or other
  misc_feature (48)..(48): Xaa is any aa, unknown, or other
  misc_feature (51)..(51): Xaa is any aa, unknown, or other
MLGRLSSIIAKELLNGQKVVVVRCEEICXSGGLVRQKXKYLRFLRKRXNTXPSHGPIHFRAPSKIL

SEQ ID NO: 938 - DNA, 785 bp, Zea mays
  misc_feature: Ceres CLONE 230150-R
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (94)..(94): n is a, c, t, g, unknown, or other
aacccccacccccccaccccccccaccaacaaaaaaacccatcacccaaataatatttttgttttttttccccccnnnnnagcaattgggtacngggccccccctcgaggtcgacggtatcgataagcttttttttttttttttttgcagatctaaatggtcctctctatgtgataaagatcgggaactatacaaagttaattacagataatattattgtgtgaaagttaacttgctatgtcttgttttacctagtccacagtcaagtgtaacaatattccgtaatccaggataagcctttattattttttgttctatgggaaagtaacacatcactggggctccacagcctgcacatttgtgtaagagtaagagtagctctcaatggtggagttgccctctctgaacttcgtccaggaaaacccccacgccttaagcaaaatttggcctctcaggttaaaaactcctccttagaaaggatgaatgtttaagaaaaacagaacccattgctgcaaccagaagcttaaagtgtgtgacccactgacaaaaatgttgccgcccatccatagaccccccccctcagtaagcctctaacaaccttaacttagaagaaaaggaccctggaagcccaagaggccaataatggtggaaatgtggtgtaccatttggaggcaaaccaaaataacccattaaaaaggaaatgaccattggcatgggcacaaacaatggggaactaagaggcataattggaccgccaggggcacttcaaaagaaatcctctccaa

SEQ ID NO: 939 - DNA, 1368 bp, Zea mays
  misc_feature: Ceres CLONE 230189
  misc_feature: Encodes the peptide sequence at SEQ ID NO. 940
ccctcccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgytacgccgggggcgccggcggcggggacgagctctcggtggaggagcgcaacctgctgtccgtcgcctacaagaacgtcatcggcgcccgcagsgcytcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttaatgtctcggaataatatgaattggctacaaaaaaaaaaaaaaaa

SEQ ID NO: 940 - protein, 268 aa, Zea mays
  misc_feature: Ceres CLONE 230189
  misc_feature (8)..(249): Pfam Name: 14-3-3 Pfam Description: 14-3-3 protein
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 809 in the 11/479,226 US patent application
  misc_feature (36)..(36): Xaa is any aa, unknown, or other
  misc_feature (67)..(67): Xaa is any aa, unknown, or other
  misc_feature (68)..(68): Xaa is any aa, unknown, or other
MSPSEPTREESVYMAKLAEQAERYEEMVEFMERVAXYAGGAGGGDELSVEERNLLSVAYKNVIGARXXSWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQ

SEQ ID NO: 941 - DNA, 162 bp, Zea mays
  misc_feature: Ceres CLONE 230228-F
  misc_feature (1)..(1): n is a, c, t, g, unknown, or other
  misc_feature (93)..(93): n is a, c, t, g, unknown, or other
nwaaattgcattgcaggcyccgmgtactccgtggggcgacctggaggaggtgctggcgcgcgcggsgaccaaggaccgcacggtgatcatgangagatcaacgcggcgtggacgscccgggctcgctgctggacctcttcttcgagagcttccgcacggggg

SEQ ID NO: 942 - DNA, 217 bp, Zea mays
  misc_feature: Ceres CLONE 230253-F
  misc_feature: Encodes the peptide sequence at SEQ ID NO. 943
  misc_feature (174)..(174): n is a, c, t, g, unknown, or other
aaagtccagaccaaagctcctaagtccaatccctcgctagccacttgccatctgatcaaccagccagccgatctcagcgatccgccatggccaccgcgtattacgagaggccccgtggcggcgcgtcgaggaggcggacgacttcgatgagttcgaccccacgccgtacgsttngggtaacgacctcgccgtcaccttcggtcgcccgctgccaccg

SEQ ID NO: 943 - protein, 43 aa, Zea mays
  misc_feature: Ceres CLONE 230253-F
  misc_feature (29)..(29): Xaa is any aa, unknown, or other
  misc_feature (30)..(30): Xaa is any aa, unknown, or other
MATAYYERPRGGASRRRTTSMSSTPRRTXXVTTSPSPSVARCH

SEQ ID NO: 944 - DNA, 320 bp, Zea mays
  misc_feature: Ceres CLONE 230258-F
  misc_feature: Encodes the peptide sequence at SEQ ID NO. 945
atcgacwttttatcwccagatccagattagctaccacggcaccgccagcccggacggcwataaagacgaggcccaccwcgaaawcgacggcgatraaraagaccagttcccctcwcctratcgtcctgttcctcacagcagcagccaatggcggccgagccggaraagcaggcggcccamgcggcacaggagacggccgtgcacatcgwgtacgtwgaccgccccgaggacgccgaccctgaggagttccacatccgcaccctcacccccgatccatcggcagcgaacagaaggccagggacgcartgcatcataccaca

SEQ ID NO: 945 - protein, 57 aa, Zea mays
  misc_feature: Ceres CLONE 230258-F
  misc_feature (11)..(11): Xaa is any aa, unknown, or other
  misc_feature (21)..(21): Xaa is any aa, unknown, or other
MAAEPEKQAAXAAQETAVHIXYVDRPEDADPEEFHIRTLTPDPSAANRRPGTQCIIP

SEQ ID NO: 946 - DNA, 143 bp, Zea mays
  misc_feature: Ceres CLONE 230299-F
  misc_feature: SWISSPROT Homolog: EC 1.1.1.219 Dihydrokaempferol 4-reductase
gtctagctgagaacatggtgacctcaagcaagggcaaggtatgtgtamcggggcctcaggctttgttgcctcttggcttatcaaacggctcctcaaatctaratatcatgtggtagggactgtcagggacccaggaatcacca

SEQ ID NO: 947 - DNA, 435 bp, Zea mays
  misc_feature: Ceres CLONE 230310-F
  misc_feature: Encodes the peptide sequence at SEQ ID NO. 948
acactagtcaaagttttacgtaacttgcgtggttctcttcctgcgacggaagcaaacactgcccgagacatagacagcgggacgtcgagatggccgacggggaggacgccgccgccgcgykchgccgggccgccatcacagactaccgcaagawagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgtataatgaacgctttatcgtgaaggccagcagtggtccccgatacgtggtcggttgccgaagtaaagtggacaaggagaagttgacatctggtactcgtgttgtactttgaacatgacgacctttgacaat

SEQ ID NO: 948 - protein, 102 aa, Zea mays
  misc_feature: Ceres CLONE 230310-F
  misc_feature (41)..(41): Xaa is any aa, unknown, or other
  misc_feature (52)..(52): Xaa is any aa, unknown, or other
TLVKVLRNLRGSLPATEANTARDIDSGTSRWPTGRTPPPRXAGPPSQTTARXLLNCRELESRVGTVRESLKTAKKDFTKTEDDLKSLQSVGQIIGEVLRPLV

SEQ ID NO: 949 - DNA, 264 bp, Zea mays
  misc_feature: Ceres CLONE 230346-F
  misc_feature: Encodes the peptide sequence at SEQ ID NO. 950
  misc_feature (165)..(165): n is a, c, t, g, unknown, or other
  misc_feature (212)..(212): n is a, c, t, g, unknown, or other
atctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcanscggcagtmcgcgtcaagatcctcttcaccgcgctctgccacaccgnccactacacctggagcggtcaaggatcctgagggtcttttttccttgcattc

SEQ ID NO: 950 - protein, 60 aa, Zea mays
  misc_feature: Ceres CLONE 230346-F
  misc_feature: SWISSPROT Homolog: EC 1.1.1.1 Alcohol dehydrogenase
  misc_feature: Functional homolog of the protein sequence given in SEQ ID NO 96859
  misc_feature: Useful for making plants with modulated heat sensitivity
  misc_feature (35)..(35): Xaa is any aa, unknown, or other
  misc_feature (36)..(36): Xaa is any aa, unknown, or other
  misc_feature (51)..(51): Xaa is any aa, unknown, or other
MASPTQGQVITCKAAVAYEPNKPLVIEDVQVAPPXXAVRVKILFTALCHTXHYTWSGQGS

SEQ ID NO: 951 - DNA, 369 bp, Zea mays
  misc_feature: Ceres CLONE 230364-F
  misc_feature: Encodes the peptide sequence at SEQ ID NO. 952
  misc_feature (149)..(149): n is a, c, t, g, unknown, or other
  misc_feature (230)..(230): n is a, c, t, g, unknown, or other
  misc_feature (274)..(274): n is a, c, t, g, unknown, or other
acgagcccggttcgttctcgacctttcgtctcgctctcgcccgcccgaccccgcggascctagcctagccttgcccccgaccgcggattccccctcggccgccgcgcgcccgcacccgcacccgcgatgatgaactgcgccggasaggnaccccgtggaggacttcctgatctccggcgccgtcgacgacgaagatctagccatcttctgcgacggaggacttgggattnagggtgtcaatgggagatgcttgtggatttgagcagtctaattngggcaaaaggggttagakatgaaccatgttcatctggtctaaaatctaaagcttgtcgtgaaaaaatgaggagggacaagctgaatgacaggttc

SEQ ID NO: 952 - protein, 81 aa, Zea mays
  misc_feature: Ceres CLONE 230364-F
  misc_feature (7)..(7): Xaa is any aa, unknown, or other
  misc_feature (8)..(8): Xaa is any aa, unknown, or other
  misc_feature (35)..(35): Xaa is any aa, unknown, or other
  misc_feature (50)..(50): Xaa is any aa, unknown, or other
  misc_feature (56)..(56): Xaa is any aa, unknown, or other
MMNCAGXXPRGGLPDLRRRRRRRSSHLLRRRTWDXGCQWEMLVDLSSLIXAKGVRXEPCSSGLKSKACREKMRRDKLNDRF

SEQ ID NO: 953 - DNA, 470 bp, Zea mays
  misc_feature: Ceres CLONE 230378-F
  misc_feature: Encodes the peptide sequence at SEQ ID NO. 954
attcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacacttgggtgcttgacaagctcaaggctgagcgtgagagaggtatcaccattgatatcgctctttggaagtttgagaccaccaagtactactgcactgtcattgatgcccctggacatcgcgacttcatcaagaacatgatcacgggtacctcccaggctgactgtgctgtcctgatcattgactccaccactggtggttttgagg

SEQ ID NO: 954 - protein, 124 aa, Zea mays
  misc_feature: Ceres CLONE 230378-F
  misc_feature (5)..(124): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYTWVLDKLKAERERGITIDIALWKFETTKYYCTVIDAPGHRDFIKNMITGTSQADCAVLIIDSTTGGFE

SEQ ID NO: 955 - DNA, 447 bp, Zea mays
  misc_feature: Ceres CLONE 230385-F
  misc_feature: Encodes the peptide sequence at SEQ ID NO. 956
accttcctccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtgt

SEQ ID NO: 956 - protein, 121 aa, Zea mays
  misc_feature: Ceres CLONE 230385-F
  misc_feature (5)..(121): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTG

SEQ ID NO: 957 - DNA, 365 bp, Zea mays
  misc_feature: Ceres CLONE 230398-F
  misc_feature: Translation starting site: 189
  misc_feature: SWISSPROT Homolog: EC 3.1.3.16 Phosphoprotein phosphatase
gaggaaaaatctcgcattcgcaaaccaagcaaatggaggcatgagctccgccgcctccccgtctctcgccgatctcccccaaaccctagcctcgacctgaccgccagctgggcccgcagcggagaaggagtcggagtcgcccccacccacccaccctctgccgcgggcgggagcgggcggcggacgagatgccgtcgcacggggatctggaccggcavatcgcgcmstgcsatcttgcaagtacctgcccgaggcggaggtcaaggtgctctrcggagcaggccaaggccatcctcatggaggaatggaacgtgcagcccgtgmgctgccccgtcaccgtctgcgrcgacatccacggccagttc

SEQ ID NO: 958 - DNA, 267 bp, Zea mays
  misc_feature: Ceres CLONE 230434-F
  misc_feature (219)..(219): n is a, c, t, g, unknown, or other
agatctcccccatttctcctccacgccgccccctccgcatttcccgtgctcctcttgttccggcatggcggacagacgcagccacaaggggaaggcggcgctasccaagcacgagtccctgatggagaagctcgccgacaagctccacgtcggcggcggcaaggccgactcctmactcctcctcggactccgacagtgacgagcggccccgccctcggnaccgctgccgacgagctcaagcagtcwccttctccgacgccgccgcca

SEQ ID NO: 959 - DNA, 118 bp, Zea mays
  misc_feature: Ceres CLONE 230550-F
  misc_feature (49)..(49): n is a, c, t, g, unknown, or other
  misc_feature (50)..(50): n is a, c, t, g, unknown, or other
  misc_feature (90)..(90): n is a, c, t, g, unknown, or other
aggcaagtagccctccctgttccatcgaacccagcagagcagccagccnncaacgaagcatgccgtcgaagccgaacgccgcgtcggccnhgtcttcmtcgctttcctcctcgtcatc

SEQ ID NO: 960 - DNA, 145 bp, Zea mays
  misc_feature: Ceres CLONE 230553-F
  misc_feature (100)..(100): n is a, c, t, g, unknown, or other
aaaaatcgagaggacgccagggccgattctctgcgtgacttggggcgtcgtcgcgagttttctccggccgagggcggcgcgaccggacaacmagcgtgancggaccggcgacatgactcgcggcaaccagcgtgaccgcgaccgt

SEQ ID NO: 961 - DNA, 383 bp, Zea mays
  misc_feature: Ceres CLONE 230559-F
  misc_feature: Encodes the peptide sequence at SEQ ID NO. 962
ctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggc

SEQ ID NO: 962 - protein, 69 aa, Zea mays; identical to SEQ ID NO: 778
  misc_feature: Ceres CLONE 230559-F
  misc_feature (50)..(50): Xaa is any aa, unknown, or other

SEQ ID NO: 963 - DNA, 392 bp, Zea mays
  misc_feature: Ceres CLONE 230631-F
  misc_feature: Encodes the peptide sequence at SEQ ID NO. 964
aaagaaaaacggtgagctagaaacttccaaatcgaacggcacacaaaaatcacaacccggaaaggaccagcagcgcaaaggtgagcgagctttccttcggaactctcgtgctcacctcatccgtccgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagaggg

SEQ ID NO: 964 - protein, 68 aa, Zea mays
  misc_feature: Ceres CLONE 230631-F
  misc_feature (10)..(68): Pfam Name: S1FA Pfam Description: DNA binding protein S1FA
MADQFVDSANNVIIEEVNKGLNPGMVVLLVVASFLLLFFVGNYALYVYAQKTLPPKKKKPVSKKKLKR

SEQ ID NO: 965 - DNA, 147 bp, Zea mays
  misc_feature: Ceres CLONE 230690-F
  misc_feature (77)..(77): n is a, c, t, g, unknown, or other
  misc_feature (78)..(78): n is a, c, t, g, unknown, or other
aatccaccaccatcctctgccttgtcgatcatccatcgaccgcctcctgctcggcttcccaccccgcctgcygcgtnncacaccagggaggagctcctccgaccgaccggccatgagctaccaggctcctcctccgggcacctcagc

SEQ ID NO: 966 - DNA, 407 bp, Zea mays
  misc_feature: Ceres CLONE 230708-F
  misc_feature: Translation starting site: 93
  misc_feature (77)..(77): n is a, c, t, g, unknown, or other
  misc_feature (78)..(78): n is a, c, t, g, unknown, or other
  misc_feature (233)..(233): n is a, c, t, g, unknown, or other
aacaacagccctacaacttactgcttgctctagctagctagctgctcccggcccatatccactacacaagtaggctnncagcagcagcagcaatggcctcggtgacgagttcccggccgtggcctcgtcctgctgctcgccgccagcgccttcctggccagcgaggtggcggcgtgcggcggctgcccgaaaccaactcctcctcctccatcgccaccaccgccgtcgcccwncagcacgccgtscctccgccaccgtccagctccggcgcaagtgccccaagaacgcgctgaaactgggcgtgtgcgcaacgtgctgggcctcgtcaaggtgtccatcggcaaggtgcccaccgactcgtgctgcccgctgctggacggcctcgcgaccctggaggccgccgtctg

SEQ ID NO: 967 - DNA, 327 bp, Zea mays
  misc_feature: Ceres CLONE 230712-F
  misc_feature: Pfam Name: Ribosomal_S7 Pfam Description: Ribosomal protein S7p/S5e
  misc_feature (221)..(221): n is a, c, t, g, unknown, or other
attagaatccacctcgcaccccgcgagckktgacttccctagggtttagtcgcgccgccgccgccgccgaaacagcacatcgctctctcgatctcagccatggcgaggtggagcagccccaggacgcggtgaagctcttcaaccgctggaccttcgacgatgtccaggtgaacgatatctcgctgaacgactacctggctgtgactgcggcgaasacsgancattcctgccgcactccgcggggcgctactccaagaagcggttccgcaaggcgcagtgscattycgtcgagcgcctcaccaactcgctcatgatgcacgggcgcaa

SEQ ID NO: 968 - DNA, 119 bp, Zea mays
  misc_feature: Ceres CLONE 230715-F
agatccgtgttccgtgtccgcgtccagtgtgtccgctactccgctccccctcagtcctcagttcctcacctagcggtastgacgcgcgggagacgtagatggcggcttcggaggcggca

SEQ ID NO: 969 - DNA, 316 bp, Zea mays
  misc_feature: Ceres CLONE 230735-F
  misc_feature: Pfam Name: Ribosomal_S12 Pfam Description: Ribosomal protein S12
  misc_feature (66)..(66): n is a, c, t, g, unknown, or other
  misc_feature (241)..(241): n is a, c, t, g, unknown, or other
  misc_feature (245)..(245): n is a, c, t, g, unknown, or other
cytgccgccgccgccgctcccgctcccagctcgtgttccgcttcttgcagccgtcgccgcgarvtnccagagaacttccgtcaacatggggaagacacgtggtatgggagccgggcgcaactcaagacccaccgcagaaccagcgtggctgacaaggcatacaagaagagccatttgggcaatgagtggaagawacccttcgctgggtcatcccatgccaagggcatttgtcctggagaanattngtattgaggccaagcagcccaactccgctatccgtaagtgtgctcgtgttcagcwttgttaagaatggcaa

SEQ ID NO: 970 - DNA, 92 bp, Zea mays
  misc_feature: Ceres CLONE 230751-F
  misc_feature (25)..(25): n is a, c, t, g, unknown, or other
  misc_feature (67)..(67): n is a, c, t, g, unknown, or other
agtctccaacagaccaacagcatcnaatcaatcaagacagccccgtgctagctcacccgccgggctngccacgatgagaggcctcctcgcgt

SEQ ID NO: 971 - DNA, 182 bp, Zea mays
  misc_feature: Ceres CLONE 230779-F
  misc_feature (18)..(18): n is a, c, t, g, unknown, or other
  misc_feature (19)..(19): n is a, c, t, g, unknown, or other
aacctawayywcgtctcnnctcgcctccgccagtcagccccctcaaccccggcggccaaaagtcgacgcaccgaagcggcggccatggcggactaaagcgctgtcagagagccgggacctgacgcggatcgagcgcatcggcsgcagctcccacatccgggggctagggcwggactcctcca

SEQ ID NO: 972 - DNA, 488 bp, Zea mays
  misc_feature: Ceres CLONE 232550-F
  misc_feature: Encodes the peptide sequence at SEQ ID NO. 973
caggcaaatggaggcatgagctccgccgcctccccgtctctcgccgatctcccccaaaccctagcctcgacctgaccgccagcgggcccgcagccggagaaggagtcggagtcgcccccacccaccctctcmtctgccgcgggcggggagcgggcggcggacgagatgccgtcgcacggggatctggaccggcagatcgcgcastgcgcactgcaagtacctgcccgaggcggaggtcaaggcgctctgcgagcaggccaaggccatccttatggaggaatggaacgtgcagcccgtgcgctgccccgtcaccctctgcggcgacatccacggccagttctatgacctcatcgagctcttccgcatcggcggcgactctcccgacaccaactacctcttcatgggcgactacgtcgatcgtggctactattcagttgaaacagtttctctgttagtggctttgaaagtccgttacagagatagaatta

SEQ ID NO: 973 - protein, 72 aa, Zea mays
  misc_feature: Ceres CLONE 232550-F
  misc_feature: SWISSPROT Homolog: EC 3.1.3.16 Phosphoprotein phosphatase
  misc_feature: The sequence is a functional homolog of SEQ ID NO 13 in US patent 7271316
MEEWNVQPVRCPVTLCGDIHGQFYDLIELFRIGGDSPDTNYLFMGDYVDRGYYSVETVSLLVALKVRYRDRI

SEQ ID NO: 974 - DNA, 275 bp, Zea mays
  misc_feature: Ceres CLONE 232580-R
  misc_feature: Encodes the peptide sequence at SEQ ID NO. 975
agaagcttcttgcccagaggytgaaggaacagagggaccgccggagcgagagcttggccaagaggagatccaagctttytgccgccgccaaggcttctgctgccacctctgcttaagaatattcagttttwtgggatctttgtaaggtctatcttgtaacagcaaaagtgttttgggatctttgtaagctacatagttcacatcactcaagtgtttctgctagtagtggatccmcaaaaaaaaaaaaaaaaaaaaaaaggaaaaaaaaaaaaaaa

SEQ ID NO: 975 - protein, 37 aa, Zea mays
  misc_feature: Ceres CLONE 232580-R
  misc_feature (26)..(26): Xaa is any aa, unknown, or other
KLLAQRLKEQRDRRSESLAKRRSKLXAAAKASAATSA

SEQ ID NO: 976 - DNA, 424 bp, Zea mays
  misc_feature: Ceres CLONE 232639-F
  misc_feature (143)..(143): n is a, c, t, g, unknown, or other
  misc_feature (325)..(325): n is a, c, t, g, unknown, or other
atcttgctctgaacgcattcctcccatctcccaagacctcctcagacccgagaagcgcmstgcggggccatggacgccaccggcactggagctggagggaaggcgaagaagggagcggccggtcgcaaggccggcgggccganggaagaagtcggtgacgaggtccgtgaaggccgggctccagttccccgtcggccgcatcgggcgctacctcaagaagggccgctacgcgcascgtcggcagcggtgcccccgtctacctcgcggccgtcctggagtacctcgccgctgaggtcctggagctcgccggcaacgctgccaaggncaacaagaagacgcgcatcgtcccgggccacgtgctgctggcgatccgcaacgacgaggagctcgggaagctkgctgaccggcgtgaccatcgcccacg

SEQ ID NO: 977 - DNA, 244 bp, Zea mays
  misc_feature: Ceres CLONE 232654-F
  misc_feature (189)..(189): n is a, c, t, g, unknown, or other
acgatcacacaccactccacagcagtagcaagagggatagagcaaggccacacacacacacacaccactaggctaggttagtctttaaatcgtcgtcgagaaacaaaaagggcgcgcacgcaaacaggcaaacaagaagagarccgatcgaccgagagctagcacgcgatggcgaggtcttccagatgntggtggcggcastctgctggccttggccctggccgtgtcgaccgccgaggcgagg

SEQ ID NO: 978 - DNA, 176 bp, Zea mays
  misc_feature: Ceres CLONE 232681-F
  misc_feature (68)..(68): n is a, c, t, g, unknown, or other
  misc_feature (69)..(69): n is a, c, t, g, unknown, or other
atcactgccaaatcccccagaaaatcaactcctccccaattccacgctgccaccaattcgtcgtcctnngcgccaagcaccaaagctccgatggcccgcacgaagcagacggcgcgcaagtcgacgggcggcaaggcgccccgcaagcagctaggcgaccaaggcggcgcgcaagt

SEQ ID NO: 979 - DNA, 472 bp, Zea mays
  misc_feature: Ceres CLONE 232704-F
  misc_feature: Encodes the peptide sequence at SEQ ID NO. 980
  misc_feature (66)..(66): n is a, c, t, g, unknown, or other
acacttgckccgccactgcctcacaggtaaggccgccatggtctccggttcgggcgtgtgcgcgantcgttgggtggacgcgcgccaccacatgctgggccgtctctcctcgatcatagccaaggagctcaatgggcagaaggtggtcgtcgtccgctgcgaggagatctgcatgtcgggcggcctcgtccgtcagaagatgaaktacctccgcttcctccgcaagcggatgaacaccaagccgtcccasgggcccatccacttccgcgcccccgccaagatcctgtggcgcaccatccgcgggatgattccgcacaagaccaagaggggggaggcggctctggcgaggctcaagacgtacgagggcktcccgccgccgtacgacaagaccaagcgtatggtcatccctgacgctcttaaggttctgaggctacagcctggacacaagtactgcctcctcggcgacctctct

SEQ ID NO: 980 - protein, 145 aa, Zea mays
  misc_feature: Ceres CLONE 232704-F
  misc_feature (12)..(125): Pfam Name: Ribosomal_L13 Pfam Description: Ribosomal protein L13
  misc_feature (10)..(10): Xaa is any aa, unknown, or other
  misc_feature (56)..(56): Xaa is any aa, unknown, or other
  misc_feature (71)..(71): Xaa is any aa, unknown, or other
  misc_feature (111)..(111): Xaa is any aa, unknown, or other
MVSGSGVCAXRWVDARHHMLGRLSSIIAKELNGQKVVVVRCEEICMSGGLVRQKMXYLRFLRKRMNTKPSXGPIHFRAPAKILWRTIRGMIPHKTKRGEAALARLKTYEGXPPPYDKTKRMVIPDALKVLRLQPGHKYCLLGDLS

SEQ ID NO: 981 - DNA, 484 bp, Zea mays
  misc_feature: Ceres CLONE 232722-F
  misc_feature: Encodes the peptide sequence at SEQ ID NO. 982
gtcgcgccgccgctcctctcacaacccagtcgctcaaaaccctagagctctcgcctgctcgcytccgccgccggagcgagctccccatcttcatccgtcaaccatggcgacccagatcagcaagaagaagaagttcgtcagckacggtgttttctacgccgagctcaatgagatgctgacgcgggastggcggaggatggctactctggcgtggaggtgcgcgtcacgccgatgcgcacggagatcatcatccgcgccacgsacgcagaacgtgctcggcgagaagggccgcagatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtgccgcaggcttgctatggtgttcttcgttatgttatggaga

SEQ ID NO: 982 - protein, 84 aa, Zea mays
  misc_feature: Ceres CLONE 232722-F
  misc_feature (11)..(11): Xaa is any aa, unknown, or other
MRTEIIIRATXAERARREGPQIRELTSVVQKRFNFPENGVELYAEKVVNRGLCAIAQAESLRYKLLGGLAVPQACYGVLRYVME

SEQ ID NO: 983 - DNA, 481 bp, Zea mays
  misc_feature: Ceres CLONE 232723-F
  misc_feature: Translation starting site: 86
agccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgatggacttgtgaagtgtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgaggggccttaacatag

SEQ ID NO: 984 - DNA, 596 bp, Zea mays
  misc_feature: Ceres CLONE 232740-R
caagacgctcgtcgccaggaacgtcatcccggccaactggaggcccaacaccttctaccgctccttcgtccagtacagctagctagctggtttgcgccctcgggccgytcggtcaccaccacccaccactactaccaccaccacccactagactactgcttctgctaccaaatactacggcggaacggaacggctggttgccgccgccgccgtcgtccttggaaaggttgaggcgtctcttggtcatccgtatcgttaccgttgtcatggtcctttgagtcgttgcaaccctgattgcaagccggcaagggggaaaaaaccaacaaagccgtgtgggaaaatggaggaggcaggcgtacaatgtacgctctcccgcccactgttgctttataatctctatatcatcatcatcttcttcttctccattccgatcggtgattaatcgaaaagtatattgtaatgtataaacaccatttcctgtttcccggagctgagctaccctgttcacacccctgtgcagggttgaggcttctgcatgttaattgttctttcgtcactaatgttttcttctgtgacaatgaaaaaaaaaaaaaaaa

SEQ ID NO: 985 - DNA, 824 bp, Zea mays
  misc_feature: Ceres CLONE 232767
  misc_feature: Encodes the peptide sequence at SEQ ID NO. 986
agggatagtttggctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacttcaaggacgtgccgctgcccatctgcgcctcgctgctcaagcagttggactcggacgacgacgacgatcagtaatagcacatcgtcgacgaccgcagactggctggcactaaaccacaaatcctcttcacctggattacaaatatgtaactsagaaaggaaaggaaaacaaaaatgtaactgcgtggctgtmccaaattctgagtgcyggattctysctattgtcacccattgttcgttttatcatacaagttgcagcgcaaaaaaaaaaaaaaaaaa

SEQ ID NO: 986 - protein, 167 aa, Zea mays
  misc_feature: Ceres CLONE 232767
  misc_feature (34)..(154): Pfam Name: Pollen_Ole_e_I Pfam Description: Pollen proteins Ole e I family
MASIPATTFAVILSVLFCAAAGTAVDNDLPDYVIQGRVYCDTCRAGFVTNVTEYIAGAKVRLECKHFGTGKLERSIDGVTDANGTYTIELKDSHEEDICEVVLVESPRKDCDQVQADRDRAGVLLTRNVGISDNLRPANPLGYFKDVPLPICASLLKQLDSDDDDDQ

SEQ ID NO: 987 - DNA, 461 bp, Zea mays
  misc_feature: Ceres CLONE 232791-F
  misc_feature: Translation starting site: 82
  misc_feature: SWISSPROT Homolog: EC 5.2.1.8 Peptidylprolyl isomerase
gcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtyatccaagctctttgttggagggatttcttatcaaactgatgatcacagtctcagggacgagttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctacggtggtggt

SEQ ID NO: 988 - DNA, 595 bp, Zea mays
  misc_feature: Ceres CLONE 232792-R
  misc_feature: Encodes the peptide sequence at SEQ ID NO. 989
accagcagtggcaccagctgcaagtgctccacctgttgagaaaccatctgctgcaaagactgatgcggccaagcaggttgctgctggggttaccagccaaaccaataactaccacagggctgatggtcagaacactggcaacttcttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaaatttcacggcaagtcgtttgccgtatctttttttaccaatgtatgtctatatatgtaagtatcaaatctgcaatgtgttaatcaccatttccgctggggcggccgcacgagtactttacgcatcagtatatgtgcagcatcaaatattccattttcatgaccataagacgttcttgatccaaaaaaaaaaaaaaaa

SEQ ID NO: 989 - protein, 96 aa, Zea mays
  misc_feature: Ceres CLONE 232792-R
PAVAPAASAPPVEKPSAAKTDAAKQVAAGVTSQTNNYHRADGQNTGNFLRTVLQPRSTLLLAVALPWATCSVATDARAGALTKVILPCLLRAMSES

SEQ ID NO: 990 - DNA, 612 bp, Zea mays
  misc_feature: Ceres CLONE 232794-R
  misc_feature: Encodes the peptide sequence at SEQ ID NO. 991
ctgtacaagattgctgatattccgttcttggcaccctacaagaccdagattattgatgttatcgagaagggagagaaacagcccaacatcactattggcattttggtctccgttgtcatcgtgttcgttaccgttctctgcaagctcctgtttggtggcaagaaaccagtggcacctgtgaaacctgcagctgaggcgaagaagcccaaggccgcggagacggacggtgctggaagcagtggtgacaaggatgagaaagaggatgaaaaggaggagacaggcccacgtcggaggacccgaagggagacatagacctgtttttgacgtgttttagctcttctggcgtctgcttattttgagaactcttaatatttgtgagtgtataataggagcttatgtcacctctgcggcttcccccgctgctgatttgtttttaatggttagaccaggacccttcacgagcgtagaatttagttcttgttggtcatttatgtgctgtgcctgacggtgttcaatcagatagaggtgatggtttttttggtagatcaaatcaaggaatatttcatatgcctttttggcaactgtttcagttgggcaaaaaaaaaaaaaaaa

SEQ ID NO: 991 - protein, 103 aa, Zea mays
  misc_feature: Ceres CLONE 232794-R
  misc_feature (16)..(16): Xaa is any aa, unknown, or other
LYKIADIPFLAPYKTXIIDVIEKGEKQPNITIGILVSVVIVFVTVLCKLLFGGKKPVAPVKPAAEAKKPKAAETDGAGSSGDKDEKEDEKEETGPRRRTRRET

SEQ ID NO: 992 - DNA, 479 bp, Zea mays
  misc_feature: Ceres CLONE 232794-F
  misc_feature: Encodes the peptide sequence at SEQ ID NO. 993
acggacgcttcgctctagtcggaaggtttcgaggaactcccgggctcgaggagatcgggacgatgatgggagggcgcgctctgctgctgctcctggtctcggcgctgctcgttcatatccgcgcctctgacccgctgctgtacgagccgtttgatgaggacttcgagggtagatggatcgtmtccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtggg

SEQ ID NO: 993 - protein, 139 aa, Zea mays
  misc_feature: Ceres CLONE 232794-F
  misc_feature (24)..(139): Pfam Name: Calreticulin Pfam Description: Calreticulin family
MMGGRALLLLLVSALLVHIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCG

SEQ ID NO: 994 - DNA, 448 bp, Zea mays
  misc_feature: Ceres CLONE 232847-F
  misc_feature: Encodes the peptide sequence at SEQ ID NO. 995
  misc_feature (2)..(2): n is a, c, t, g, unknown, or other
  misc_feature (409)..(409): n is a, c, t, g, unknown, or other
anaccctagaagcctccaccctcctgcgcctccaccctcctcgccgcctcactccctctgcagaggtcgcagatccgtccggttagacgaagccgcccgcacccatggcctccggtragctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtsgcgctgctccagttgctgctgacgahccagctggaggtgctgcagctgctgctsccctgctgcagaggagaagaaggaagagcccaaggaggagtctgatgacganatgggcttcagctggttcgactgaggaggccctaggtac

SEQ ID NO: 995 - protein, 114 aa, Zea mays
  misc_feature: Ceres CLONE 232847-F
  misc_feature (21)..(87): Pfam Name: Ribosomal_60s Pfam Description: 60s Acidic ribosomal protein
  misc_feature (5)..(5): Xaa is any aa, unknown, or other
  misc_feature (67)..(67): Xaa is any aa, unknown, or other
  misc_feature (75)..(75): Xaa is any aa, unknown, or other
  misc_feature (85)..(85): Xaa is any aa, unknown, or other
  misc_feature (102)..(102): Xaa is any aa, unknown, or other
MASGXLACTYAALILSDDGIAITAEKIATIVKAANIKVESYWPALFAKLLEKRSVEDLILSVGSGGXAAPVAADXPAGGAAAAAXLLQRRRRKSPRRSLMTXWASAGSTEEALG

SEQ ID NO: 996 - DNA, 395 bp, Zea mays
  misc_feature: Ceres CLONE 232851-F
  misc_feature (218)..(218): n is a, c, t, g, unknown, or other
  misc_feature (296)..(296): n is a, c, t, g, unknown, or other
atcacccaccgcctccgccgccgacaacagcgtagtgtagtgtagttccggagagggttggggagagtagtagtgatccgcaatartcgacggaggaggmwgttatrgctgaggtcccggatraccgaggwgccagcggargtcccggcggcccaggtggccgaggmgcccaaggcgaascaggcgcccaaggagaagaaggcgcctaaggagaagangccgtccgcggcgaagaagccggcggcgcaccctccctacgctgagatsattgtagaggcgatcgctgccctcaaggngaggaaggggtcgagctcggtggccatcagcaagtacgtcgaggggaagcacggcgcaagctccccaccaacttccgcaagcagctcacccgtgcagct

SEQ ID NO: 997 - DNA, 2129 bp, Zea mays
  misc_feature: Ceres CLONE 232885
  misc_feature: Encodes the peptide sequence at SEQ ID NO. 998
gccttctaggcttccattctcaccgcagtcgccggtgtcgcctccgcctggatcgtccgccactgccagctgccattccgcctcggatctcagtcgccttgctgcctctgcgcccggacacagccgcgcattccccaccggctcgccgagcaggggccctgctcccacgctgctcactctccccaatttcccacgcacgcctagcgaggtcgggggttgaggtctggcggagatgggcggcgtgccctggaaccgggtggaacttgcggtgctcgtactctacgcgctgggcttctacctcgtcgtgatctgcaggtcgcttcgcctctcgcacgaatattccgggaggctctacggactacgcgtgggatcacttgcgggtcatctgaatgacctgtcggatgcgcaatggagaaacttccgcgggaacttgccaattctgactgttgtaatgggagcatttctgattctggtcaatacgttgagatattgctatggcctgaaaggtcgaggtactgctttgttgtggctcatactgtccttgagctatttatgttatcttcacggtgcttgtgttgtttttgttcttttaattgcactgattaattactcaatagtgaagctatttgctcattataagtattgcacaagcctcatttggagcttcaacttgtccgttcttattcttaaccgagtttatgaaggatattcattctcattgttcggtcaaaatatggcttttctagacaactatcggggtacattcaggtggcacatatgcttcaattttgttgtattacggatgattagctttggatgtgattactgctggacaattcattcttctcattttgacttcaagaaacatatgcaaagatctcaggtttgttattctggaaagacatgctactttgctttgcaggaaagagggctcagtgttgacagatatacatttcttatgtatttatgctacttgacatatgctccagtgtatattgctggacctattgttggatacaatgcatttgctgctcagttagaggtacctcagaaaaattattcatttgcacaaatatcttggtatggtctaaggtggattttgagtttccttcttatggaaggcatgacacactttttccactacaatgcctttgtagtaagccggctatggcagcagttatccccttttgaggttttcatcatcagttatggggtgttaaactttatgtggttgaaattctttcttatttggcgctacttccggttttggtcactggttggaggagtcgagactcctgaaaacatgccaaggtgtataaataattgccatgatctggagagtttctggaaaagctggcatgcttcttttaataaatggttggttaggtacttatacattcctcttggtggttctcaaagaaaactactgagtatctgggtgatattcacgtttgtagcagtgtggcatgatctagaatggaaacttatctcatgggcatggttgacttgcttatttttcattccagagatattggttaaatctctgtccagcaaatttcaggcaactagttcccttgggatgcttgttcaccgtgaatttaaagcaattgctggtgcagtgacaatcagctgtcttatggtggcaaatcttgttggttacgtcgtggggccatccgggattaaagttctgatatcaagaatggctgggaaggatgccctgccttccctcgccttcatatttactacgttctacgtgggcgttaagcttatgttccatatacggggatgctagcaagaaccaaggttgagggagcttaagatgatatctccagttttgactcgcaagcaagcasatggcttcgccgtggctgaagatgatagcttcgtcttttttgtttgcatattttgtttttgttttctaaacagtgtcgagagaacatcagctgctataagcgttgacatgtgtgtgattttgctcttagaatatataaaggtaaaggctgactcattagcgtggtgaacgttgaagttgcacactgctatacgtcctgttgtaaccatgatcgacgcgattcatttggctcaaatgcatatgcgaatttaatgtgttgccaaaaaaaaaaaaaaaa

SEQ ID NO: 998 - protein, 519 aa, Zea mays
  misc_feature: Ceres CLONE 232885
  misc_feature (196)..(475): Pfam Name: MBOAT Pfam Description: MBOAT family
MGGVPWNRVELAVLVLYALGFYLVVICRSLRLSHEYSGRLYGLRVGSLAGHLNDLSDAQWRNFRGNLPILTVVMGAFLILVNTLRYCYGLKGRGTALLWLILSLSYLCYLHGACVVFVLLIALINYSIVKLFAHYKYCTSLIWSFNLSVLILNRVYEGYSFSLFGQNMAFLDNYRGTFRWHICFNFVVLRMISFGCDYCWTIHSSHFDFKKHMQRSQVCYSGKTCYFALQERGLSVDRYTFLMYLCYLTYAPVYIAGPIVGYNAFAAQLEVPQKNYSFAQISWYGLRWILSFLLMEGMTHFFHYNAFVVSRLWQQLSPFEVFIISYGVLNFMWLKFFLIWRYFRFWSLVGGVETPENMPRCINNCHDLESFWKSWHASFNKWLVRYLYIPLGGSQRKLLSIWVIFTFVAVWHDLEWKLISWAWLTCLFFIPEILVKSLSSKFQATSSLGMLVHREFKAIAGAVTISCLMVANLVGYVVGPSGIKVLISRMAGKDALPSLAFIFTTFYVGVKLMFHIRGC

SEQ ID NO: 999 - DNA, 746 bp, Zea mays
  misc_feature: Ceres CLONE 233027
  misc_feature: Encodes the peptide sequence at SEQ ID NO. 1000
aatctccctcctcctctccgccctcgccccctcgccctcgcccgcctgtttaaacctgactgtctataacttaccgccggtccgcacccgcccaccgtccctgtccccttccccgtctaagcactcggatcctctgccgccgcgatgagctactacggccagcagcagccgcccgtcagcgcgccgccggcgmarggttatcccgggaaggacgcgtacccgccgccgggctacccgcccgcgggatatcctccgccggcgcagggctacccaccgcagggctacccgccgcagggctaccctccgcagcaggggtatccgcagcagggatacccgccgcagtactcgcagccgccgccgccgcccygccagcagcagagcagcgggccctctttcatggagggatgcttggccgccctttgttgctgctgcctattggaagcctgcttctgagatctaagctgcgcacaacttgttctagaaacaccacttcaatttgcacggttgatataactggggattggcttgttagcgaagaaccgaagataccatgggttcttatgcaaatcacagttctcctagttctttctatcgttctgattgtccgttgcgatgtttggtgtacctagtagtatcttaattatataccttacactgtttacctatccaatggaattcttggtctagctaacattgtgagattatgtcacttttctcgttctctgtagtgaaaaaaaaaaaaaaaa

SEQ ID NO: 1000 - protein, 102 aa, Zea mays
  misc_feature: Ceres CLONE 233027
  misc_feature (17)..(17): Xaa is any aa, unknown, or other
  misc_feature (75)..(75): Xaa is any aa, unknown, or other
MSYYGQQQPPVSAPPAXGYPGKDAYPPPGYPPAGYPPPAQGYPPQGYPPQGYPPQQGYPQQGYPPQYSQPPPPPXQQQSSGPSFMEGCLAALCCCCLLEACF

SEQ ID NO: 1001 - DNA, 277 bp, Zea mays
  misc_feature: Ceres CLONE 233081-F
  misc_feature: Encodes the peptide sequence at SEQ ID NO. 1002
aaggagatggagcgggcggcgcggttgaggagctcccacacctccacggccgacctactcgcgtggccgcagccccagggccccgtccagcaacgccgtcgccgccggccgstccggtcagccgtcggaggctatcaggaaggtggtgttcgggggtcaggtcaccgaggaggaggccgacagcctcaccaagaggaagccgtgctccgcgcccaagtggaaggagatgactgggagcggcattgttcgctgccgggagcaatggagacgctgggga

SEQ ID NO: 1002 - protein, 90 aa, Zea mays
  misc_feature: Ceres CLONE 233081-F
  misc_feature (36)..(36): Xaa is any aa, unknown, or other
MERAARLRSSHTSTADLLAWPQPQGPVQQRRRRRPXRSAVGGYQEGGVRGSGHRGGGRQPHQEEAVLRAQVEGDDWERHCSLPGAMETLG

SEQ ID NO: 1003 - DNA, 146 bp, Zea mays
  misc_feature: Ceres CLONE 233089-F
aaaaaaacagacacagcagcgagagaagagakkccactgtccaccccaccccaccagaaaaacgcattccgcagacgcgcggcgagggaktaggaggcgacggcgggtgccgaggcccgcagcacggggaagctaccggctagcgt

SEQ ID NO: 1004 - DNA, 84 bp, Zea mays
  misc_feature: Ceres CLONE 233102-F
  misc_feature: Encodes the peptide sequence at SEQ ID NO. 1005
  misc_feature (40)..(40): n is a, c, t, g, unknown, or other
  misc_feature (41)..(41): n is a, c, t, g, unknown, or other
gctagtcgctactcactgtaccgcaccgccgccgccgtcnngcacacggggcacaggacgcgcgcgatcccctcgagtccggat

SEQ ID NO: 1005 - protein, 28 aa, Zea mays
  misc_feature: Ceres CLONE 233102-F
  misc_feature (14)..(14): Xaa is any aa, unknown, or other
ASRYSLYRTAAAVXHTGHRTRAIPSSPD

SEQ ID NO: 1006 - DNA, 304 bp, Zea mays
  misc_feature: Ceres CLONE 233138-F
  misc_feature: Encodes the peptide sequence at SEQ ID NO. 1007
  misc_feature (68)..(68): n is a, c, t, g, unknown, or other
cactccctcccccccgcctccactaccccactcccaggcgccgcacaggtacgtcgccggcggmttgnacgacgcgcttcaagaagaaccgcaagawgcgcggccacgtgtccgccgggcacgccgcatcggcaagcacaggaagcatcccggartcgcggtaacscggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgat

SEQ ID NO: 1007 - protein, 43 aa, Zea mays
  misc_feature: Ceres CLONE 233138-F
MHHHRILFDKYHPGYFGKVGMRYFHKLRNKFYCPAVNIERLWS

SEQ ID NO: 1008 - DNA, 265 bp, Zea mays
  misc_feature: Ceres CLONE 233154-F
  misc_feature: Encodes the peptide sequence at SEQ ID NO. 1009
aacaacacggtccactaaccctagcgacacgctcggctcgtttgatccccgcgggagctctagttccgccaagcgtgcgtaccggcgtccgatccgggaccgaagatgacggagtccctggtgcggaacaagccggggatggccagcatcaaggagatgccggtggtgcaggacgggccgccgccgggcgtttttcgcgcccgttkcgcttcgcccgccggatccccacctcggggcccagcgccaccgccatcttcctcaccac

SEQ ID NO: 1009 - protein, 53 aa, Zea mays
  misc_feature: Ceres CLONE 233154-F
  misc_feature (34)..(34): Xaa is any aa, unknown, or other
MTESLVRNKPGMASIKEMPVVQDGPPPGVFRARXASPAGSPPRGPAPPPSSSP

SEQ ID NO: 1010 - DNA, 206 bp, Zea mays
  misc_feature: Ceres CLONE 233190-F
accagttttgccaccaaggtcacaccatccamcacggccatggagtccggcgcagacgaagtgtggcgttcgagtccccggcacatttccgcatctacaasagcgggaggatcgagcgcctgataccggcccccggtcacttcccgccggcctcgacgaggcacwcggtgtcacctcaaaggacgtcgtctggtacgccggcaccg

SEQ ID NO: 1011 - DNA, 471 bp, Zea mays
  misc_feature: Ceres CLONE 233212-F
  misc_feature: Encodes the peptide sequence at SEQ ID NO. 1012
akatcagatcacactcgtagaagaaggaaaaatatccccaaaccctagctcccgatctcgatggcgaaccctcgcgtcttcttcgacatgaccgtcggcggcgcccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaasaaccggctcccggtgtktctccatggccaacgccggggcccaacaccaacgggctcccagttcttcatctgcaccgtcgcgaccccttgggctcgacggcaagcacgtcgtcttccgg

SEQ ID NO: 1012 - protein, 116 aa, Zea mays
  misc_feature: Ceres CLONE 233212-F
  misc_feature (1)..(115): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (77)..(77): Xaa is any aa, unknown, or other
  misc_feature (83)..(83): Xaa is any aa, unknown, or other
MELYANEVPKTAENFRALCTGEKGVGKSGKPLHYKGSTFHRVIPEFMCQGGDFTRGNGTGGESIYGEKFPDEKFVRXNRLPVXLHGQRRGPTPTGSQFFICTVATPWARRQARRLP

SEQ ID NO: 1013 - DNA, 244 bp, Zea mays
  misc_feature: Ceres CLONE 233221-F
  misc_feature: Encodes the peptide sequence at SEQ ID NO. 1014
atttttttcgactttcgagcgcagaaacgagagggccggagcagccgcagtcccggcgatcccgccgccggtcgccctcatacttcctcgtcactgccttcgtttctctttccaacaatcaagatgagccgtggcgtagcgcgggtggtggtcaaagttctctgggttacctctttggaagcggtgagccccccaaaccagcagtggcaccagctgtaagtgctccacctgctgctgcagtctt

SEQ ID NO: 1014 - protein, 80 aa, Zea mays
  misc_feature: Ceres CLONE 233221-F
FFRLSSAETRGPEQPQSRRSRRRSPSYFLVTAFVSLSNNQDEPWRSAGGGQSSLGYLFGSGEPPKPAVAPAVSAPPAAAV

SEQ ID NO: 1015 - DNA, 229 bp, Zea mays
  misc_feature: Ceres CLONE 233224-F
  misc_feature (108)..(108): n is a, c, t, g, unknown, or other
  misc_feature (168)..(168): n is a, c, t, g, unknown, or other
atcacacactcgactctcctctctcgcatccgcagcctctcgagctctactccatccccctcgatctcgaagcgcmsagcagcagtcaggcggccatggacgcgagcncmscggagccggcssgaaggcgaagaagggcgcggccgggcgcaaggccggcggggcgangggaagaagtcggtgacgaggtccgtcaaggccgggctgcagtttcccgtcgggccgcatc

SEQ ID NO: 1016 - DNA, 132 bp, Zea mays
  misc_feature: Ceres CLONE 233232-F
atcacaattcacagcgctcaagttctcgcgcccacagccaaatttttctccactcaatcgcggcataagctgcactgcvcatggacgccagcggascggtagcaaggcgaagaagggggcggctggkcgcaa

SEQ ID NO: 1017 - DNA, 233 bp, Zea mays
  misc_feature: Ceres CLONE 233243-F
  misc_feature: Encodes the peptide sequence at SEQ ID NO. 1018
acctcaacacagcaccaccaaccaagcaacctcactcgctacaaacaagaaacaacaagcgaaagttttytctcgagagaggaggagaagaccaacaccggggggggattgcarcagcagcagcgacgaaggcgtcgtcgtggatggtggccattagcgtgggcgccgtggaagcgctcaaggaccagggaggcctctgccgctggaactacgcgctgcgtccgtctaccgga

SEQ ID NO: 1018 - protein, 77 aa, Zea mays
  misc_feature: Ceres CLONE 233243-F
  misc_feature (23)..(23): Xaa is any aa, unknown, or other
  misc_feature (38)..(38): Xaa is any aa, unknown, or other
LNTAPPTKQPHSLQTRNNKRKFXLERGGEDQHRGGIAXAAATKASSWMVAISVGAVEALKDQGGLCRWNYALRPSTG

SEQ ID NO: 1019 - DNA, 107 bp, Zea mays
  misc_feature: Ceres CLONE 233254-F
  misc_feature (54)..(54): n is a, c, t, g, unknown, or other
  misc_feature (96)..(96): n is a, c, t, g, unknown, or other
acacagcaagccagcagagcagdagcagccgcagccccagcccccacaagacgngcaacaatggcgctagaagcagccaccgccccccgcgcacdntcgccgcgtgc

SEQ ID NO: 1020 - DNA, 469 bp, Zea mays
  misc_feature: Ceres CLONE 233275-F
  misc_feature: Translation starting site: 248
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgggtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagt

SEQ ID NO: 1021 - DNA, 450 bp, Zea mays
  misc_feature: Ceres CLONE 233299-F
  misc_feature: Translation starting site: 79
  misc_feature (189)..(189): n is a, c, t, g, unknown, or other
  misc_feature (214)..(214): n is a, c, t, g, unknown, or other
  misc_feature (220)..(220): n is a, c, t, g, unknown, or other
  misc_feature (226)..(226): n is a, c, t, g, unknown, or other
  misc_feature (230)..(230): n is a, c, t, g, unknown, or other
  misc_feature (250)..(250): n is a, c, t, g, unknown, or other
akgtcgggttcgcttttttcctcggcttcttctctctcgtccatcaacccagggggaaggagcgggagggagcgagccatggtagtcagcacgttcaatggacccgggattkggatcgggttcggtgtcggctgcgggttcggcgtcgggtgggggttcggaggaatgcctcttaacatgttcggcttnggtatcggtgggggttgtggatttngtcttngactangatngggcttttgaaatgcttttngttgtcagtatcgatcttcaagagttcagttccaargcattkaatttcagaagaaggcggaaggagatkatgcaccaaaagttgtttcaccgggagcttgctcaaaagtctcgtccttatggctagtatgcctgctaccataaaaattcagagactgttttgtgtgatgaatcacagttttaattacatacctacgtgtt

SEQ ID NO: 1022 - DNA, 420 bp, Zea mays
  misc_feature: Ceres CLONE 233311-F
  misc_feature: Translation starting site: 181
  misc_feature: Pfam Name: Cupin_5 Pfam Description: Cupin superfamily (DUF985)
  misc_feature (219)..(219): n is a, c, t, g, unknown, or other
awacaaacacgggcgcacaagcggaactcgctgcactgcttggwatccaacgagccaatcattcaaatcctccccggaaccgcgttgagcagggcacggtcgaccggatctagggtgagggtccgtcgccgaagaaactcccaggcggtcacgaggaggcggcgggggagggcggaggagatggcctcggaggagatgacggcgacggaggtggctgcnctgctggatctgaagccgcacccggagcggcttctacaccgagaccttccgcgacggctccatcacgctcaccacctcccagctcccgccccactacaaggtaaaccgtgctgttagcaccgcaatttatttcctacttcccgcagagtgttttcccgttctccaccgcattccttgtgctgaaacctgggcacttctaca

SEQ ID NO: 1023 - DNA, 664 bp, Zea mays
  misc_feature: Ceres CLONE 233323
  misc_feature: Encodes the peptide sequence at SEQ ID NO. 1024
ctacgcaacctcccactgcattctcgaattccgattcccaatccagcaaaccctaccagccttttgcaaactcagagagggacccgatggcacccaaggcggagaagaagccggcggcgaagaagcccgcagaggaggagcccgcggccccggcggagaaggctcccgctgggaagaagccgaasgskragaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgttacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaagttgatctgagcagtgcaatatataattctggcataaaaaaaaaaaaaaaa

SEQ ID NO: 1024 - protein, 152 aa, Zea mays
  misc_feature: Ceres CLONE 233323
  misc_feature (59)..(129): Pfam Name: Histone Pfam Description: Core histone H2A/H2B/H3/H4
  misc_feature (33)..(33): Xaa is any aa, unknown, or other
  misc_feature (34)..(34): Xaa is any aa, unknown, or other
  misc_feature (35)..(35): Xaa is any aa, unknown, or other
MAPKAEKKPAAKKPAEEEPAAPAEKAPAGKKPXXXKRLPAGKSAGKEGGVDKKGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 1025 - DNA, 117 bp, Zea mays
  misc_feature: Ceres CLONE 233352-F
acacgcacaccgcgacccagtccagagccagtacgtgcgamrcacgcacgctgctggtccgcgtacsagaacgacggtcaggtcggccggtgcttttcagtttggaataatgacggc

SEQ ID NO: 1026 - DNA, 365 bp, Zea mays
  misc_feature: Ceres CLONE 233382-F
  misc_feature: Encodes the peptide sequence at SEQ ID NO. 1027
  misc_feature (77)..(77): n is a, c, t, g, unknown, or other
  misc_feature (78)..(78): n is a, c, t, g, unknown, or other
  misc_feature (233)..(233): n is a, c, t, g, unknown, or other
aacaacagccctacaacttactgcttgctctagctagctagctgctcccggcccatatccactacacawktaggctnncagcagcagcagcaatggcctcggtgacgagttcccggccgtggcctcgtcctgctgctcgccgccagcgccttcctggccagcgaggtggcggcgatgcggcggctgccgaaaccaactcctcctcctccatcgccaccaccgccgtcgcccancagcacgccgtgcctccgccaccgtccagctccggcggcaagtgcccaagaacgcgctgaaactgggcrtgtgcgcaacgtgctgggcctcgtcaaggtgtccatcggcaaggtgcccaccgactcgtgctg

SEQ ID NO: 1027 - protein, 63 aa, Zea mays
  misc_feature: Ceres CLONE 233382-F
  misc_feature (20)..(20): Xaa is any aa, unknown, or other
  misc_feature (43)..(43): Xaa is any aa, unknown, or other
MRRLPKPTPPPPSPPPPSPXSTPCLRHRPAPAASAQERAETGXVRNVLGLVKVSIGKVPTDSC

SEQ ID NO: 1028 - DNA, 400 bp, Zea mays
  misc_feature: Ceres CLONE 233386-F
  misc_feature: Encodes the peptide sequence at SEQ ID NO. 1029
  misc_feature (2)..(2): n is a, c, t, g, unknown, or other
anacagacccctttcccctccctcctcgaccactccgacgcccacagcgcctccggaggctccacctctccaccggcggcasgaggggcgaggggggctaatactgtaggcggaggaggaaccgagccgatggggcagcagtcgctgatctacgcgttcgtggcgcggggcaccgtgggtctggccgagtacaccgagttcaccggcaacttcaccaccatcgccgcccagtgcctgcagaagctccccgccagcaacaacaagttcacctacaactgcgacggccacaccttcaactacctcgtcgaggacggattcacgtactgtgtagttgctgttgaatccagtcgggcgacaaatccccatagctttcctggacagagtttaatgaagactttac

SEQ ID NO: 1029 - protein, 90 aa, Zea mays
  misc_feature: Ceres CLONE 233386-F
MGQQSLIYAFVARGTVGLAEYTEFTGNFTTIAAQCLQKLPASNNKFTYNCDGHTFNYLVEDGFTYCVVAVESSRATNPHSFPGQSLMKTL

SEQ ID NO: 1030 - DNA, 140 bp, Zea mays
  misc_feature: Ceres CLONE 233415-F
  misc_feature: Encodes the peptide sequence at SEQ ID NO. 1031
  misc_feature (111)..(111): n is a, c, t, g, unknown, or other
agaaaaacgcattccgcagacgcgcggcgagggagtaggaggcgacggcgggtgcsaggcccgcagcacggggaagctaccggctagcgtmcgggacgggctcgcgctttnctgtcgctccatgtcggtcgccggcgaga

SEQ ID NO: 1031 - protein, 46 aa, Zea mays
  misc_feature: Ceres CLONE 233415-F
  misc_feature (19)..(19): Xaa is any aa, unknown, or other
  misc_feature (37)..(37): Xaa is any aa, unknown, or other
EKRIPQTRGEGVGGDGGCXARSTGKLPASVRDGLALXCRSMSVAGE

SEQ ID NO: 1032 - DNA, 313 bp, Zea mays
  misc_feature: Ceres CLONE 233420-F
  misc_feature: Translation starting site: 171
  misc_feature: SWISSPROT Homolog: EC 3.1.3.16 Phosphoprotein phosphatase
  misc_feature (61)..(61): n is a, c, t, g, unknown, or other
  misc_feature (99)..(99): n is a, c, t, g, unknown, or other
  misc_feature (193)..(193): n is a, c, t, g, unknown, or other
  misc_feature (226)..(226): n is a, c, t, g, unknown, or other
  misc_feature (236)..(236): n is a, c, t, g, unknown, or other
acccgctgtcagtctcactccccgcgcgcgsctctctctttcctcgccttcgccgccggvncgagcttgagctsagctggttcctcgtatagaagacgncggccgcggtwtggagcccatgaacgtagacaacggcggcasggtgccttgacgcgcagatcgaacagctgatgmagtgccgcccgctcgccgngcaagaggttaaggcactgtgcgagaaggccanggagatattnatggaggaaagmaacgttcagcctgtcaagagtccagtgacaatatgtggtgatatacatggacaattccacgatct

SEQ ID NO: 1033 - DNA, 99 bp, Zea mays
  misc_feature: Ceres CLONE 233440-F
  misc_feature: Encodes the peptide sequence at SEQ ID NO. 1034
aaccaaaatcgcacgctgagctcccaaagatccccaaaccctacacccgcccgccgggcactcggggaccgtcgaatcgagcaggttgacggaggagag

SEQ ID NO: 1034 - protein, 33 aa, Zea mays
  misc_feature: Ceres CLONE 233440-F
NQNRTLSSQRSPNPTPARRALGDRRIEQVDGGE

SEQ ID NO: 1035 - DNA, 439 bp, Zea mays
  misc_feature: Ceres CLONE 233519-F
  misc_feature: Encodes the peptide sequence at SEQ ID NO. 1036
gagtacgagcggctactcccggcggcggcggcgatgagcgcggtgaacatcaccaacgtggcggtgctggataaccccaccgccttcctcaatcccttccagtttgagatctcctacgagtgcctcgtgcccctcgacgacgatctggagtggaagcttatatatgttggatcagctgaagatgaaaactacgatcaacagcttgagagcgtgcttgttggccctgtcaatgttgggacctaccgttttgtccttcaggctgacccaccggatccctcaaagatccgtgaggaagacataattggtgtgactgtgctgctattgacatgctcttacatgggccaggagttcatgagagtaggctactacgtgaacaacgattatgatgatgaacaattgagagaagagcctccagcaaaggtgctaattgaccgggtgc

SEQ ID NO: 1036 - protein, 135 aa, Zea mays
  misc_feature: Ceres CLONE 233519-F
  misc_feature (1)..(135): Pfam Name: Anti-silence Pfam Description: Anti-silencing protein, ASF1-like
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRV

SEQ ID NO: 1037 - DNA, 492 bp, Zea mays
  misc_feature: Ceres CLONE 233553-F
  misc_feature: Encodes the peptide sequence at SEQ ID NO. 1038
  misc_feature (24)..(24): n is a, c, t, g, unknown, or other
aaggagaccgtgcctacgcttttnttctccctccattcattcacacaccacacctcccgaactccgaactacaagtttcgcttctcgtcgcgacgactgggcgagaccgcgccgccgccgccgctvwtgagttctttagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctacaacgagcttcgtgttgccccagaggagcaccctgtgttgctcactgaggctcctttgaacccaaaggccaac

SEQ ID NO: 1038 - protein, 117 aa, Zea mays
  misc_feature: Ceres CLONE 233553-F
  misc_feature (4)..(117): Pfam Name: Actin Pfam Description: Actin
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKAN

SEQ ID NO: 1039 - DNA, 482 bp, Zea mays
  misc_feature: Ceres CLONE 233579-F
  misc_feature: Encodes the peptide sequence at SEQ ID NO. 1040
  misc_feature (69)..(69): n is a, c, t, g, unknown, or other
  misc_feature (70)..(70): n is a, c, t, g, unknown, or other
  misc_feature (400)..(400): n is a, c, t, g, unknown, or other
  misc_feature (403)..(403): n is a, c, t, g, unknown, or other
aaagtggtgttcacgtataaaccaatcagctcccgtcccagtccccgtcccacaccayacacagagaannagaaagagccacgcattgcacttggcttgcacaagccggagagccccaaacgcggcggcggacggaatgcggctgcgcctgcctcagtgaacattctgctgtgatggcgaaggagtactacactacgagcagccttgtggttgggtacgcgctgtgctcgagcctgctctcgatcatcaacaagtacgccgtgacaaagttcggtttcccaggcctcctgaccgctctacagtactcgacatccgctgctggtgtctggatcctcggaaagctaggcttcctcacccatgaccccttcaacctggagaccgcaaagaagttcgcgccggnggntctcgtcttctacctagccatattcaccaacacgaacctcctctgccacgccaacgtcgacaccttcatagtcttcaga

SEQ ID NO: 1040 - protein, 103 aa, Zea mays
  misc_feature: Ceres CLONE 233579-F
  misc_feature (76)..(76): Xaa is any aa, unknown, or other
  misc_feature (77)..(77): Xaa is any aa, unknown, or other
MAKEYYTTSSLVVGYALCSSLLSIINKYAVTKFGFPGLLTALQYSTSAAGVWILGKLGFLTHDPFNLETAKKFAPXXLVFYLAIFTNTNLLCHANVDTFIVFR

SEQ ID NO: 1041 - DNA, 294 bp, Zea mays
  misc_feature: Ceres CLONE 233655-F
attttttcgactttcgagcgcagaaacgagagggccggagcagccgcagtcccggcgatcccgccgccggtcgccctcatacttcctcgtcactgccttcgtttctctttccaacaatcaagatgagccgtggcgtacgcgggtggtggtcaaagttctctgggttacctctttagaagcggtgagccccccaaaccagcagtggcaccagctgtaagtgctccacctgctgctgcagtgctccacctstgagaaaccacctgctgcaaasctgatggcaccagtcagattgct

SEQ ID NO: 1042 - DNA, 322 bp, Zea mays
  misc_feature: Ceres CLONE 233773-F
  misc_feature: Translation starting site: 73
  misc_feature (191)..(191): n is a, c, t, g, unknown, or other
catccaattcacaggctcaccacaccaaccaacaagcaaaaattccccaatcctctcgtctccgcggcgaagatgtcggggcgcggcaagggcggcaagggcctgggcaagggcggcgcgavtcatccggaaggtctgcgcgacaacatccaggggatcacgaagccggcgatccggagactggcgcggcngggcggcgtgaagsatctcggggctmatctacgaggagacccgcggcgtgctcaagatcttcctggagaacgtcatccgcgacgccgtcacctacaccgagcacgcgcgccgtaagaccgtcaccgccatg

SEQ ID NO: 1043 - DNA, 187 bp, Zea mays
  misc_feature: Ceres CLONE 233789-F
  misc_feature: Encodes the peptide sequence at SEQ ID NO. 1044
  misc_feature (133)..(133): n is a, c, t, g, unknown, or other
atacatttcgactctcaactcccaaggtcccttttttttctcgatctggaagcgccgcagtagcagccattgacgtgagcggasaggcgggaaggcgaagaagggcgcggccgggcgcaaggccggcgggcgncgaagaagtcggtgtcgcggtcctccagggccgggctgcagttccmacgtcagc

SEQ ID NO: 1044 - protein, 61 aa, Zea mays
  misc_feature: Ceres CLONE 233789-F
  misc_feature (28)..(28): Xaa is any aa, unknown, or other
  misc_feature (44)..(44): Xaa is any aa, unknown, or other
TFRLSTPKVPFFSRSGSAAVAAIDVSGXAGRRRRARPGARPAGXEEVGVAVLQGRAAVPTS

SEQ ID NO: 1045 - DNA, 351 bp, Zea mays
  misc_feature: Ceres CLONE 233884-F
  misc_feature: Encodes the peptide sequence at SEQ ID NO. 1046
  misc_feature (134)..(134): n is a, c, t, g, unknown, or other
  misc_feature (242)..(242): n is a, c, t, g, unknown, or other
  misc_feature (344)..(344): n is a, c, t, g, unknown, or other
catttcgactttcgagcgcagaaacgagagggccggagcagccgcagtcccggcgatcccgccgccggtcgccctcatacttcctcgtcactgccttcgtttctytttccaacaatcaagatgagccgtggcgntasgcgggtggtggtcaaagttctctgggttacctctttggaagtcggtgagccccccaaaccagcagtggcaccagctgtaagtgctccacctgctgctgcagtgcntccacctstgawgaaaccacctgctgcaaasctgatggcaccagtcagattgctgctggggttacagccaaaccaataactaccacagggccgacggtcagnacaccgg

SEQ ID NO: 1046 - protein, 66 aa, Zea mays
  misc_feature: Ceres CLONE 233884-F
  misc_feature (5)..(5): Xaa is any aa, unknown, or other
  misc_feature (6)..(6): Xaa is any aa, unknown, or other
  misc_feature (41)..(41): Xaa is any aa, unknown, or other
  misc_feature (44)..(44): Xaa is any aa, unknown, or other
  misc_feature (45)..(45): Xaa is any aa, unknown, or other
  misc_feature (51)..(51): Xaa is any aa, unknown, or other
MSRGXXRVVVKVLWVTSLEVGEPPKPAVAPAVSAPPAAAVXPPXXKPPAAXLMAPVRLLLGLQPNQ

SEQ ID NO: 1047 - DNA, 291 bp, Zea mays
  misc_feature: Ceres CLONE 233905-F
  misc_feature: Translation starting site: 26
  misc_feature: SWISSPROT Homolog: EC 2.7.4.3 Adenylate kinase
  misc_feature (135)..(135): n is a, c, t, g, unknown, or other
  misc_feature (199)..(199): n is a, c, t, g, unknown, or other
  misc_feature (233)..(233): n is a, c, t, g, unknown, or other
  misc_feature (235)..(235): n is a, c, t, g, unknown, or other
  misc_feature (246)..(246): n is a, c, t, g, unknown, or other
aaacctagaaccctcttcccccgcgatggccgcaggagcggcggcgctcgcggcgscgcgtccgaacgtgctagtgacggggacgccggggacggggaagacgaccacgtgctcgctccttgccgacgccgcacntccgccacgtcaacatcggcgacctagtccgcgagaagagccttcacgacggctgggacgccgncctcgagtgccatgtcatcaacgaggacctggtntncgacgagcttnaggacatgatggaagaaggtggtatactagtagattaccacggat

SEQ ID NO: 1048 - DNA, 374 bp, Zea mays
  misc_feature: Ceres CLONE 233913-F
  misc_feature (328)..(328): n is a, c, t, g, unknown, or other
acaagcaccagaccaattaactagcttcttctagctctagctaggctcgtctgctgcaagaaggtaacagtaacagcaggcatggaggggaaggagraggacgtccgcctgggcgccaacaagttctcggagcgccacccatcggcacggcagcgcagggaacggacgacaaggamtacaaggagcccccgccggcgccgmtcttcgagcccggggagctcaagtcctggtccttctaccgcgccggcatcgcsagtttcgtcgccaccttcctcttcctctacatctccatcctcaccgtcatgggcgtctccaagtccacctccangtgcgccaccgtcggcatccagggcatcgctgggtccttcggcggc

SEQ ID NO: 1049 - DNA, 378 bp, Zea mays
  misc_feature: Ceres CLONE 233918-F
  misc_feature: Encodes the peptide sequence at SEQ ID NO. 1050
  misc_feature (116)..(116): n is a, c, t, g, unknown, or other
  misc_feature (244)..(244): n is a, c, t, g, unknown, or other
accgacccaaaccctagcgcgcacccacctcccttcccctttcccggcgtgcggtccggcgttggagatgcgggggctgctcgcggacggcgggatggcgctggcgatggcgcggnagttaacgagtcgtcgggcggtgctgcgttgtcgcagggtctgttatggtgggcgtcggartgccacggggtgttgtacagccttgcgtgatgctgccgtcgctggccttcgtgggattcctagcatngcaggcgcggcggacttccgtagctcagctacggccgctctcacgtcgtcgtcgtcgcgtactacgcctcctctgggtcgtcgccgtactcaacctcctctggtgcttcctgcaggcatggcaatgtatgcctg

SEQ ID NO: 1050 - protein, 72 aa, Zea mays
  misc_feature: Ceres CLONE 233918-F
  misc_feature (6)..(6): Xaa is any aa, unknown, or other
  misc_feature (28)..(28): Xaa is any aa, unknown, or other
MVGVGXPRGVVQPCVMLPSLAFVGFLAXQARRTSVAQLRPLSRRRRRVLRLLWVVAVLNLLWCFLQAWQCMP

SEQ ID NO: 1051 - DNA, 353 bp, Zea mays
  misc_feature: Ceres CLONE 233920-F
  misc_feature: Encodes the peptide sequence at SEQ ID NO. 1052
  misc_feature (63)..(63): n is a, c, t, g, unknown, or other
aaagaaaaacggtgagctagaaacttccaaatcgaacggcacacaaaaatcacaacccggaanggaccagcagcgcaaaggtgagcgagctttccttcggaactctcgtgctcacctcatccgtccgacaaatccacacgaatcctctgattcagagcagggtgttggcattgatcagacgcctgcyatggcggatcagttcgtggattcggcgaacaatgtgatcattgaggaggtgacaagggcctgaacccaggaatggtggttctgcttgtggttgcaagcttcctgctgctcttctttgtggggaactatgcgctgtatgtgtatgcgcagaaracgctcccgccaaa

SEQ ID NO: 1052 - protein, 31 aa, Zea mays
  misc_feature: Ceres CLONE 233920-F
MVVLLVVASFLLLFFVGNYALYVYAQKTLPP

SEQ ID NO: 1053 - DNA, 143 bp, Zea mays
  misc_feature: Ceres CLONE 233924-F
accaacctcagcacaccaaggagagtacgtggaggagcagccatggcttcatcggtggccgccgcggsagcacattcctgggcaccgcctggcgacccggcgccacagaacgggcgcatcgtggcccggttcgggttcgggtt

SEQ ID NO: 1054 - DNA, 340 bp, Zea mays
  misc_feature: Ceres CLONE 233983-F
  misc_feature: Translation starting site: 91
  misc_feature (208)..(208): n is a, c, t, g, unknown, or other
tcacacactaatcaacaagcaggaccagctagctagctcctctcactgctatcacccgcccagccatctcgctgaaagagaaaagcgcgcatgaagactaatagctcgggmattgmagtcgtcctactggtggccatgctggcagtmcattccgcgttsracgacatctcgwgctacgacgtgctcaacgaactgtcgccgtkcctgnmcttcctgcagggcaaggcagccaaacccagcgagagcaacaaccagtgctgcgacggcgtgagggccctgtacgcggcggcggaacaccaggcccgacaggcaggccacgtgccggtgcctcaaggcggcc

SEQ ID NO: 1055 - DNA, 238 bp, Zea mays
  misc_feature: Ceres CLONE 233988-F
  misc_feature: Encodes the peptide sequence at SEQ ID NO. 1056
gagtttcctattttcgtctcctccccacagcagcccgkcgaaaaccctagtaagcaaaccaccggagcagcggcgcttgcsrggcggacatgcgacgacgattacaacgaaattgacatggggtatgaggatgagcccccagaaccggagattgaggaaggagctgaagaagagcctgagaacaacgaagatgcccctgatgacgtcataggtggtgagggtgaagataaggaacagg

SEQ ID NO: 1056 - protein, 79 aa, Zea mays
  misc_feature: Ceres CLONE 233988-F
  misc_feature (13)..(13): Xaa is any aa, unknown, or other
  misc_feature (28)..(28): Xaa is any aa, unknown, or other
EFPIFVSSPQQPXENPSKQTTGAAALAXRTCDDDYNEIDMGYEDEPPEPEIEEGAEEEPENNEDAPDDVIGGEGEDKEQ

SEQ ID NO: 1057 - DNA, 490 bp, Zea mays
  misc_feature: Ceres CLONE 234002-F
  misc_feature: Translation starting site: 96
  misc_feature: Pfam Name: ubiquitin Pfam Description: Ubiquitin family
accgcacgccacgccgccgccgtcctattcctcggagrggagaagccgccgccgcagcaatcacagcagcccggagaaagcccaggtccgacaagatgcagatcttcgtgaagacgctagacagggaagaccatcaccctcgaggtcgagagcagcgacaccatcgacaatgtcaaggcmaagatccaggacaaggaagggatcccgccggaccagcagcggctgatctttgccgggaagcagctggaggatggccgcacccttgcgactataacatccaaaaggagtctacgcttcacctcgtgcttaggctccgcggtggcatcattgagccctcgctgcaggscttcgctcgcaagtacaaccaggacaagatgatctgccgcaaatgctatgcacgactgcaccctagggctgtcaactgccgcaagaagaagtgtggtcacagcaaccagctgagggccaagsagagatcaagaacctgaggtgc

SEQ ID NO: 1058 - DNA, 441 bp, Zea mays
  misc_feature: Ceres CLONE 234009-F
  misc_feature: Translation starting site: 127
  misc_feature: Pfam Name: Dirigent Pfam Description: Dirigent-like protein
  misc_feature (47)..(47): n is a, c, t, g, unknown, or other
  misc_feature (48)..(48): n is a, c, t, g, unknown, or other
  misc_feature (297)..(297): n is a, c, t, g, unknown, or other
attccacactgcactactgcagctaacaagcgcatcacaatggccanntttgcaaagccgcagcatctgctsttgccgccaccgtggccgtcgttctcctgctcgtcgccgcggcggacgccagccatgtcgcccggtgcacctgcggttgtacatgcacgacatcatcggcgggccggggcagacggcatccacctcatccggaacgtcgggccgccgcacacgtcgctgaagggcgcctacttcggcgacacggtggccatcgacgacctcgtgaccgagggacccgccgccghntccagggccgtcggcgggcgctgggcacctacatgctgtcctcccagcgcgasaggtgctcgatggtcgccgtcaccgtcgtgctcgccgacgggccctacaacggcagcaccttcgccgtggmcggamgcgtcaagatcttcg

SEQ ID NO: 1059 - DNA, 165 bp, Zea mays
  misc_feature: Ceres CLONE 234014-F
  misc_feature (66)..(66): n is a, c, t, g, unknown, or other
  misc_feature (67)..(67): n is a, c, t, g, unknown, or other
  misc_feature (106)..(106): n is a, c, t, g, unknown, or other
aacagcgaacacatctgcttcgcatttcttcccatcccccttcgcaacccaaactccawctcgctnncatcgatggcgcccaaggccgagaagaagcccgcggcrnagaagccggcggaggaggagcccgcggctgagaaggcgcccgccgtgaagaagccgaag

SEQ ID NO: 1060 - DNA, 133 bp, Zea mays
  misc_feature: Ceres CLONE 234022-F
  misc_feature (86)..(86): n is a, c, t, g, unknown, or other
  misc_feature (87)..(87): n is a, c, t, g, unknown, or other
agcagccctgcccagccgcgcgactagaggccgaccagaccgaccgacagagctcgctcgctcgcaactccgcaatggcgtccatnntcgtgcaagcggtggtgatcctcctggacgtgatcgccttcggcct

SEQ ID NO: 1061 - DNA, 146 bp, Zea mays
  misc_feature: Ceres CLONE 234055-F
  misc_feature: Encodes the peptide sequence at SEQ ID NO. 1062
  misc_feature (58)..(58): n is a, c, t, g, unknown, or other
  misc_feature (59)..(59): n is a, c, t, g, unknown, or other
  misc_feature (97)..(97): n is a, c, t, g, unknown, or other
  misc_feature (98)..(98): n is a, c, t, g, unknown, or other
aaaaacattttatcttctctatcgctactccaagagtacccaatcaccgagccatggnnatctcagtcactgccgtggccgccttgcccgctttctnngctcaaagaagcctcccgcagccgtcccgccagagggtcgtagcgttc

SEQ ID NO: 1062 - protein, 48 aa, Zea mays
  misc_feature: Ceres CLONE 234055-F
  misc_feature (20)..(20): Xaa is any aa, unknown, or other
  misc_feature (33)..(33): Xaa is any aa, unknown, or other
KTFYLLYRYSKSTQSPSHGXLSHCRGRLARFLXSKKPPAAVPPEGRSV

SEQ ID NO: 1063 - DNA, 164 bp, Zea mays
  misc_feature: Ceres CLONE 234061-F
  misc_feature (92)..(92): n is a, c, t, g, unknown, or other
  misc_feature (93)..(93): n is a, c, t, g, unknown, or other
ccatcacccaaaacacawgtagggttaggaaggcggcggccagcggcgagagcgcgagaggaggaggggtcggccatgacggggaaggcgannagaaagcacacagcgaaggagatcgccgcgaagatcgacgcggcgacgacgaaccggggcggcggcaaggc

SEQ ID NO: 1064 - DNA, 401 bp, Zea mays
  misc_feature: Ceres CLONE 234067-F
  misc_feature: Encodes the peptide sequence at SEQ ID NO. 1065
  misc_feature (113)..(113): n is a, c, t, g, unknown, or other
  misc_feature (114)..(114): n is a, c, t, g, unknown, or other
atcagaaaccaagtaccagcaccaccgaccaccaagccaccaatcatggccgccactttgcatctccacctcctcgtgacccttcttttcgtcgccactctcaccgtggcctnngttgccgacgactcgccgccggacccacaccaccggcaccgcscagccgaccgcgtaccagatgctggagcggtacaacttcacgcagggcatcctscgcaggcgtgacggggtacgtcctcaacgccgatggctccttcgaggtgtacctcccggcggactgcagcttccgcgccggcagcatgcgggtccagtacagcagccgcgtcgccggccacattcagccgctgtccatcacatccctggaggagtgaaggtgaaggtgctgtttctcgtgggtcggcgtc

SEQ ID NO: 1065 - protein, 121 aa, Zea mays
  misc_feature: Ceres CLONE 234067-F
  misc_feature (38)..(38): Xaa is any aa, unknown, or other
  misc_feature (52)..(52): Xaa is any aa, unknown, or other
  misc_feature (70)..(70): Xaa is any aa, unknown, or other
QKPSTSTTDHQATNHGRHFASPPPRDPSFRRHSHRGLXCRRLAAGPTPPAPXSRPRTRCWSGTTSRRASXAGVTGYVLNADGSFEVYLPADCSFRAGSMRVQYSSRVAGHIQPLSITSLEE

SEQ ID NO: 1066 - DNA, 380 bp, Zea mays
  misc_feature: Ceres CLONE 234083-F
  misc_feature: Encodes the peptide sequence at SEQ ID NO. 1067
attttttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgc

SEQ ID NO: 1067 - protein, 103 aa, Zea mays
  misc_feature: Ceres CLONE 234083-F
  misc_feature (62)..(90): Pfam Name: zf-RanBP Pfam Description: Zn-finger in Ran binding protein and others
  misc_feature (4)..(33): Pfam Name: zf-RanBP Pfam Description: Zn-finger in Ran binding protein and others
MNRKPGDWDCRACQHLNFSRRDACQRCSEPRGVGDRSGGGGDLGGRGGSSFGGGFGAGSDVRPGDWYCSCGAHNFASRSNCFRCSAYKEEAAGAFDSDMSRSR

SEQ ID NO: 1068 - DNA, 152 bp, Zea mays
  misc_feature: Ceres CLONE 234101-F
  misc_feature (107)..(107): n is a, c, t, g, unknown, or other
aaccagcaacccgcatccacacctcgcagccgtattcctgtctcgaatcctctctcgccgctccgatggmccgcacgawgcaaacagcaaggaagtcgaccggcggnaaggccccccggaaagcagctggcccactaaggctgcgcgcaagt

SEQ ID NO: 1069 - DNA, 159 bp, Zea mays
  misc_feature: Ceres CLONE 234124-F
  misc_feature: Encodes the peptide sequence at SEQ ID NO. 1070
  misc_feature (117)..(117): n is a, c, t, g, unknown, or other
  misc_feature (119)..(119): n is a, c, t, g, unknown, or other
atcgcagaaattctccgcaacttcacagcgtatcatcgttttccatcgctcctactcctatcatccagaaaatctgagcggtattgatggcgcccaaggcggagaagaagccggcgnanagaaggtggcggaggaggagccctcggagaaggcggctcc

SEQ ID NO: 1070 - protein, 52 aa, Zea mays
  misc_feature: Ceres CLONE 234124-F
  misc_feature (39)..(39): Xaa is any aa, unknown, or other
  misc_feature (40)..(40): Xaa is any aa, unknown, or other
SQKFSATSQRIIVFHRSYSYHPENLSGIDGAQGGEEAGXXKVAEEEPSEKAA

SEQ ID NO: 1071 - DNA, 207 bp, Zea mays
  misc_feature: Ceres CLONE 234156-F
  misc_feature: Encodes the peptide sequence at SEQ ID NO. 1072
atcttgctctgaacgcattcctcccatctcccaagacctcctcagacccgagaagcgcmkgcgggccatggacgccaccggcactggagctggagggaaggcgaagaagggagcggccggwcgcaaggccgcrggccgagggaagaagtcggtracgaggtccgtgaaggccgggctccagtwamccmgtcggccgcatcgggcgct

SEQ ID NO: 1072 - protein, 46 aa, Zea mays
  misc_feature: Ceres CLONE 234156-F
  misc_feature (39)..(39): Xaa is any aa, unknown, or other
  misc_feature (40)..(40): Xaa is any aa, unknown, or other
  misc_feature (41)..(41): Xaa is any aa, unknown, or other
MDATGTGAGGKAKKGAAGRKAAGRGKKSVTRSVKAGLQXXXRPHRA

SEQ ID NO: 1073 - DNA, 325 bp, Zea mays
  misc_feature: Ceres CLONE 234162-F
  misc_feature: Pfam Name: S10_plectin Pfam Description: Plectin/S10 domain
  misc_feature (273)..(273): n is a, c, t, g, unknown, or other
attcgctcctcccgaccgccgccgtcgccgcctcctctccccagcacccggagctcgaccgaacgccgctcaccatgatcatccccaagaagaaccgcaatgagatctygcaagtacctcttcaaggagggcgtgctgtatgccaagaaggactcacaacctcggcgaasacccgcagatcgatgtagcccaacctccaggtgatcaagctcatgcagagctttaagtccaaggagtatgttcaggsagaccttctcmtggcagtactactantggtatctcaccaacgatggcaytgagcacctacgcaactacctgaacctcc

SEQ ID NO: 1074 - DNA, 281 bp, Zea mays
  misc_feature: Ceres CLONE 234173-F
  misc_feature: Encodes the peptide sequence at SEQ ID NO. 1075
  misc_feature (181)..(181): n is a, c, t, g, unknown, or other
  misc_feature (224)..(224): n is a, c, t, g, unknown, or other
  misc_feature (275)..(275): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggccaaggccggcgggcgacgaagaagtcggtgtcgcggtcctccagggccgggctgcagttccccntcagccgcgtcgggcgtacctcaaamagggccggtacgcgcangttagggcacgggtgccccgtctacctcgccgccgtcctggagtacctcgnggccgr

SEQ ID NO: 1075 - protein, 70 aa, Zea mays
  misc_feature: Ceres CLONE 234173-F
  misc_feature (38)..(38): Xaa is any aa, unknown, or other
  misc_feature (46)..(46): Xaa is any aa, unknown, or other
  misc_feature (52)..(52): Xaa is any aa, unknown, or other
  misc_feature (69)..(69): Xaa is any aa, unknown, or other
MDVSGQAVRRRRARRGQGRRATKKSVSRSSRAGLQFPXSRVGRTSXRAGTRXLGHGCPVYLAAVLEYLXA

SEQ ID NO: 1076 - DNA, 187 bp, Zea mays
  misc_feature: Ceres CLONE 234191-F
  misc_feature: Encodes the peptide sequence at SEQ ID NO. 1077
  misc_feature (61)..(61): n is a, c, t, g, unknown, or other
atcacacactaatcaacaagcaggaccagctagctagctcctctcactgctatcacccgknagccatctcgctgaaagagaaaagcgcmscatgaagactactagctcgggcattgcagtcgtcctactggtggccatgctggcagtccattccgcgttggccgacatctcgtgctccgacgtgctc

SEQ ID NO: 1077 - protein, 32 aa, Zea mays
  misc_feature: Ceres CLONE 234191-F
MKTTSSGIAVVLLVAMLAVHSALADISCSDVL

SEQ ID NO: 1078 - DNA, 193 bp, Zea mays
  misc_feature: Ceres CLONE 234192-F
  misc_feature (165)..(165): n is a, c, t, g, unknown, or other
tcgaaaacccaccgcacccctgtccachgttggcttggtgacttcctccgctcggctcccctccgctcccgaacggtcgatctttgcatggcagcagcagctggctccaaggggcgggcgatcgctgaaasttcgtcagccgcgtcctcgccggcaaggcgactngccgaggagggmcgwgcacgcctcggst

SEQ ID NO: 1079 - DNA, 417 bp, Zea mays
  misc_feature: Ceres CLONE 234195-F
  misc_feature: Encodes the peptide sequence at SEQ ID NO. 1080
  misc_feature (252)..(252): n is a, c, t, g, unknown, or other
  misc_feature (366)..(366): n is a, c, t, g, unknown, or other
  misc_feature (394)..(394): n is a, c, t, g, unknown, or other
acgcggaaaccctagcagctcaacaccctcgakgtacctccattcgcagtcggccgtgtcctcggagccgcgggagatggcggatcaggagacagtagctgtggttgaggcacctamcccggttctaggggaaccgatggacctgatgactgccctgcagctcgtcatgaagaagtcaggtgctcacgatggccttgtgaagggtcttcgtgaggctgccaaagccatcgagaagcatgccgctcagctctncgtgcttgccgaggactgcgaccagcctggttatktcaagctggtgaaggctctctgcgctgagcacaatgtccacctggttactgtgcctagcgccaaaactctttgagagtnggctgggctttgcaagatcgactctganggcgaggcgagggaggttgtagg

SEQ ID NO: 1080 - protein, 94 aa, Zea mays
  misc_feature: Ceres CLONE 234195-F
  misc_feature (25)..(95): Pfam Name: Ribosomal_L7Ae Pfam Description: Ribosomal protein L7Ae/L30e/S12e/Gadd45 family
  misc_feature (14)..(14): Xaa is any aa, unknown, or other
  misc_feature (59)..(59): Xaa is any aa, unknown, or other
  misc_feature (71)..(71): Xaa is any aa, unknown, or other
MADQETVAVVEAPXPVLGEPMDLMTALQLVMKKSGAHDGLVKGLREAAKAIEKHAAQLXVLAEDCDQPGYXKLVKALCAEHNVHLVTVPSAKTL

SEQ ID NO: 1081 - DNA, 410 bp, Zea mays
  misc_feature: Ceres CLONE 234201-F
  misc_feature: Translation starting site: 121
  misc_feature (49)..(49): n is a, c, t, g, unknown, or other
  misc_feature (50)..(50): n is a, c, t, g, unknown, or other
  misc_feature (97)..(97): n is a, c, t, g, unknown, or other
attccacccgcttcccccagccgcacgaaaccctaacgccgccgccgcnncacaggtaagccgccgtcatggtctccggttccggcgtatgcgcgantcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccdhtccaagatcctgtggcgcaccatccgcgggatgattccgcacaagaccaagaggggggaggcggctctggcgaggctcaagacgtacgagggcgtcccgcggc

SEQ ID NO: 1082 - DNA, 383 bp, Zea mays
  misc_feature: Ceres CLONE 234210-F
  misc_feature (276)..(276): n is a, c, t, g, unknown, or other
  misc_feature (301)..(301): n is a, c, t, g, unknown, or other
  misc_feature (315)..(315): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcabktaggcacgggtgcccccgtctacctcgccgccgtcctggagtacctcgnggccgaggtgctcgagctcgccggnaacgccgcaagggncaacaagaagacgcgcatcattccgggccacgtgmtcctcgccatccgcaacgacgaggagctcggca

SEQ ID NO: 1083 - DNA, 481 bp, Zea mays
  misc_feature: Ceres CLONE 234228-F
  misc_feature: Encodes the peptide sequence at SEQ ID NO. 1084
agtccactcacaagtgacaagatatattttagacattttaagtttgataatggatccaagatatgttactttattcatcttcttagtacttgccttacatggagatactacttttgcagaaacttgcaggcagttcgttaaagtgcatccattctgctttaaagcaatgtgcaaggcaaattgtgctatagagggaaaattctctgatggttcctatgtaaaggattacagatgtgaatcaggtggatttcactcagtgtgcgtttgcattttttgcaaacattagttatctaaagacaagcggagatatcttcttgtattcctatatgttatttaggagtattgtcaaataattatatggtagcttagttaactagctagtttgtttatttatagacatatgtagcactagttaactagttggtatttcttaaattcttagctatataccaggaacatgttttcagcgcttcaataatgt

SEQ ID NO: 1084 - protein, 78 aa, Zea mays
  misc_feature: Ceres CLONE 234228-F
MDPRYVTLFIFLVLALHGDTTFAETCRQFVKVHPFCFKAMCKANCAIEGKFSDGSYVKDYRCESGGFHSVCVCIFCKH

SEQ ID NO: 1085 - DNA, 440 bp, Zea mays
  misc_feature: Ceres CLONE 234236-F
  misc_feature: Encodes the peptide sequence at SEQ ID NO. 1086
  misc_feature (49)..(49): n is a, c, t, g, unknown, or other
  misc_feature (50)..(50): n is a, c, t, g, unknown, or other
  misc_feature (97)..(97): n is a, c, t, g, unknown, or other
  misc_feature (98)..(98): n is a, c, t, g, unknown, or other
attccacccgcttcccccagccgcacgaaaccctaacgctgccgccgcnncacaggtaagccgccgccatggtgtccggttccggcgtatgcgcganncgtgggtggacgcgcgccaccacatgctgggccgcctgtcgtcgattatcgccaaggaactgctcaatgggcagaaggtggwcgtcgtccgctgcgaggagatctgtatgtcgggtgggctcgtacgccagaagatgaagtacctccgctttctccgcaagcggatgaacaccaagccatcccatggacccatccacttccgcgccccgtccaagatcctgtggcgcaccatccgcgggatgattccgcacaagaccaagaggggggatgcggctctggcgaggctcaagacgtacgagggcgtaccgcgccgtacgacaagactaagcgcctggtcatccc

SEQ ID NO: 1086 - protein, 117 aa, Zea mays
  misc_feature: Ceres CLONE 234236-F
  misc_feature (5)..(114): Pfam Name: Ribosomal_L13 Pfam Description: Ribosomal protein L13
  misc_feature (3)..(3): Xaa is any aa, unknown, or other
  misc_feature (4)..(4): Xaa is any aa, unknown, or other
  misc_feature (31)..(31): Xaa is any aa, unknown, or other
MRXXWVDARHHMLGRLSSIIAKELLNGQKVXVVRCEEICMSGGLVRQKMKYLRFLRKRMNTKPSHGPIHFRAPSKILWRTIRGMIPHKTKRGDAALARLKTYEGVPRRTTRLSAWSS

SEQ ID NO: 1087 - DNA, 134 bp, Zea mays
  misc_feature: Ceres CLONE 234247-F
  misc_feature (82)..(82): n is a, c, t, g, unknown, or other
  misc_feature (83)..(83): n is a, c, t, g, unknown, or other
tgactccgccatcaaaaacatctccaaaaccccattccgcaatgagacccgcagccgcagcagccaccgctaccaccgccgnntccgtctccgcgccgcctccctctcgccttctctcgctgcctccctctcgc

SEQ ID NO: 1088 - DNA, 131 bp, Zea mays
  misc_feature: Ceres CLONE 234259-F
  misc_feature (41)..(41): n is a, c, t, g, unknown, or other
acgcacaccgcgacccagtccagagccagtacgtgcgamgncacgcacgctgctggtccgcgtacsagacgacggtcaggtcggccggtgcttttcagtttggaataatgacrgcgacgacgacgacagcc

SEQ ID NO: 1089 - DNA, 481 bp, Zea mays
  misc_feature: Ceres CLONE 234269-F
  misc_feature: Encodes the peptide sequence at SEQ ID NO. 1090
agttcgacactcgacaggctcggtttccgccctcctctcccaccgccgcgcaccgagaagatggggaagcggtggatcccgctggaggccaacccggacgtcctgaaccagttcatatgggggctgggagtccacgaggaggatgtgcagttctgcgacgtctacggccttgacgatgagctgctcgctatggtgccccagcccgttctcgccgtcctcttcctctacccgctcacctccctggacgaggagaaagaagaatcaagtgtttctgctgccacatcgacctcagcgggcaaggaattgagcaagaaagtatactttacgaagcagactgttggtaatgcttgtggaacagttggtgttattcatgcaataggaaatgcaacatctcaaatcaagctagttgaggggtcctattttgagaagttctataagcaaacggctgatatggatccagctcagcgtggctgccttttct

SEQ ID NO: 1090 - protein, 140 aa, Zea mays
  misc_feature: Ceres CLONE 234269-F
  misc_feature (4)..(140): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
MGKRWIPLEANPDVLNQFIWGLGVHEEDVQFCDVYGLDDELLAMVPQPVLAVLFLYPLTSLDEEKEESSVSAATSTSAGKELSKKVYFTKQTVGNACGTVGVIHAIGNATSQIKLVEGSYFEKFYKQTADMDPAQRGCLF

SEQ ID NO: 1091 - DNA, 384 bp, Zea mays
  misc_feature: Ceres CLONE 234272-F
  misc_feature: Encodes the peptide sequence at SEQ ID NO. 1092
ctcccgcagagcatkccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggaagt

SEQ ID NO: 1092 - protein, 102 aa, Zea mays
  misc_feature: Ceres CLONE 234272-F
  misc_feature (11)..(102): Pfam Name: Ribosomal_S3Ae Pfam Description: Ribosomal S3Ae family
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWK

SEQ ID NO: 1093 - DNA, 286 bp, Zea mays
  misc_feature: Ceres CLONE 234393-F
  misc_feature: Encodes the peptide sequence at SEQ ID NO. 1094
gaaaaatcaccaccatctcacttcatataccactccctaggaggacccagcaacacaacagccgagctttgcttaggcaagatgaacaggaagccaggagactgggactgcagggcgtgccagcacctcaacttcagccgccgagacatatgccagcgctgtagcgagccacgtggagttgctgatcgtggcagtggcggcggcggaggaggaggaggaggcgactacgccagcttcggtggccgcggtggctcctccttcggcggcggctttggcgctgctggct

SEQ ID NO: 1094 - protein, 68 aa, Zea mays
  misc_feature: Ceres CLONE 234393-F
MNRKPGDWDCRACQHLNFSRRDICQRCSEPRGVADRGSGGGGGGGGGDYASFGGRGGSSFGGGFGAAG

SEQ ID NO: 1095 - DNA, 422 bp, Zea mays
  misc_feature: Ceres CLONE 234428-F
  misc_feature: Encodes the peptide sequence at SEQ ID NO. 1096
  misc_feature (163)..(163): n is a, c, t, g, unknown, or other
  misc_feature (195)..(195): n is a, c, t, g, unknown, or other
avtccccaccacctccctgtatccctcctccccttctggccgacgaaaccctacgcgcgcgcgctgcywagacctcgccgccgacgcctactccgactccgacgccgcagtcgtgatgtacgccgacagacctcgggcaggaaacgctctgtaatggaccgcntcggctcgggcggmrgctcgcgctcgcggtcngacgacgcaaaaaggttttgccaggatgatgggacatggagacgtgagctttataaggattctagaggaactcagacttcatctgaacctacttccagaaatctggaatcgaacaaaaaatcccaagtgcagcaaaaggttgtgaagaaattaccagtttcagatcttcgtggaaagttatctggtgtcgcgagccagcgccctcaacttagcagtactgttcaggt

SEQ ID NO: 1096 - protein, 89 aa, Zea mays
  misc_feature: Ceres CLONE 234428-F
  misc_feature (4)..(4): Xaa is any aa, unknown, or other
  misc_feature (9)..(9): Xaa is any aa, unknown, or other
MDRXGSGGXSRSRSDDAKRFCQDDGTWRRELYKDSRGTQTSSEPTSRNLESNKKSQVQQKVVKKLPVSDLRGKLSGVASQRPQLSSTVQ

SEQ ID NO: 1097 - DNA, 651 bp, Zea mays
  misc_feature: Ceres CLONE 234441-R
  misc_feature (88)..(88): n is a, c, t, g, unknown, or other
cgattgggtaccgggcccccctcgaggtcgacggtatcgataagcttttttttttttttttttgaggacgagatggaatggatcttgnttccgacgatgaagaggaggaactgaacattccagtaatcaaagaaaatggggtttcttcctcgtcatcatcactggtatcatcctcatcacttgaatcatcatcgccttcggcaggacataatccctccccctcatcggaatcatcagaatcatcctcatcagaatcatcacactcaccatcctcagaatcgtcagatgcatccttgcttttcttttcaggccaagacttgattttgaatctctagaaactactgccatcgcttgtgttttctgctcctccttgccatacacctttcgtccttgactactgcaatgattaaccgctgccctatgccacactaagggatataaactatatccccgcgcacgccatgatgaccgacgccgtgcacaaacacggcgctctgacgggcatcgagttgtgacacggcgacggctctgtgtcgaacaagaccagccgctttgcgccgctgtcgccttctagcgtgtcctgcatggcgacgcatgtcgggttcatgggcaatcaacgctccaaggccatggattcgggcgatatccgct

SEQ ID NO: 1098 - DNA, 643 bp, Zea mays
  misc_feature: Ceres CLONE 234457-R
  misc_feature: Encodes the peptide sequence at SEQ ID NO. 1099
gttgtgcgactgcgggcgaagcgcgctatcgttggtgccggcgcgagggtcctgttctatccgacgcttctctacaacgtgtccgcaaccggttcgatggcgagttccgctggtgggatcgcatcgacaagtatgttttgctaggtgctgttccgttctctagcgatgttctgcgcctgaagcaacttggtgtaagaggagttgttacactcaatgaaccctatgaaactctggttccaacatccttataccaggctcatggaatcaatcatctcaaaattcctacaagagactacctgtttgccccatccctggagcatatttgtcgtgcagtggattttatccattgtaatgaagtgcaaggtggtagcacctatgtccactgtaaggctggaaggggacgaagcaccactatagttttgtgttttttgatcaagtacagaaatatgactcctgaagtagctttggatcatgcgaggtctgtgaggcctagagtgcttttagcgcccgcacagtggcaggccgttaaaatgttcagtgtgtatccttacagaagaggtgtcggatggtataattcaactacttaacaatttaaccatatgttatgtttggtgaaattattatggcaaaaaaaaaaaaaaaa

SEQ ID NO: 1099 - protein, 194 aa, Zea mays
  misc_feature: Ceres CLONE 234457-R
  misc_feature (40)..(181): Pfam Name: DSPc Pfam Description: Dual specificity phosphatase, catalytic domain
  misc_feature: SWISSPROT Homolog: EC 3.1.3.48 Protein-tyrosine-phosphatase
CATAGEARYRWCRREGPVLSDASLQRVRNRFDGEFRWWDRIDKYVLLGAVPFSSDVLRLKQLGVRGVVTLNEPYETLVPTSLYQAHGINHLKIPTRDYLFAPSLEHICRAVDFIHCNEVQGGSTYVHCKAGRGRSTTIVLCFLIKYRNMTPEVALDHARSVRPRVLLAPAQWQAVKMFSVYPYRRGVGWYNSTT

SEQ ID NO: 1100 - DNA, 477 bp, Zea mays
  misc_feature: Ceres CLONE 234484-F
  misc_feature: Encodes the peptide sequence at SEQ ID NO. 1101
ctactcccaaaatcccaaaaccctagctcgctaacgaccccaggcagacgcgccgtcctcccctcccccatggcgctcaagcagaagggcaccgacgccgccgccaccgacaccggtaccaagaagcgccgccgcgtcttcttctccgacaccgatgctggtgttgaggcaaatgagtgtatgaaagtgtttctagtatggaatccaggcgaggtgggctctgtagactgcactgctattcagccatttgacctaaaccatttttttggtgaagatgggaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaagctctggcaagtatgagaagaaggtgtatgtgctccccaagcacct

SEQ ID NO: 1101 - protein, 125 aa, Zea mays
  misc_feature: Ceres CLONE 234484-F
  misc_feature: SWISSPROT Homolog: EC 2.3.1.48 Histone acetyltransferase
MALKQKGTDAAATDTGTKKRRRVFFSDTDAGVEANECMKVFLVWNPGEVGSVDCTAIQPFDLNHFFGEDGKIYGYKNLKINVWISAKSFHGYADVSFDETSDGGKGITDLKPVLQNIFGEKLWQV

SEQ ID NO: 1102 - DNA, 126 bp, Zea mays
  misc_feature: Ceres CLONE 234533-F
  misc_feature (62)..(62): n is a, c, t, g, unknown, or other
acaccgcgacccagtccagagccagtacgtgcgacarcacgcacgctgctggtccgcgtacnagacgacggtcaggtcggccggtgcttttcagtttggaataatgacggcgacgacgacgacagc

SEQ ID NO: 1103 - DNA, 423 bp, Zea mays
  misc_feature: Ceres CLONE 234535-F
  misc_feature: Encodes the peptide sequence at SEQ ID NO. 1104
attagaatccacctcgcaccccgcggkcggtgactcccctagggtttcgtcgctccgccgccgccgaaacagcacatcgctctctcgatctcagccatggcggaggtggagcagccccaggacgcggtgaagctcttcaaccgctggaccttcgaatgtccaggtgaacgatatactcgctgaacgactacctggctgtgactgcggcgamsacgcgatcattcctgccgcactccgcggggcgctactccaagaagcggttccgcaaggcgcagtgcsatcgtcgagcgcctcacccaactcgctcatgatgcacgggcgcaacaacggcaagaaggtcatggccgtccgcatcatgargcacaccctggagatcatccacctgctcactgacgccaatccatccaggtggtcgtggacgcg

SEQ ID NO: 1104 - protein, 38 aa, Zea mays
  misc_feature: Ceres CLONE 234535-F
  misc_feature (18)..(18): Xaa is any aa, unknown, or other
MMHGRNNGKKVMAVRIMXHTLEIIHLLTDANPSRWSWT

SEQ ID NO: 1105 - DNA, 420 bp, Zea mays
  misc_feature: Ceres CLONE 234564-F
  misc_feature: SWISSPROT Homolog: EC 2.7.7.6 DNA-directed RNA polymerase
  misc_feature (232)..(232): n is a, c, t, g, unknown, or other
agccgcaagcyaaaaccctagcaagcaaaccaccggagcagcggcgctcgcgcggggcggasatcggcgacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgassnaaaacaacaaaatatatgacgaatatgaacgtgcgcgcattcttggtacacgagccttgcagataagcattgaatgctccagtcatggttgagcttgagggagaaactgaccctcttgagattgcgatgaaggagcttagagcgcgcaagatacccttcacgatcagacggtacctacctgatggaag

SEQ ID NO: 1106 - DNA, 196 bp, Zea mays
  misc_feature: Ceres CLONE 234595-F
agcactcgtcaccgttccgagaccagcgccagacgcagacggccccgaacgccggcggsaagcattcaggtcgtcgactccgagcatcgacccgccgcgatggagaagggaaagggcctcgctcgccgctggsgttgggagctccccgacgcctcctcctcctcccccgccrtccccgacccgcccgggcttcacc

SEQ ID NO: 1107 - DNA, 422 bp, Zea mays
  misc_feature: Ceres CLONE 234596-F
  misc_feature: Translation starting site: 82
agcagcctcccgaatccccaaagcctccgacccccttcctctctccctccgccgccgctgcgcacgcagggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgsgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaamgggaagaggagaaggaagagagcgacgacgacatgg

SEQ ID NO: 1108 - DNA, 495 bp, Zea mays
  misc_feature: Ceres CLONE 234626-F
  misc_feature: Encodes the peptide sequence at SEQ ID NO. 1109
tacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcagg

SEQ ID NO: 1109 - protein, 123 aa, Zea mays
  misc_feature: Ceres CLONE 234626-F
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIR

SEQ ID NO: 1110 - DNA, 215 bp, Zea mays
  misc_feature: Ceres CLONE 234651-F
  misc_feature: Encodes the peptide sequence at SEQ ID NO. 1111
aggtccttcaccgtgcgcgcctctctccgcaagccaccggcaccgcsccgtggcaatggctgccagcgccctgcttgccggcggtgccatggcccaggaggtgctgctgggcgcaggcgacggcgggctcgtcttcgasagccagttcaccgtcaaggccggcgacaccatcacattcaagaacaacgccggcttcccgcacaacgtcgtcttcg

SEQ ID NO: 1111 - protein, 53 aa, Zea mays
  misc_feature: Ceres CLONE 234651-F
  misc_feature (28)..(28): Xaa is any aa, unknown, or other
MAASALLAGGAMAQEVLLGAGDGGLVFXSQFTVKAGDTITFKNNAGFPHNVVF

SEQ ID NO: 1112 - DNA, 429 bp, Zea mays
  misc_feature: Ceres CLONE 234658-F
  misc_feature: Translation starting site: 66
  misc_feature: Pfam Name: HMG_box Pfam Description: HMG (high mobility group) box
  misc_feature (82)..(82): n is a, c, t, g, unknown, or other
atccatcaatcctcatcgccacccaacccgccgagtccccaagcaagttgagcatccatccatccatggcgggaggcaagtncaccggcaatgcscgcgcmsaggaagckcgtcgaggcaaccgtcctcaagckctccagggacgggagsccttcaccagatgckaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcggcaabttcgcccaccgccttcttcctcttcatggacgacttcaggaaggagtttccaaggccacccatcctgacaacaaggagtgtcgctac

SEQ ID NO: 1113 - DNA, 292 bp, Zea mays
  misc_feature: Ceres CLONE 234695-F
  misc_feature (64)..(64): n is a, c, t, g, unknown, or other
  misc_feature (142)..(142): n is a, c, t, g, unknown, or other
gtggcacagtgcacacactcgtctcatcggagaaaagtagatccgggttagggttttagacggngataggtgcggcgggcgacgagaaggctgcgatggctgcgtccgctgcagccgcgggggccggtgccgccgagggcanggcgcggtggactccaaggaccttcagcagcagagcaaggcgctcgacaagctcactgatcatgtcgaggaccggcagctcgattcatcccgtgtccaatccgccatggcgcaacttgcttcatccaamgaggctgactggaacgcgatg

SEQ ID NO: 1114 - DNA, 95 bp, Zea mays
  misc_feature: Ceres CLONE 234704-F
  misc_feature: Encodes the peptide sequence at SEQ ID NO. 1115
  misc_feature (46)..(46): n is a, c, t, g, unknown, or other
agaggaaaggtgaggccgatagatagaggagctgcggcgccgcggngaggcgaagagtggaggatccgatccgaagcgagaggactgaatcctgc

SEQ ID NO: 1115 - protein, 31 aa, Zea mays
  misc_feature: Ceres CLONE 234704-F
  misc_feature (16)..(16): Xaa is any aa, unknown, or other
RGKVRPIDRGAAAPRXGEEWRIRSEARGLNP

SEQ ID NO: 1116 - DNA, 391 bp, Zea mays
  misc_feature: Ceres CLONE 234744-F
  misc_feature: Encodes the peptide sequence at SEQ ID NO. 1117
attgggagctcactcgctggtcgttgcctgctgcggattgcccccaggcgggccccactcattccgctgctgatatttcgtttggttctcctttccgtcttgtccgtcgccgaggccttccgctcgctccccagctccagcaggcagatcagatccatccaaccacgaamaggaaggaaggtaggaggaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatmgccgagcagctcgagtt

SEQ ID NO: 1117 - protein, 61 aa, Zea mays
  misc_feature: Ceres CLONE 234744-F
MSAVAVSSSLNPNAPLFIPAALLQVEDFSPQWWDLITTTAWFRDHWSREHAHLDEIAEQLE

SEQ ID NO: 1118 - DNA, 421 bp, Zea mays
  misc_feature: Ceres CLONE 234760-F
  misc_feature: Encodes the peptide sequence at SEQ ID NO. 1119
  misc_feature (193)..(193): n is a, c, t, g, unknown, or other
  misc_feature (345)..(345): n is a, c, t, g, unknown, or other
aatgccattgccaccttccaaacgcaaacaattctaaagcaacgcrgcgaacaattgagaaagccagagcgagcgatcgaccgagagagagagagagataggggtgggggagaggcaaggaaggggaagaggagcgaaggcgcccgacgacagcggcaccgtmgggattggccatcggmaccgcggtcggcgncacctccattgccctcttcaccggcgtgastgctggttgggcatgaaggcttaccgtgacggccgattctcgagaggatggtggcggatgcgcgtctgcacgctcggcggcgtcaccaccctggggcaggcgctggcmtacgactgcgccangtgcggccgcagcctggaccagcgggaggaggtccgcacgctctcctgcggtcacgtgttccacctccgcaaggtc

SEQ ID NO: 1119 - protein, 62 aa, Zea mays
  misc_feature: Ceres CLONE 234760-F
  misc_feature (37)..(37): Xaa is any aa, unknown, or other
MKAYRDGRFSRGWWRMRVCTLGGVTTLGQALAYDCAXCGRSLDQREEVRTLSCGHVFHLRKV

SEQ ID NO: 1120 - DNA, 453 bp, Zea mays
  misc_feature: Ceres CLONE 234773-F
  misc_feature: Encodes the peptide sequence at SEQ ID NO. 1121
accctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcagcatcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaagggaaggttgtaggctgctcctgtgtcgtcgtc

SEQ ID NO: 1121 - protein, 90 aa, Zea mays
  misc_feature: Ceres CLONE 234773-F
  misc_feature (1)..(90): Pfam Name: Ribosomal_L7Ae Pfam Description: Ribosomal protein L7Ae/L30e/S12e/Gadd45 family
  misc_feature (50)..(50): Xaa is any aa, unknown, or other
MKKSSAHDGLVKGLREAAKAIEKHAAQLCVLAEDCDQPDYVKLVKALCAXTMFTWSLFLPLRPLASGLGFARLTLRARQGKVVGCSCVVV

SEQ ID NO: 1122 - DNA, 122 bp, Zea mays
  misc_feature: Ceres CLONE 234774-F
  misc_feature (48)..(48): n is a, c, t, g, unknown, or other
  misc_feature (49)..(49): n is a, c, t, g, unknown, or other
  misc_feature (111)..(111): n is a, c, t, g, unknown, or other
  misc_feature (117)..(117): n is a, c, t, g, unknown, or other
awaaccaaactaattacctcttcccgcgacctcctcccccggcgtacnncggagatccaccccgacccaccaccgcgtgcctcggcaatggccgccgctccgaccaccgtnaccwantctct

SEQ ID NO: 1123 - DNA, 432 bp, Zea mays
  misc_feature: Ceres CLONE 234776-F
  misc_feature: Translation starting site: 202
  misc_feature: SWISSPROT Homolog: EC 2.7.10.2 Non-specific protein-tyrosine kinase
  misc_feature (98)..(98): n is a, c, t, g, unknown, or other
  misc_feature (107)..(107): n is a, c, t, g, unknown, or other
  misc_feature (312)..(312): n is a, c, t, g, unknown, or other
atagcatagcagagcaggcgcaccgcacacctcactgccgctcccttctcgtctcgtctcctctcctctcctcggcggatccgagmaccgacccaccncmcctmtrntcgttccttcmgccggaatcgctgctcctctctgtgtgctgtcgatttgtgcggmgactgttagtttggatcggtcccatccttcwgttgatcaatggctgacggtgaggatatccagccacttgtgtgtgacaatggcactggaatggtcaaggctggctttgctggtgatgatgcgcccagagcagtgttccctagtatagtnggccgccctcggacacgggtgtgatggttggaatgggccagaaggacgcctatgtaggtgacgaggcacagtcaaaaagaggtatcttgaccttgaagtaccccattgagcacggtatcg

SEQ ID NO: 1124 - DNA, 247 bp, Zea mays
  misc_feature: Ceres CLONE 234829-F
  misc_feature: Encodes the peptide sequence at SEQ ID NO. 1125
  misc_feature (41)..(41): n is a, c, t, g, unknown, or other
gaacgctagctgaaccctagccggcggatctccgcgggcgncagtcaggagtggaggcgtggtcgcacgggcgaggtcgcaataggagaggctcagagagatggggcggccttacgcggtgaaggggcggaagaagaagcgcaastcgaggaggcggcggcggcggcctcggacstgccccgcccgtcgaagaagcggaggagctgccaccgccagaggtgagaagcggcgaggaaaagagcagcga

SEQ ID NO: 1125 - protein, 49 aa, Zea mays
  misc_feature: Ceres CLONE 234829-F
  misc_feature (15)..(15): Xaa is any aa, unknown, or other
MGRPYAVKGRKKKRXSRRRRRRPRTCPARRRSGGAATARGEKRRGKEQR

SEQ ID NO: 1126 - DNA, 148 bp, Zea mays
  misc_feature: Ceres CLONE 234943-F
ctacggccgccgcagcatcaagctccccgaccaaaccctactcgtaccccgccgccgccgcagccgkctagccgcgcacaccagcaagcagaactagcagccatgccgcccaaattggacccctctcaggtggtggaggtcttcgtcg

SEQ ID NO: 1127 - DNA, 237 bp, Zea mays
  misc_feature: Ceres CLONE 234958-F
  misc_feature: Encodes the peptide sequence at SEQ ID NO. 1128
  misc_feature (42)..(42): n is a, c, t, g, unknown, or other
gaacgctagctgaaccctagccggcggatctccgcgggcggncagtcaggagtggaggcgtggtcgcacgggcgaggtcgcaataggagaggctcagagagatggggcggcccggatgaaggggcggaagaagaagcgcaastcgaggaggcggcggcgrcggcctcggacgctaccccgcccgtcgaagaagcggaggagctgccaccgccagaggttkagaagcggcgaggaaaa

SEQ ID NO: 1128 - protein, 40 aa, Zea mays
  misc_feature: Ceres CLONE 234958-F
  misc_feature (9)..(9): Xaa is any aa, unknown, or other
  misc_feature (35)..(35): Xaa is any aa, unknown, or other
MKGRKKKRXSRRRRRRPRTLPRPSKKRRSCHRQRXRSGEE

SEQ ID NO: 1129 - DNA, 415 bp, Zea mays
  misc_feature: Ceres CLONE 234959-F
  misc_feature: Encodes the peptide sequence at SEQ ID NO. 1130
  misc_feature (83)..(83): n is a, c, t, g, unknown, or other
accaccgcatcccacaccccccgagctcagcttagctccactccagctccaatcacagtcgtgaccagagcgcgagastarbnagagggccgtgaaaatrcmgatcaataggatmgccctggggagccaccaggaggtgtaccacccgggcgccctcaaggsgcgttcgctgagttcatctccaccctcatcttcgtcttcgccggccagggctccggcatggccttcagcaagctgaccggcggcggcccgacgaccccggcggccttgaatcgcggcggcggtggcgcacgcgttcgsctgttcgtggcggtgtctgtgggcgcgaacatctccggcgggcacgtgaaccctgccgtgacctttcggagccttcgtgggcggcaacatcaccctgttccgggggctctgtact

SEQ ID NO: 1130 - protein, 65 aa, Zea mays
  misc_feature: Ceres CLONE 234959-F
MAFSKLTGGGPTTPAALNRGGGGARVRLFVAVSVGANISGGHVNPAVTFRSLRGRQHHPVPGALY

SEQ ID NO: 1131 - DNA, 168 bp, Zea mays
  misc_feature: Ceres CLONE 234981-F
  misc_feature: Encodes the peptide sequence at SEQ ID NO. 1132
aggtgaaacggcatggcgacggtcgcagcccgccgctcctccagcagcgatgggtggccggtgggcggtgcggctgctgggcacgcagcggaggcttctccgggcggagagggcgcgcgaggagggggaggtggatccggcgacgcgatctttgtgaagaagccggcg

SEQ ID NO: 1132 - protein, 52 aa, Zea mays
  misc_feature: Ceres CLONE 234981-F
MATVAARRSSSSDGWPVGGAAAGHAAEASPGGEGARGGGGGSGDAIFVKKPA

SEQ ID NO: 1133 - DNA, 116 bp, Zea mays
  misc_feature: Ceres CLONE 235013-F
  misc_feature (74)..(74): n is a, c, t, g, unknown, or other
aacaacagcgaacacatctcctcgcatttcttcccatccgatccccccttcgcaaccaaaaccccaactcgccnhgcatcgatggcgcccaaggccgagaagaaacccgctggcga

SEQ ID NO: 1134 - DNA, 199 bp, Zea mays
  misc_feature: Ceres CLONE 235044-F
  misc_feature (138)..(138): n is a, c, t, g, unknown, or other
actcatacatttcgactctcaactcccaaggtccctttttttttctcgatctggaagcgccgcagtagcagccatggacgtragcggasaggcrgtaaggcgaagaagggcgcrgcggggcgcaaggccggcgggcgngcgaagaagtcggtgtcgcgrtcctccagggccggarctgcagttccccgtcagccgcgtc

SEQ ID NO: 1135 - DNA, 214 bp, Zea mays
  misc_feature: Ceres CLONE 235047-F
atcttgctctgaacgcattcctcccatctcccaagacctcctcagacccgagaagcgcavkgcggaccatggacgccaccggcactggagctggagggaaggcgaagaagggagcggccggtcgcaaggccgtcrggcgagggaagaagtcggtkacgagagtccgtgaaggccgrgctccagttccccgtcggccgcatcgggcgctacctca

SEQ ID NO: 1136 - DNA, 281 bp, Zea mays
  misc_feature: Ceres CLONE 235050-F
  misc_feature: Encodes the peptide sequence at SEQ ID NO. 1137
  misc_feature (179)..(179): n is a, c, t, g, unknown, or other
acgcggtrcsacacagccaaaccatcctcctctccgccgcccgccgcagcagcacccaccggcaagatgaagacgatcctggcgtcggagacttggacatcccggagcgtcacggtcacggtggccgccaagctggtcacggtggagggcccccgmggcaagctcacccgaaacttcangcacctcaacctcgacttccagctgcaggaggccggccgcaagctcaaggtggacgcctgggtttcggcacccgcscaccatggccgccatccgcaccgccc

SEQ ID NO: 1137 - protein, 71 aa, Zea mays
  misc_feature: Ceres CLONE 235050-F
  misc_feature (38)..(38): Xaa is any aa, unknown, or other
MKTILASETWTSRSVTVTVAAKLVTVEGPRGKLTRNFXHLNLDFQLQEAGRKLKVDAWVSAPAHHGRHPHR

SEQ ID NO: 1138 - DNA, 467 bp, Zea mays
  misc_feature: Ceres CLONE 235099-F
  misc_feature: Encodes the peptide sequence at SEQ ID NO. 1139
  misc_feature (160)..(160): n is a, c, t, g, unknown, or other
acaacttcctgcttgcacgcaagcyactccgaggccaagtctagggtttgggaatctgtaggaggggagaggggagcgcgctcagggtcagggaggcgaagatgatcgaggtggtgctgaacgaccgcctggggaagaaggtgcgggtgaagtgcamggngacgacaccatcggcgacctcaagaagctggtggcggcgcagacgggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgttaatccgaattctgaagtcatgggtgcgcttccagtcacagcgtctttagctaacaagctcgcatacatatagggcaactttgagtgagctatgtagtacggatatggttgtgtg

SEQ ID NO: 1139 - protein, 73 aa, Zea mays
  misc_feature: Ceres CLONE 235099-F
  misc_feature (19)..(19): Xaa is any aa, unknown, or other
  misc_feature (20)..(20): Xaa is any aa, unknown, or other
MIEVVLNDRLGKKVRVKCXXTTPSATSRSWWRRRRGTRPEKIRIQKWYNIYKDHITLKDYEIHDGMGLELYYN

SEQ ID NO: 1140 - DNA, 392 bp, Zea mays
  misc_feature: Ceres CLONE 235154-F
  misc_feature: Translation starting site: 68
aatcttgctctgaacgcattcctcccatctcccaagacctcctcagacccgagaagcgcmkgcggccatggacgccaccggactggagctggagggaaggcgaagaagggagcggccggtcgcaaggccgcgggcgaggaagaagtcggtgacgargtccgtgaaggccrrgctccagttccccgtcggccgcatcgggcgctacctcaagaagggccgctacgscascgtcggcagcggtgcccccgtctacctcgcggccgtcctggagtacctcgccgctgaggtcctggagctcgccggcaacstgccaaggacaacaagaagacgcgcatcgtcccgcgccacgtgctgctggcgatccgcaacgacgaggagctcgggaagctgct

SEQ ID NO: 1141 - DNA, 478 bp, Zea mays
  misc_feature: Ceres CLONE 235166-F
  misc_feature: Translation starting site: 284
ttttaccacaccctgctctcgctcttgttgtgacggtcgattcgcttgtacaaggtagcaaccttgagatccagccaagatccagccatgagggagattctccacatccagggtggacagtgcggcaaccagatcggttccaagttctgggaggtcagtctgcgacgagcatagtatcgaccccaccggacgctatgtcggcacctccgacctccagctcgagcgcgtcaatgtctactacaacgaggcctcatgcggccgcttcgtgccgcgcgctgtgctcatggacctcgagcccggcaccatggacagcgtcgcaccgggccgtacggacagatcttccggcccgacaacttcgtcttcggccagtctggtgcagggaacaactgggccaagggcactacacagagggcgctgagctcatcgactctgtgcttgacgtcgtgaggaaagaggcggagaactgcgactgccttca

SEQ ID NO: 1142 - DNA, 446 bp, Zea mays
  misc_feature: Ceres CLONE 235178-F
  misc_feature: Translation starting site: 303
  misc_feature: SWISSPROT Homolog: EC 5.2.1.8 Peptidylprolyl isomerase
cgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccactcccwccacaacgccttcagcacctacggcgaggtcctcgagtccaagatcatcctcgatcgggagacgcagaggtcccgcggcttcggcttcgtcaccttctccacggaggaggcgatgcggaacscatcgagggcatgaacggcaaggagctggacggccgcaacatcaccgtcaacgaggcccagtcccgcggcggccgtkgaggcggcggcggtgggtacggtggtggccgttgaggcggcggctacggcaactccgacgggaactcggaggaactc

SEQ ID NO: 1143 - DNA, 320 bp, Zea mays
  misc_feature: Ceres CLONE 235193-F
  misc_feature: Translation starting site: 177
accagcctgctccggtcctcttggagttgggcctgccacctcccggccggtccgccgcgssttccagtttcgcctctcgtcgccggtcctggcgagccccgcctccttgatctccgaccagcagcttccccaaygcccactccccagccccggacgtgcccttcgccggtrctgtcatggcgttcggccgacggagccccggatcctcgcggcaccctcccgcgctcaccatcgtcacggcgctactcctcgcctccctctacttcgccgccgcggcggcttacctatcgcccaccgacgcgatgcacaacaacaactgg

SEQ ID NO: 1144 - DNA, 464 bp, Zea mays
  misc_feature: Ceres CLONE 235196-F
  misc_feature: Translation starting site: 27
  misc_feature: Pfam Name: WCOR413 Pfam Description: Cold acclimation protein WCOR413
  misc_feature (93)..(93): n is a, c, t, g, unknown, or other
gcaataacgcaaagattcggctgacaatggggaaggggttcgcgtcgtacttggcgatgaagacggggtcggagggcggcgacggcgcggcangtggcggcgcacaggcgctcatcgacgcggacctgcggaacctcggcgtcgcccgcgawakctcgccaaccacgccttamgtcctcggcggcgggttggggttcggcacttctttcctcaagtggctggccttcctcgccgcagtgtatctcttgatattggactgcacgacctggaagaccaacatggctgacagctctcttggttccttacattttcttcactctgcctaatgtgctgttttctctgatcagaggagaggtggggaaatggattgcgattattgctgttattctgcgcctatttttttccgcgccacttcccagattggtttagagcttcccgggttccatcatcctgctcacagcggt

SEQ ID NO: 1145 - DNA, 236 bp, Zea mays
  misc_feature: Ceres CLONE 235213-F
  misc_feature: Encodes the peptide sequence at SEQ ID NO. 1146
  misc_feature (108)..(108): n is a, c, t, g, unknown, or other
acaacaccagaatccgcgaatcacagacgcgtctatctcagcttgctgcactgcactaccctgccctgccatcatatcgtacgtgagcccggccgagcgagavgggangaggcatggctgctccgaagctcgcgacgctggcgctggccgtgctcctggcggcgaccgtggtagctcccccggccgcggtgcgcgcgsgtattgtcgtgctccaccgtgtacagcacgctgatgcc

SEQ ID NO: 1146 - protein, 41 aa, Zea mays
  misc_feature: Ceres CLONE 235213-F
  misc_feature (29)..(29): Xaa is any aa, unknown, or other
MAAPKLATLALAVLLAATVVAPPAAVRAXIVVLHRVQHADA

SEQ ID NO: 1147 - DNA, 371 bp, Zea mays
  misc_feature: Ceres CLONE 235220-F
  misc_feature (313)..(313): n is a, c, t, g, unknown, or other
  misc_feature (354)..(354): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcggggcgaggaagaagtcggtgacgaggtccgtgaaggccgggctccagttccccgtcggccgcatcgggcgctacctcaagaagggccgctacgcgcasgttcggcagcggtgcccccgtctacctcgcggccgtcctggagtacctcgccgctgaggtcctggagctcgccggcaacgctnccaaggacaacaagaagacgcgcatcgtcccgcgccacgtnctgctggcgatccgcaa

SEQ ID NO: 1148 - DNA, 419 bp, Zea mays
  misc_feature: Ceres CLONE 235231-F
  misc_feature: Encodes the peptide sequence at SEQ ID NO. 1149
  misc_feature (98)..(98): n is a, c, t, g, unknown, or other
  misc_feature (163)..(163): n is a, c, t, g, unknown, or other
attcctcggagagagaagccgccgtcgcagcaatcacagcagcccggagaacggccaggtccgacaagatgcagatctttgtgaagacgctgacaagnaagaccatcaccctcgagrtcgagagcagcgacaccatcgacaatgtcaaaggccaagatccagnacaaggwagggatcamgccggaccagcagcgrgctgatctttgccgggaagcagctggaggatggccgcacccttgcgactataacatccaaaaggagtctacgctccacctcgtgctcaggctccgcggtggcatcattgagccctcgctgcaggcgctcgctcgcaagtacaaccaggacaagatgatttgccgcaaatgctatgcacggmtgcaccctagggctgtcaactgccgcaagaagaagtgtggtca

SEQ ID NO: 1149 - protein, 92 aa, Zea mays
  misc_feature: Ceres CLONE 235231-F
  misc_feature (53)..(92): Pfam Name: Ribosomal_L40e Pfam Description: Ribosomal L40e family
  misc_feature (8)..(8): Xaa is any aa, unknown, or other
  misc_feature (10)..(10): Xaa is any aa, unknown, or other
  misc_feature (13)..(13): Xaa is any aa, unknown, or other
  misc_feature (79)..(79): Xaa is any aa, unknown, or other
MSKAKIQXKXGIXPDQQRADLCREAAGGWPHPCDYNIQKESTLHLVLRLRGGIIEPSLQALARKYNQDKMICRKCYARXHPRAVNCRKKKCG

SEQ ID NO: 1150 - DNA, 1191 bp, Zea mays
  misc_feature: Ceres CLONE 235293-R
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (66)..(66): n is a, c, t, g, unknown, or other
  misc_feature (76)..(76): n is a, c, t, g, unknown, or other
  misc_feature (80)..(80): n is a, c, t, g, unknown, or other
  misc_feature (905)..(905): n is a, c, t, g, unknown, or other
  misc_feature (1129)..(1129): n is a, c, t, g, unknown, or other
  misc_feature (1191)..(1191): n is a, c, t, g, unknown, or other
taaaatgtctcttactaannnnatntnnnnnnnnnnccctagaatggggggcgattgggtaccggnccccccctcnaggnctattacacaagaggtttttttttttttttttttcccacagcaatcgcgttcgcaaatcaacggtccgatgtacacaacacatccgtatttgtcactgtagaccaaaggcagctgcgttatggttatggccacttgaactgacagcagaagcatcagcatcaaggtgtacgtacgcactccactactgtagagctactaatccgacaaatctttggtcctggatcagacgcacgcacgcgctctcgttccggaaatgactatccaattctactcgaacctcagaaaccacgccccccggttccctgaatactatagagtccaccttgatctcttccacacgtcatactcgatcgacaaacaacatacgttaactactataacgaagttgacgaaaattacaacctctcacctcctatacttataccaccacaattactactcactccaccgccctgtaggccctttacttatacgtacaacaattttctactccattgctcattacgtccttcctattattttcgtcccctggacgcgtgttgggtacttttgcacatacaccatacaatcctatgaacacgtatagctaaagctttcggtttacagcaaactcatacacctctcctactatccgcaccctgcgaatattacgatactgttaactatatatagtaatgcacgtgcacccacttataattactaacattttactaggtctcacatctcaagcgcactcatcttctaacctatatcacctccaacagtcatctctacactcatgctaacacttctgacactattctctccaccattgcaatgtctcnttaacagattatcttaagatagagatctcatctctctctgaccaaaacttctttcgggctatcgctgaccagtccacctcgactctctctcatgaatactctcctctatgttggatatgatattcctatacgagtagagtggacctcctcttgatcttgtttctattgcacacaatcgacacactgccagccgtctcacatggccacacgtctactcgctattntactataacaataaagttatatttgctcgacagcgtcatctagtctatgttatagtgtatgn

SEQ ID NO: 1151 - DNA, 432 bp, Zea mays
  misc_feature: Ceres CLONE 235317-F
  misc_feature: Encodes the peptide sequence at SEQ ID NO. 1152
  misc_feature (61)..(61): n is a, c, t, g, unknown, or other
  misc_feature (63)..(63): n is a, c, t, g, unknown, or other
gagagcccagcgtcggagatctccgccgccatggagacgctggccagcgccatgcgscgangnaaccgccggtccaaggccccgcctcctcctctgcttcctccgccctcgcctcgggcagggtccctctcgtcatggccttccactcctgcctcgcctggctctaacgtcgcmcggccgtttstggcaggacgcgcagacccgggcgatcctgtccggcctcctcgagaagagctctaccagcgtcccgaagtgctctcggtggaggacaagcytaggaaccttgggtgcaaggcgattcgaaggaaaattgttgaggcggagatggacctgaccagggccaagagcgagggggtactgtgggggaacaggactgcagctgtggactccgacaagaggcagcagcttctttgacgtcattggagtttacac

SEQ ID NO: 1152 - protein, 127 aa, Zea mays
  misc_feature: Ceres CLONE 235317-F
  misc_feature (11)..(11): Xaa is any aa, unknown, or other
  misc_feature (52)..(52): Xaa is any aa, unknown, or other
  misc_feature (82)..(82): Xaa is any aa, unknown, or other
METLASAMRRXNRRSKAPPPPLLPPPSPRAGSLSSWPSTPASPGSNVARPFXAGRADPGDPVRPPREELYQRPEVLSVEDKXRNLGCKAIRRKIVEAEMDLTRAKSEGVLWGNRTAAVDSDKRQQLL

SEQ ID NO: 1153 - DNA, 471 bp, Zea mays
  misc_feature: Ceres CLONE 235324-F
  misc_feature: Translation starting site: 78
  misc_feature: Pfam Name: iPGM_N Pfam Description: BPG-independent PGAM N-terminus (iPGM_N)
  misc_feature: SWISSPROT Homolog: EC 5.4.2.1 Phosphoglycerate mutase
atcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtstggtcggattttcgcccaaggtgctaagcttgttgatcaagctcttgcctcaggaaagatttatgatggagatgggttcaactacatcaaagaatcttttgaaaatggtactcttcaccttattgggttgttgag

SEQ ID NO: 1154 - DNA, 216 bp, Zea mays
  misc_feature: Ceres CLONE 235341-F
  misc_feature: SWISSPROT Homolog: EC 3.6.3.14 H(+)-transporting two-sector ATPase
  misc_feature (1)..(1): n is a, c, t, g, unknown, or other
  misc_feature (108)..(108): n is a, c, t, g, unknown, or other
ncctccccttttccttcctcttcgccccagcgacgcgtccgcccggavaccgagcgaggcaggcaactaaccaccgagaggcmgggacaggaacaggaagccgggavnagatgtcgtcggtgttcagcggcgmtgagacggcccccttcttcggcttcctcggcgccgcscrrcmctcgtcttctcatgcatgggcgccgcgtacgggaccgcgaa

SEQ ID NO: 1155 - DNA, 418 bp, Zea mays
  misc_feature: Ceres CLONE 235398-F
  misc_feature: Encodes the peptide sequence at SEQ ID NO. 1156
  misc_feature (156)..(156): n is a, c, t, g, unknown, or other
attccgtcgtcgtcgtcagcagcttctgcttgctttgtgggggaaggagagagagagagagcgagagagagatctagtagagaggctagtaggtggtcctcgaacgaagatgttagcggtgttcagcgggcaggtggtggaggtgccggcggactngwaggcggcgggcagcrracgccgtcgcccaaracgaaggcgtcgcagctcgtggggcgcttcctggccgcctccgagccggccgtgtccgtrcagctcggcgaccacggccacctcgcttactcccacaccaaccaggcgctcctccgccccaggtcgttcgcggccaaggacgaggtgttctgcctgtttcgaagggggtgctggacaacctggggtcggctgagccagcagcacgggctgtcaacaagggcgccaacga

SEQ ID NO: 1156 - protein, 139 aa, Zea mays
  misc_feature: Ceres CLONE 235398-F
  misc_feature (53)..(53): Xaa is any aa, unknown, or other
  misc_feature (58)..(58): Xaa is any aa, unknown, or other
IPSSSSAASACFVGEGERERARERSSREASRWSSNEDVSGVQRAGGGGAGGLXGGGQXTPSPKTKASQLVGRFLAASEPAVSVQLGDHGHLAYSHTNQALLRPRSFAAKDEVFCLFRRGCWTTWGRLSQQHGLSTRAPT

SEQ ID NO: 1157 - DNA, 474 bp, Zea mays
  misc_feature: Ceres CLONE 235461-F
  misc_feature: Encodes the peptide sequence at SEQ ID NO. 1158
  misc_feature (60)..(60): n is a, c, t, g, unknown, or other
  misc_feature (87)..(87): n is a, c, t, g, unknown, or other
  misc_feature (88)..(88): n is a, c, t, g, unknown, or other
  misc_feature (114)..(114): n is a, c, t, g, unknown, or other
  misc_feature (115)..(115): n is a, c, t, g, unknown, or other
gctcagactcgtctgctgcagctcctcctccgccgccgtatcaaacgcactctccttcgnhgccgtatcaaacgcactctccttcgnngccgtatcaaacgcactctcctccgnngccgcccgaggcaagatggttctccagaacgacatcgaccttctcaacccgccggcagagctcgagaagctcaagcacaagaagaagcgcctcgtccagtcccccaactcattcttcatggatgtcaagtgccagggatgcttcagcataaccacggttttcagccactcccagactgttgttgtgtgcccaggctgccaaactgttctctgccagcccacgggaggaaaggcgaggctcacggagggctgmtctttccgccggaagggagactagagcgagtctgttattagtactggatcggttgtcaatctccagtatgtggtcttcaagtttttgctctgtgcccagacgttaag

SEQ ID NO: 1158 - protein, 86 aa, Zea mays
  misc_feature: Ceres CLONE 235461-F
  misc_feature (30)..(84): Pfam Name: Ribosomal_S27e Pfam Description: Ribosomal protein S27
  misc_feature (79)..(79): Xaa is any aa, unknown, or other
MVLQNDIDLLNPPAELEKLKHKKKRLVQSPNSFFMDVKCQGCFSITTVFSHSQTVVVCPGCQTVLCQPTGGKARLTEGXSFRRKGD

SEQ ID NO: 1159 - DNA, 376 bp, Zea mays
  misc_feature: Ceres CLONE 235532-F
  misc_feature: Encodes the peptide sequence at SEQ ID NO. 1160
  misc_feature (24)..(24): n is a, c, t, g, unknown, or other
  misc_feature (28)..(28): n is a, c, t, g, unknown, or other
  misc_feature (99)..(99): n is a, c, t, g, unknown, or other
  misc_feature (163)..(163): n is a, c, t, g, unknown, or other
  misc_feature (257)..(257): n is a, c, t, g, unknown, or other
  misc_feature (258)..(258): n is a, c, t, g, unknown, or other
  misc_feature (363)..(363): n is a, c, t, g, unknown, or other
gaaaaccctaghagttcggtagtncctntccthtcgaggtattagcagtcgaccggttcctcggagcacgatgaagtttgttgmtgcctacctgcttgntgtcctcgctgggaacgccagcccctccgctgacgatttgactgccattctggagtyagttggntgtgaagttgacaatgaaaagatggaactcctgctgtcccaactgagcggtaaggacatcaccgagctcattgccgcgggcagggagaagtttnntthagthccatgtggtggcggcggtgtcgctgttgcggcastgcacctgctgctggcggastgctcctgcastgaggcaaagaaagaagagaaggtggaagaganggaagaaagcgat

SEQ ID NO: 1160 - protein, 102 aa, Zea mays
  misc_feature: Ceres CLONE 235532-F
  misc_feature (17)..(102): Pfam Name: Ribosomal_60s Pfam Description: 60s Acidic ribosomal protein
  misc_feature (5)..(5): Xaa is any aa, unknown, or other
  misc_feature (10)..(10): Xaa is any aa, unknown, or other
  misc_feature (29)..(29): Xaa is any aa, unknown, or other
  misc_feature (63)..(63): Xaa is any aa, unknown, or other
  misc_feature (64)..(64): Xaa is any aa, unknown, or other
  misc_feature (77)..(77): Xaa is any aa, unknown, or other
  misc_feature (83)..(83): Xaa is any aa, unknown, or other
  misc_feature (87)..(87): Xaa is any aa, unknown, or other
  misc_feature (98)..(98): Xaa is any aa, unknown, or other
MKFVXAYLLXVLAGNASPSADDLTAILEXVGCEVDNEKMELLLSQLSGKDITELIAAGREKFXXVPCGGGGVAVAAXHLLLAXCSCXEAKKEEKVEEXEESD

SEQ ID NO: 1161 - DNA, 453 bp, Zea mays
  misc_feature: Ceres CLONE 235541-F
  misc_feature: Pfam Name: NAP Pfam Description: Nucleosome assembly protein (NAP)
  misc_feature (175)..(175): n is a, c, t, g, unknown, or other
ttcccagctccgcctccttttcctgccttcctcctcactagtcgctcccccgcggctcgscaggcgggcgacacaacgaggctaaatccctatcgcgaggaggcgtgtgaggccagcggctttgcgatgacagcaccagcgacaaggggaagaaggccaagactgatgccgacgnggcgaggagaacgaacagatcgacggcgtcctcgtcctctccatcgagaagctccaggagatacaggacgagctcgagaaggtaaatgaggaagcaagtgacaaggttatggagggtggagcagaaatacagtgagatccgcagacctgttctatctcaaagaggggtgacattatcaagaccatcccggaactttttggctcacagcgttttatgagccatcctctattaagtgagcttctgactgaagaggaccagaagatattcaagtacttaga

SEQ ID NO: 1162 - DNA, 732 bp, Zea mays
  misc_feature: Ceres CLONE 235551-R
caattgggtaccgggccccccctcgaggtcgacggtatcgataagcttttttttttttttttttattcatgcatatacggattgtacctgtgaaacaaacgatatatatgcatagcttccttatacggattgtaattccacgcgctgttaacaatcgggatggtgaaatgtacaccatgatcagttgataacgtgaaatgggtgggcagcatcagcaccatgaacgcgtcatagggagaagggcttcgcatagacttcaaatggctcgcatgccgtcagttgtggctcctgtctcaaaccaccaaaacaactggtcccccttcaaagactcttgaaccgcccttaaaactaggggcattaaaggcttgtttgttgcaataattccctctggcacgatcaaaatatctacctttgcaaaaatccaaaatcgtttcctgggggaatctttttaccatggccacccagtttctggggaaaataattgatccagcctggatgatcccaaaagtggttctaatgaaatttttgtggggggatgcgcaaaaaaattggccctatcccccccgggttaggggaccaaattttggttggggtatcccttccaaaaagaaggaatctgggaaccccaagtttctcttggaatgagacttggttaaaatcccccttgggaagggggatgctttccaagggtttcaaaaaaagggggggccccacgggattatatgggggaaa

SEQ ID NO: 1163 - DNA, 186 bp, Zea mays
  misc_feature: Ceres CLONE 235552-F
  misc_feature (81)..(81): n is a, c, t, g, unknown, or other
cgatcacacaccactccacagcagtagbaagagggatagagcaaggccacacacacacacacaccactaggctaggttaancktttaatcgtcrtcgagaagcaagatgggcgcgcacsaagcwggcaagcaagaagagagccgatcgaccgagagcwagcacgcgatggcgaggtcttccaagat

SEQ ID NO: 1164 - DNA, 206 bp, Zea mays
  misc_feature: Ceres CLONE 235555-F
gaacgcattcctcccatctcccaagacctcctcagacccgagaagcgcmkgcgggccatggacgccaccggcactggagctggagggaaggcgaagaagggagcggccggtcgcaaggccgytkkgtcgatggaagaagtcggtgacgaggtccgtgaaggccgggctccagttccccgtcggccgcatcgggcgctacctcaaga

SEQ ID NO: 1165 - DNA, 479 bp, Zea mays
  misc_feature: Ceres CLONE 235578-F
  misc_feature: Encodes the peptide sequence at SEQ ID NO. 1166
  misc_feature (452)..(452): n is a, c, t, g, unknown, or other
gatccagcgagagggagcgagtagcagccgcagccggagagctcgccgaggccgccgaagacgaccatggggttctgggcgacgacgctcatcttcgtcctcgccggcgtcgcscatccctcttcacgctcctctgctgcaaccgcgggccctccacaaacctgttccattatgaccttgctgactacagctgtaatttgttgctggatgatgtatgcaatcgtctaccttgctcagatgaagccattgatcaaccccattctgagcggagagtgagcgcmsatctgtattgaacagaacgaaagctagacctgctgtaccattgttcagtccgtgaactttctattcattttggccccacctgatgaaataaataaataaactggcatgatttttttggtgctactcttcacccgtgattagtgtatgcattgtatgatatacgcagtaantaacatctaaatatctgtgtcgatcct

SEQ ID NO: 1166 - protein, 69 aa, Zea mays
  misc_feature: Ceres CLONE 235578-F
  misc_feature (1)..(70): Pfam Name: ATP_synt_H Pfam Description: ATP synthase subunit H
  misc_feature: SWISSPROT Homolog: EC 3.6.3.14 H(+)-transporting two-sector ATPase
MGFWATTLIFVLAGVAHPSSRSSAATAGPPQTCSIMTLLTTAVICCWMMYAIVYLAQMKPLINPILSGE

SEQ ID NO: 1167 - DNA, 466 bp, Zea mays
  misc_feature: Ceres CLONE 235601-F
  misc_feature: Translation starting site: 304
  misc_feature (376)..(376): n is a, c, t, g, unknown, or other
aacaaacctctcctggcacgagatcacgcttctcgttggatcgaacagctagggtttccaagatgttcgggcgcgcgcgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttngaggtggtggcagcagtaggggcagaaggcaggcgaaggggagaggatgtggttcatcctctaaaggtttctctggaggatttgtacaat

SEQ ID NO: 1168 - DNA, 486 bp, Zea mays
  misc_feature: Ceres CLONE 235612-F
  misc_feature: Encodes the peptide sequence at SEQ ID NO. 1169
gttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaagatttatgatggagatgggttcaactacatcaaagaatcttttgaaatggtactcttcaccttattgggttgttgagtgatggtggtgtca

SEQ ID NO: 1169 - protein, 131 aa, Zea mays
  misc_feature: Ceres CLONE 235612-F
  misc_feature (15)..(126): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGRFMMEMGSTTSKNLLKWYSSPYWVVE

SEQ ID NO: 1170 - DNA, 450 bp, Zea mays
  misc_feature: Ceres CLONE 235619-F
  misc_feature: Encodes the peptide sequence at SEQ ID NO. 1171
  misc_feature (119)..(119): n is a, c, t, g, unknown, or other
agtgcgcgcgggctctcttcgtcgtgcggcaactgcgcgaccgccgacgcccgacggcaggtgcaccaggtcttcgtcgaccccttcgcaaggcctcggttccatccttcgccggascncggcccgtcaacaggacttgatctactactcactagcggtgtagaggcgaagaaaagaacttgaccatgarcagcataggcacaggttacgatttgtctgtcacgactttctccccagatggtcgtgtcttccaggtcgagtatgccaccaaggccgtcgacaacagcgggactgttgtggggatcaagtgcaaagatggcattgtcctgggtgtcgagaagctggtaacctcaaagatgatgctggaaggatcaaaccgargattccattcggtgcaccgtcactctggctgggttgtggctggtttagcagcagatgggcaggcaaatt

SEQ ID NO: 1171 - protein, 88 aa, Zea mays
  misc_feature: Ceres CLONE 235619-F
  misc_feature: SWISSPROT Homolog: EC 3.4.25.1 Proteasome endopeptidase complex
  misc_feature (2)..(2): Xaa is any aa, unknown, or other
  misc_feature (66)..(66): Xaa is any aa, unknown, or other
MXSIGTGYDLSVTTFSPDGRVFQVEYATKAVDNSGTVVGIKCKDGIVLGVEKLVTSKMMLEGSNRXFHSVHRHSGWVVAGLAADGQAN

SEQ ID NO: 1172 - DNA, 447 bp, Zea mays
  misc_feature: Ceres CLONE 235651-F
  misc_feature: Translation starting site: 81
  misc_feature: Pfam Name: FMN_red Pfam Description: NADPH-dependent FMN reductase
  misc_feature: SWISSPROT Homolog: EC 1.6.5.2 NAD(P)H dehydrogenase (quinone)
  misc_feature (89)..(89): n is a, c, t, g, unknown, or other
  misc_feature (439)..(439): n is a, c, t, g, unknown, or other
accagcaccagcacggcgaccaaccctctcccaacccgactagtcggactcgcagctccgccccaagtccaggtcgaagcatggaagtngcggcggcgtcggcgaggcccgtcctgcgcgtggctgccatctgcggctccctccgcaaggcctccttcaaccgcggcctcctccgcgccgccgsgrgttggttgcgaggactccatcccggggctccgcatcgacgagctcgacatctccgacctgcccatcatcaacaccgacctcgagaccgggcagcggcagcagcaccgtcttcccgcccgccgtcgaggccttccgcgccaaggtctgccaggccgactgcttcctcttcggcgcgcccgagtacaactcactccatcgccaccccgctgaagaaccgcacttgactggggcctctagaggaaagaaactgttnggcagaca

SEQ ID NO: 1173 - DNA, 405 bp, Zea mays
  misc_feature: Ceres CLONE 235723-F
  misc_feature: Translation starting site: 70
  misc_feature (225)..(225): n is a, c, t, g, unknown, or other
  misc_feature (227)..(227): n is a, c, t, g, unknown, or other
  misc_feature (323)..(323): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcanyntagggcacgggtgcccccgtctacctcgccgccgtcctggagtacctcgcggccgaggtgctcgagctcgccgggcaacgcggcaagggacaacangaagacgcgcatcatcccgcgccacgtgctcctcgccatccgcaacgacgaggagctcggcaagctgctggccggcgtcacc

SEQ ID NO: 1174 - DNA, 653 bp, Zea mays
  misc_feature: Ceres CLONE 235780
  misc_feature: Encodes the peptide sequence at SEQ ID NO. 1175
aagtcgttgacacaaagagaaattccacagccggggggcaaggctttaattgccccctctccctccctcgcctccttcaccatcccaccgagctttgcaacagctagtagcatgggcaagctgtgctgcagccaggaagacgacgagccggcgttcaacctcctggggctgctcgtcaccgtcgtcctcgccctgctcctgctcatgctgtgcacgccgccccgccgcagcgttgcggtcgcctactacccccgttactgctaggacaggacggacgcggtggcggtggcacacgccgtcgagcttcagccttcttcgaggtagggaggaaaggatcaatcttctgctctgctctgcgatgggcgccgaggtaggcatcagacgtggagttcaattcgagtccgasttgtggagtatacaataaatcatgctggattgtttgtttgtatgtaaaagcgttctgttattattggtaaatcaatgtgcctactgcgtaaggctggtcggtctgtaacctgatccgagagtctgtctgttggtaaaaaattaattgactactggaatttgttgaaaaaaaaaaaaaaaaaaaaaaaaaaaaaaaaaaaaaaakaagaaaaaaaaaaaaaaaaaaaaaargaaaaaaaaaaaaaaaa

SEQ ID NO: 1175 - protein, 50 aa, Zea mays
  misc_feature: Ceres CLONE 235780
MGKLCCSQEDDEPAFNLLGLLVTVVLALLLLMLCTPPRRSVAVAYYPRYC

SEQ ID NO: 1176 - DNA, 441 bp, Zea mays
  misc_feature: Ceres CLONE 235797-F
  misc_feature: Encodes the peptide sequence at SEQ ID NO. 1177
  misc_feature (52)..(52): n is a, c, t, g, unknown, or other
  misc_feature (300)..(300): n is a, c, t, g, unknown, or other
  misc_feature (390)..(390): n is a, c, t, g, unknown, or other
ctactcccaaaatcccaaaaccctagctcgctaacgaccccaggcagacgcnccgtcctcccctcccccatggcgctcaagcagaagggcaccgacgccgccgccaccgacaccggtaccaagaagcgccgccgcgtcttcttctccgacaccgatgctggtgttgaggcaaatgagtgtatgawagtgtttctagtatggaatccaggcgaggtgggctctgtagactgcactgctattcagccatttgacctaaaccatttttttggtgaaagatgggaaaatatatggttacaaaantcttaggataaatgtgtggataagtgcgaaatctttccatgggatatgctgatgtttcatttgacgaaacatctgatggagggaaaggantaacagatctaaagcctgttcttcagaacatttttggagaaaagctctggc

SEQ ID NO: 1177 - protein, 78 aa, Zea mays
  misc_feature: Ceres CLONE 235797-F
  misc_feature: SWISSPROT Homolog: EC 2.3.1.48 Histone acetyltransferase
  misc_feature (39)..(39): Xaa is any aa, unknown, or other
  misc_feature (77)..(77): Xaa is any aa, unknown, or other
MALKQKGTDAAATDTGTKKRRRVFFSDTDAGVEANECMXVFLVWNPGEVGSVDCTAIQPFDLNHFFGERWENIWLQXS

SEQ ID NO: 1178 - DNA, 145 bp, Zea mays
  misc_feature: Ceres CLONE 235815-F
aaacgcccaggcacacacgacacgaaccaggcaaccagctgcggacggaggaaccctagcggaacactgagcaggtgacggcggcgcgctaccggtgacggggatacggcggcatcggcccctcctccatccccggcgcggcggc

SEQ ID NO: 1179 - DNA, 166 bp, Zea mays
  misc_feature: Ceres CLONE 235841-F
  misc_feature (105)..(105): n is a, c, t, g, unknown, or other
gagaatagctaggccgcgccgacgccgaaccgcagcagacacgcgcgcggacagstacgagggagggagctgcctgaggtagaggaggaggagaacatgcagggnggcggcggcgtggaccagccgcgattgcagatggtgctgcgggtgaggcacccgtcgtcgc

SEQ ID NO: 1180 - DNA, 124 bp, Zea mays
  misc_feature: Ceres CLONE 235847-F
gaaaaaacaacaacaacaacccgcacaacggcacgattctyctcctccgtccgcgtmtctcggtttcggcgatgtcggggcgcggcaagggcggcaaggggctgggcaagggcggcgcaagcgc

SEQ ID NO: 1181 - DNA, 402 bp, Zea mays
  misc_feature: Ceres CLONE 235893-F
  misc_feature: Encodes the peptide sequence at SEQ ID NO. 1182
  misc_feature (334)..(334): n is a, c, t, g, unknown, or other
aaccaccccgcttccccygaccgcgtctcggagcacccttctcaaccgcatcctgcctctgctcggtgtcgccgtctcgactgcaggagaggggagcgccccgtcgccgatctgatcgggagccggagcaagcgtcgaggtgagcccgtcagaaccgccatggcagcggccgccgmcgattccgacaccgccgcagctgtgcgcgccatgtccacctgcgcccactktcagcgagaaatcccatcttcgaacatcgacttgcactctgtacattgcgcccgcaacctccgaaagttccagcactgtggcgaaatgattcctaggaaacttatgngatgaacattatgatgaaaaccatgccccgatcaattgctccctttgttraagaaacaatagaacgtg

SEQ ID NO: 1182 - protein, 58 aa, Zea mays
  misc_feature: Ceres CLONE 235893-F
  misc_feature (6)..(6): Xaa is any aa, unknown, or other
  misc_feature (23)..(23): Xaa is any aa, unknown, or other
MAAAAXDSDTAAAVRAMSTCAHXQREIPSSNIDLHSVHCARNLRKFQHCGEMIPRKLM

SEQ ID NO: 1183 - DNA, 238 bp, Zea mays
  misc_feature: Ceres CLONE 235904-F
  misc_feature: Encodes the peptide sequence at SEQ ID NO. 1184
  misc_feature (124)..(124): n is a, c, t, g, unknown, or other
  misc_feature (183)..(183): n is a, c, t, g, unknown, or other
aacaaatcgaaacaaagaaagaaaaaatcgagaggacgccagggccgattctctgcgtgacttggggcgtcgtcgcgagttttctccggccgagggcggcgcgaccggacaaccagcgtgascngaccggcgacatgactcgcggcaaccagcgtgaccgcgaccgtgagcgcgcggcggcgnaaagcccaacgccaagaactcccagggacgggctcaccccggagcagcgccgcga

SEQ ID NO: 1184 - protein, 34 aa, Zea mays
  misc_feature: Ceres CLONE 235904-F
  misc_feature (17)..(17): Xaa is any aa, unknown, or other
MTRGNQRDRDRERAAAXSPTPRTPRDGLTPEQRR

SEQ ID NO: 1185 - DNA, 439 bp, Zea mays
  misc_feature: Ceres CLONE 235939-F
  misc_feature: Encodes the peptide sequence at SEQ ID NO. 1186
  misc_feature (308)..(308): n is a, c, t, g, unknown, or other
atccgcttctgtcagttccttttctaaaagaaaaaaatacagtcgcatctcgcctccagcagggtgagttcgcctcggcagggtgtggcataccatggagagctcgtcgccgtcagtgccgttcccgcctgcaggcccggtcgagagcacctaccgcgcctgcaccatcccctamcgtttcccctccgacaacccgcgywaggccacccctgtcgagatccaatggattgacctctttctcaactctgtcccgtccttcaaacagcgggcggagaacgaccccaccgtacccgatgcgcccgcgaaanaggtaagttcgcgcagaggttacacgtcaatgcttgaagagttgaagagaatccggagagccatggaggaccaccagattgcatacttctttgtaggcttcgtgagctaggtactcagagagctgggattt

SEQ ID NO: 1186 - protein, 107 aa, Zea mays
  misc_feature: Ceres CLONE 235939-F
  misc_feature (27)..(27): Xaa is any aa, unknown, or other
  misc_feature (36)..(36): Xaa is any aa, unknown, or other
  misc_feature (72)..(72): Xaa is any aa, unknown, or other
MESSSPSVPFPPAGPVESTYRACTIPXRFPSDNPRXATPVEIQWIDLFLNSVPSFKQRAENDPTVPDAPAKXVSSRRGYTSMLEELKRIRRAMEDHQIAYFFVGFVS

SEQ ID NO: 1187 - DNA, 471 bp, Zea mays
  misc_feature: Ceres CLONE 235961-F
  misc_feature: Encodes the peptide sequence at SEQ ID NO. 1188
acgaaacccacagcaaaaccggaacagaaagccttggaagcctaggcgaascagaactgggaaggggagaagattctgatggggactaagawacagggaggaggcggaggawaccagawggtcctcctctggagctgccggtggtcacctctaaggagctcggcaagataggccccgccctcggaatcggcatcggctgcggcgccggcgcaggcatcggattcttcggtggtgcagggttaggctatggatttcctggactcacattaggctttggagttggagctggatgtggtgtgggaattggctttggttatggcttgggcaaaggaattgcatatgatgaaaagaaaaaatactccaatgttggcaagatgttccaggaagctccacattttcctatggacactgtcggtgctttatttgacgagctggttataaacaccaagaagcttgtgacatcaacatcaa

SEQ ID NO: 1188 - protein, 32 aa, Zea mays
  misc_feature: Ceres CLONE 235961-F
MFQEAPHFPMDTVGALFDELVINTKKLVTSTS

SEQ ID NO: 1189 - DNA, 571 bp, Zea mays
  misc_feature: Ceres CLONE 235980
  misc_feature: Encodes the peptide sequence at SEQ ID NO. 1190
aaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaatttgaatatctgaacaattgaataagaaaaaaaaaaaaaaaa

SEQ ID NO: 1190 - protein, 130 aa, Zea mays
  misc_feature: Ceres CLONE 235980
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDEIDAMLHQTGCCSPIGFSFSTVLSLLPTQFRSCPLCVCEAAILELLFV

SEQ ID NO: 1191 - DNA, 414 bp, Zea mays
  misc_feature: Ceres CLONE 236016-F
  misc_feature: Encodes the peptide sequence at SEQ ID NO. 1192
  misc_feature (143)..(143): n is a, c, t, g, unknown, or other
  misc_feature (144)..(144): n is a, c, t, g, unknown, or other
  misc_feature (148)..(148): n is a, c, t, g, unknown, or other
  misc_feature (361)..(361): n is a, c, t, g, unknown, or other
atccagtcgcatctycctctccgaaatcaaggtagcgtacaccgctgcagtttctagagccctctctgccactcgtgatcccactagtcacaatgcctgcyctcgccaagcccgcctcccgcaccgccaagcccgccgcggbnncgangccgaagcctgccgccgccaagccgamscccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccanggggcaagctcgtgaaggtcaaggcttcgtacagctctcggacgccgccaaga

SEQ ID NO: 1192 - protein, 107 aa, Zea mays
  misc_feature: Ceres CLONE 236016-F
  misc_feature (34)..(104): Pfam Name: Linker_histone Pfam Description: linker histone H1 and H5 family
  misc_feature (17)..(17): Xaa is any aa, unknown, or other
  misc_feature (18)..(18): Xaa is any aa, unknown, or other
  misc_feature (19)..(19): Xaa is any aa, unknown, or other
  misc_feature (28)..(28): Xaa is any aa, unknown, or other
  misc_feature (90)..(90): Xaa is any aa, unknown, or other
MPALAKPASRTAKPAAXXXPKPAAAKPXPTAGASHPPYFEMIKEAITALKERTGSSSQAIAKYVGDKHGASLPANFKKMLSIQLRGSAAXGQAREGQGFVQLSDAAK

SEQ ID NO: 1193 - DNA, 171 bp, Zea mays
  misc_feature: Ceres CLONE 236040-F
accgaattcgagacctccaattccctcgtagcagcagcaccagtagagtctccttcctctccggcggcgatgtctgggcgcggcaagggcggcaaggggctgggcaagggcggcgcaagcggcaccsaacgtcccgcgacaacatccaagggatcacgaagccggcgatcc

SEQ ID NO: 1194 - DNA, 447 bp, Zea mays
  misc_feature: Ceres CLONE 236153-F
  misc_feature: Encodes the peptide sequence at SEQ ID NO. 1195
  misc_feature (195)..(195): n is a, c, t, g, unknown, or other
  misc_feature (196)..(196): n is a, c, t, g, unknown, or other
aatttttggtgagtgcgccctttcccttcctccccagatccccgtccccgttttccacttttgcctccgccccaattcggataacaaacccctccgcctcgtcgcgtctcctcccagccgagccgatccggtagcagagagggagagggagggactgagggaggaggagcygggttccggtcccggccgcccggnncttgcgcgattcgattgcagctctcgtccccgggcggcgtccaggatggtgcggggcaagacgcagatgaagcggatagagaacccgaccagccgccagtcaccttctccaagcgccgcaaacggcctgctcaagaaggcgttcgagctctccgtcctctgcgacgccgaggtcgccctmcgtcgtcttctcccggcgcggcaagctctacgaattcgccagcggaagtgcgcagaaaacgattgaacgtt

SEQ ID NO: 1195 - protein, 66 aa, Zea mays
  misc_feature: Ceres CLONE 236153-F
  misc_feature (9)..(60): Pfam Name: SRF-TF Pfam Description: SRF-type transcription factor (DNA-binding and dimerisation domain)
MVRGKTQMKRIENPTSRQSPSPSAANGLLKKAFELSVLCDAEVALRRLLPARQALRIRQRKCAEND

SEQ ID NO: 1196 - DNA, 390 bp, Zea mays
  misc_feature: Ceres CLONE 236158-F
  misc_feature: Encodes the peptide sequence at SEQ ID NO. 1197
accgacccaaaccctagcgcgcacccacctcccttcccctttcccggcgtgcggtccggcgttggagatgcgggggctgctcgcggacggcgggatggcgctggcgatggcgccggagttaacgagtcgtcgggcggtgctgcgttgtcgcagggtctgttatggtgggcgtcggagtgccacggggtgttgtacagccttgcgtgatgctgccgtcgctggccttcgtgggattcctagcatggcaggcgcggcggacttccgtagctcagctacggccgctctcacgtcgtcgtcgtcgcgtactacggcttcctctgggtcgtcgccgtactcaacctcctctggtgctttcctgcaggcatggcaatgtatgcctgacagggcatt

SEQ ID NO: 1197 - protein, 68 aa, Zea mays
  misc_feature: Ceres CLONE 236158-F
TDPNPSAHPPPFPFPGVRSGVGDAGAARGRRDGAGDGAGVNESSGGAALSQGLLWWASECHGVLYSLA

SEQ ID NO: 1198 - DNA, 230 bp, Zea mays
  misc_feature: Ceres CLONE 236164-F
  misc_feature (105)..(105): n is a, c, t, g, unknown, or other
  misc_feature (166)..(166): n is a, c, t, g, unknown, or other
aaagataaaatcgagaggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagcgcgcggcggcganagcccaacgccaagaactcccaggacgggctcaccccggagcagcgccgcgaggagggacaaga

SEQ ID NO: 1199 - DNA, 349 bp, Zea mays
  misc_feature: Ceres CLONE 236177-F
  misc_feature: Encodes the peptide sequence at SEQ ID NO. 1200
tccgtgcatacatgctcattgctcaccaagggcaaggraggaggagaggacacacagcagtagcggcgaaatggcggcgatgatgatggatagtaccgcggagaaagacctcgccggckacvtttgcggtgagcgggcacgggcaggacttggagcggtcttgccatgaccaggaagcccgccgctgcagatggtgcgagcagcagagggcctagccatcgggcgtttcgtacgggagctgatggtggagggcgtggcgtcgttmctgctggtgttctggtccgcggtggcgcsgctgatscaggagatgcacggcacgctgacgttcccccatggtgttgcctcgwtc

SEQ ID NO: 1200 - protein, 52 aa, Zea mays
  misc_feature: Ceres CLONE 236177-F
  misc_feature (25)..(25): Xaa is any aa, unknown, or other
  misc_feature (35)..(35): Xaa is any aa, unknown, or other
  misc_feature (37)..(37): Xaa is any aa, unknown, or other
MVRAAEGLAIGRFVRELMVEGVASXLLVFWSAVAXLXQEMHGTLTFPHGVAS

SEQ ID NO: 1201 - DNA, 438 bp, Zea mays
  misc_feature: Ceres CLONE 236190-F
  misc_feature: Encodes the peptide sequence at SEQ ID NO. 1202
argtagttctggttgatttggtcctagatggcggaggaaaaagtggggcggatcttcgtcggcgggctgtcgtggaacaccacggagcgcacgctcgagcgcaccttcggtcagtacggcaaggtcatcgaggctcaggttgtagtggaaagggagacaggccgctctaggggatttggatttgtmacattttcagaacctcgggctgtggatgctgccattcggggaatgcataacggagaactggatggccgcaatatttctgtgaacaaagctgaacctaggaactctgatggctatggatatggtggtggtggtggtggtggttactcgtccggtggtagaggtggatatcgtagtggagctgatgtagttccagcagccagtgatgattgtttcaaatgtggccgtcctggacattgggctcgtgaatggtac

SEQ ID NO: 1202 - protein, 137 aa, Zea mays
  misc_feature: Ceres CLONE 236190-F
  misc_feature (9)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAEEKVGRIFVGGLSWNTTERTLERTFGQYGKVIEAQVVVERETGRSRGFGFVTFSEPRAVDAAIRGMHNGELDGRNISVNKAEPRNSDGYGYGGGGGGGYSSGGRGGYRSGADVVPAASDDCFKCGRPGHWAREWY

SEQ ID NO: 1203 - DNA, 148 bp, Zea mays
  misc_feature: Ceres CLONE 236195-F
  misc_feature (30)..(30): n is a, c, t, g, unknown, or other
aacaacagcgaacacatctcctcgcatttnttcccatccgatccccccttcgcaaccaaaaccccaactcgccbhgcatcgatggcgcccaaggccgagaagaaacccgcggcgaagaagccggcggaggaggagcycgcggccgaga

SEQ ID NO: 1204 - DNA, 125 bp, Zea mays
  misc_feature: Ceres CLONE 236303-F
  misc_feature (75)..(75): n is a, c, t, g, unknown, or other
accaaagtccaagcaccttcccaaaaaatcccccattttcttcgaggcgaggagagcgtgaaagacagggcacgncagcgacgatgtcggggcgcggcaagggcaaaggtctgggcaagggcgga

SEQ ID NO: 1205 - DNA, 368 bp, Zea mays
  misc_feature: Ceres CLONE 236310-F
  misc_feature: Encodes the peptide sequence at SEQ ID NO. 1206
  misc_feature (20)..(20): n is a, c, t, g, unknown, or other
  misc_feature (26)..(26): n is a, c, t, g, unknown, or other
gcaccattttkgcaacccbncagacnaaaagaaaggcgaaacgaggccaccagctcaccgccgagcgtaabbcgccgagcaaccaacccctctcctcgtccgccgccgtctccccggaccatggccatggccgccgcttcctcccggctgctctgggcgtcccgcgcgccgcctaacctcaggatctccaccttccccagggccttctccaccgtgctgaaggatctgaagtatgctgacactcatgaatgggtgaaakttgagggtgattcagcaaccgtggggattactgaccatgcccaggaccatttgggtgatgtygtttttgtgggagctaccagaaagttggcatcagtgtatcccaggga

SEQ ID NO: 1206 - protein, 82 aa, Zea mays
  misc_feature: Ceres CLONE 236310-F
  misc_feature (47)..(47): Xaa is any aa, unknown, or other
MAMAAASSRLLWASRAPPNLRISTFPRAFSTVLKDLKYADTHEWVKXEGDSATVGITDHAQDHLGDVVFVGATRKLASVYPR

SEQ ID NO: 1207 - DNA, 274 bp, Zea mays
  misc_feature: Ceres CLONE 236386-F
  misc_feature: Encodes the peptide sequence at SEQ ID NO. 1208
  misc_feature (179)..(179): n is a, c, t, g, unknown, or other
gtttatctcacgccgcaacctccctcgagcccgagcwaacaagggcggacgcggascggcggcgtasggacgatggcggagaagaagcgaggcgccggcactcgcaaggatgaggtggtgacacgcgagtacactatcaacctccacaaacgcctccacggatgmacctttaagaaganggcaccaaatgccatcaaggagatcaggaagttcgctcagaaggccatgggtactactgatgtccggattgacgtgaagctcaacaaggcacatc

SEQ ID NO: 1208 - protein, 67 aa, Zea mays
  misc_feature: Ceres CLONE 236386-F
  misc_feature (11)..(67): Pfam Name: Ribosomal_L31e Pfam Description: Ribosomal protein L31e
  misc_feature (31)..(31): Xaa is any aa, unknown, or other
  misc_feature (36)..(36): Xaa is any aa, unknown, or other
MAEKKRGAGTRKDEVVTREYTINLHKRLHGXTFKKXAPNAIKEIRKFAQKAMGTTDVRIDVKLNKAH

SEQ ID NO: 1209 - DNA, 235 bp, Zea mays
  misc_feature: Ceres CLONE 236399-F
  misc_feature (168)..(168): n is a, c, t, g, unknown, or other
awtttytcgcgctcctaccgccgccgcttcgttctctaaccttggctcccgctccctccgcagcatctcaacaccgccttgaggaccccccaactcgccggctgcagcatggtgaaatattcgacggagccaaccarccccaccaagtyaaccaaggccatgggcgtnggacctacgtgttcacttcaagaacacccgtkagacagcttttgcccttaggaagttgtcactcacc

SEQ ID NO: 1210 - DNA, 358 bp, Zea mays
  misc_feature: Ceres CLONE 236445-F
  misc_feature: Pfam Name: Ribosomal_L29 Pfam Description: Ribosomal L29 protein
  misc_feature (14)..(14): n is a, c, t, g, unknown, or other
  misc_feature (106)..(106): n is a, c, t, g, unknown, or other
gccatccatttttnatatcctcactcgccgccgccgccgctcgtccctcgccccatcgcgatggcccggatcaaggtgcacgagctgcgggggaagagcaaggcgnatctgcaagckcvttaaggagtttaagtcggagctctccctgctacgcgtaccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctdhcgctcgacctccgccccaagaagacccgcgccatccgcagcgcctcaccaaggcaccagctct

SEQ ID NO: 1211 - DNA, 231 bp, Zea mays
  misc_feature: Ceres CLONE 236453-F
  misc_feature: Encodes the peptide sequence at SEQ ID NO. 1212
  misc_feature (138)..(138): n is a, c, t, g, unknown, or other
  misc_feature (206)..(206): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcrncgaagaagtcggtgtcgcggtcctccagggcacgtgctgcagttccccgtcagccgcgtcgggcggtnacctcaaaaagggccggtacgcgca

SEQ ID NO: 1212 - protein, 77 aa, Zea mays
  misc_feature: Ceres CLONE 236453-F
  misc_feature (30)..(30): Xaa is any aa, unknown, or other
  misc_feature (46)..(46): Xaa is any aa, unknown, or other
  misc_feature (69)..(69): Xaa is any aa, unknown, or other
THTFRLSTPKVPFFFSIWKRRSSSHGRERXGGKAKKGAAGRKAGGXRRSRCRGPPGHVLQFPVSRVGRXPQKGPVRA

SEQ ID NO: 1213 - DNA, 123 bp, Zea mays
  misc_feature: Ceres CLONE 236479-F
atcaccaatcagtcagtcacagctcacagcaaacaccgcgamcgcccccgctcccaaacccgaccgagcaaagcsaaagccccccaaccgcggatcaatccgcagcatcgatggcgcccaagg

SEQ ID NO: 1214 - DNA, 175 bp, Zea mays
  misc_feature: Ceres CLONE 236495-F
accagaatccgcgaatcacagacgcgtctatctcagcttgctgcactgcactaccctgccctgccatcatatcgtacgtgagcccggccgagcgagarvgggaggaggcatggctgctccgaagctcgcgacgctggcgctggccgtgctcctggcggcgaccgtggtggctccc

SEQ ID NO: 1215 - DNA, 248 bp, Zea mays
  misc_feature: Ceres CLONE 236496-F
  misc_feature: Translation starting site: 154
  misc_feature: Pfam Name: UPF0139 Pfam Description: Uncharacterised protein family (UPF0139)
  misc_feature (85)..(85): n is a, c, t, g, unknown, or other
  misc_feature (107)..(107): n is a, c, t, g, unknown, or other
agcttcgatccccagaggcacagacgagacgacagagatgaaggacggaacygtcggggggaggggcgttcgctgcgggcagatnccaaggcagccgtcgacggganasrtacgcgccgccgaagctgtcgccccaggacctacccatcgactatgcaggcttcctcgacgtcgccttcggtcctcggcgtcatgctccgctacaaggtgtsctcgtggatcgcaatcatcttctgcgctcagtcgtt

SEQ ID NO: 1216 - DNA, 143 bp, Zea mays
  misc_feature: Ceres CLONE 236501-F
gaaaaaaaaacgtgctgtcttcccgtctcttcccaatgcggcgtctcgctctcctcttcctcctgcytctcctcctcgccaccggtcgaccacggcgtcacgggcccgcgacccctcccgcctctcctcctcctcctcctcct

SEQ ID NO: 1217 - DNA, 456 bp, Zea mays
  misc_feature: Ceres CLONE 236522-F
  misc_feature: Translation starting site: 248
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgggtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctycctgttcgactagagttgtgtgtgtcatct

SEQ ID NO: 1218 - DNA, 234 bp, Zea mays
  misc_feature: Ceres CLONE 236560-F
  misc_feature (42)..(42): n is a, c, t, g, unknown, or other
  misc_feature (43)..(43): n is a, c, t, g, unknown, or other
  misc_feature (176)..(176): n is a, c, t, g, unknown, or other
aactacaccacaccgcaccggcaccaccaccaaccgagcggnncaggctcctgctcaggaaggggagaagaggcgagcmttccttgggaagtcgcaggaggagagaaggggaacaaagatggggcgcggcaagatcgagatcaagctgatcgagaactccaccaaccgccagtganccttctccaagcgccgcaacgggatcctcaagaaggcgcgggagatcagcgtgctctg

SEQ ID NO: 1219 - DNA, 96 bp, Zea mays
  misc_feature: Ceres CLONE 236637-F
  misc_feature (37)..(37): n is a, c, t, g, unknown, or other
aaaaaaggaaaggaaaggacaaaggagcggcggcganggtctatggcgtcgacggctgggtacctggamgcggcgggcggcgcagaaggagcgggt

SEQ ID NO: 1220 - DNA, 176 bp, Zea mays
  misc_feature: Ceres CLONE 236648-F
  misc_feature (34)..(34): n is a, c, t, g, unknown, or other
  misc_feature (105)..(105): n is a, c, t, g, unknown, or other
  misc_feature (165)..(165): n is a, c, t, g, unknown, or other
  misc_feature (166)..(166): n is a, c, t, g, unknown, or other
atctccctgtttaatcaatccttcaagcgcaasngcctcctcctcgtcgtccggtcgtgagaagggatggcgggccgtggcaaggctatccggcgctggcgccgnaagtaaggcaacgtcgaggagctccaaggccgggactccagttccccgtcggcaggattnnaggttcctca

SEQ ID NO: 1221 - DNA, 359 bp, Zea mays
  misc_feature: Ceres CLONE 236759-F
  misc_feature: Translation starting site: 128
  misc_feature: Pfam Name: Proteasome Pfam Description: Proteasome A-type and B-type
  misc_feature: SWISSPROT Homolog: EC 3.4.25.1 Proteasome endopeptidase complex
  misc_feature (145)..(145): n is a, c, t, g, unknown, or other
gcaacaaagcaaagcaggcctccggctccctgaactgacttcagaagtcaccaacgcacccagcacagdhagaagaccctcgccggacgctcgctctcgccggggacaactcaatcccgaggccaggatggccgctacgatcgcncgatcaccgtgttctcacccgacggccacctcttccaggtcgagtacgccctcgaggccgtccgcaaggcaacgcgctgtcggstccgcggcgtcgacaccgtcgtcctcggcgtcgagaagaagtccacccccaagctccaggactccaggtccgtgcgcaagatcgtgagcytggacacccacatcgcgctggcgtgcgcgggggctcaagg

SEQ ID NO: 1222 - DNA, 187 bp, Zea mays
  misc_feature: Ceres CLONE 236773-F
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
aactcgacttgaacacggccagcgtctcatcggctgggcgtggtctacactgcacgcacacttaccaccagccaccgcaagnnnntcactagccggaagacaggccaaccccactgctagtgctaggaatctaggagcgagaacgagagaccatgtcctcagaggccagcagcgtcgtcgtcgccga

SEQ ID NO: 1223 - DNA, 183 bp, Zea mays
  misc_feature: Ceres CLONE 236801-F
ccattgtttccatccgcaccggaggcgtgccgatacaagcaacggcaacgctcccctctcctccacctccccacctatattgattctgattcatmcacccagcaggcagcagcdvacagcaagatggtgcaccmgatcgcggaggmcgacgagcggacamcttcggccgcctaacgccggacg

SEQ ID NO: 1224 - DNA, 160 bp, Zea mays
  misc_feature: Ceres CLONE 236847-F
  misc_feature: Encodes the peptide sequence at SEQ ID NO. 1225
  misc_feature (29)..(29): n is a, c, t, g, unknown, or other
acctagtacccagtaaatggaggcgctcntggtgcggcactgggcgatcccaccctgccccctggcggtgaagctccccgttcgccgcggtytctggggatcacccagtgccggagtdbctcatcgccgacggctgtccgagtgcgagtcgcggcgacca

SEQ ID NO: 1225 - protein, 48 aa, Zea mays
  misc_feature: Ceres CLONE 236847-F
  misc_feature (5)..(5): Xaa is any aa, unknown, or other
  misc_feature (26)..(26): Xaa is any aa, unknown, or other
  misc_feature (35)..(35): Xaa is any aa, unknown, or other
MEALXVRHWAIPPCPLAVKLPVRRGXWGSPSAGVXHRRRLSECESRRP

SEQ ID NO: 1226 - DNA, 456 bp, Zea mays
  misc_feature: Ceres CLONE 236893-F
  misc_feature: Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: SWISSPROT Homolog: EC 2.7.11.25 Mitogen-activated protein kinase kinase kinase
  misc_feature (103)..(103): n is a, c, t, g, unknown, or other
  misc_feature (341)..(341): n is a, c, t, g, unknown, or other
  misc_feature (402)..(402): n is a, c, t, g, unknown, or other
gatctgcttctccagtctccacacaacacaacagagcagaaggcagcacgggcgctgatgtcgatgggggaggcgctgcgggcggctgcgcaagagcatgttntgttgtggtcgaatatctcgctggaggatcactgaagcagtatttaataaagaacaggcgaaggaagcttgcatacaaggttgttgttcagatagcactggatcttgccagaggattgaactatctacattcaagaaagatagtacatcgggatgtaaaaactgaaaatatgctgctcgatacacagcgaaacctctaagattgctgattttggtgttgctcgtgttgaggctcagantccaaaggacatgacaggcgcgactgggacacttggctacatggccccagaggtgcttganggcaagccatacaacagaaggtgtgatgtctacagttttggcatatgcttatgg

SEQ ID NO: 1227 - DNA, 115 bp, Zea mays
  misc_feature: Ceres CLONE 236910-F
agaaaaacgcattccgcagacgcgcggcgagggagtaggaggcgacggcgggtgccgaggcccgcagcacggggaagctaccggctagcgtaccggagcgggctcgcgctttgct

SEQ ID NO: 1228 - DNA, 317 bp, Zea mays
  misc_feature: Ceres CLONE 236934-F
  misc_feature: Encodes the peptide sequence at SEQ ID NO. 1229
actaccgcagccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcggtakgcaaacggcgcmtcgggccggccgcgtcgsgatgcaagggcactccgtacctacatgaacgcggggattcccaagcggttcaaagaggatgaggagaaagaacagcttggcaaaakatctcgcaaaagattggaatgctgtgtttgaaaggagcatcaatacat

SEQ ID NO: 1229 - protein, 34 aa, Zea mays
  misc_feature: Ceres CLONE 236934-F
  misc_feature (16)..(16): Xaa is any aa, unknown, or other
  misc_feature (20)..(20): Xaa is any aa, unknown, or other
  misc_feature (26)..(26): Xaa is any aa, unknown, or other
MASLLARQAAQALRGXQTAXRAGRVXMQGHSVPT

SEQ ID NO: 1230 - DNA, 419 bp, Zea mays
  misc_feature: Ceres CLONE 236975-F
  misc_feature: Encodes the peptide sequence at SEQ ID NO. 1231
  misc_feature (108)..(108): n is a, c, t, g, unknown, or other
acagccacatctctccactgctccgtccagcgcgtccacctcccaaacccctactcccccaggaagcaatggcttcccccacccagggccaggtcatcacctgcaaancggcggtggcgtacgagccgaacaagccgctcgtgatcgaggacgtgcaggtggcgccgccgcagscggcaagggtcccgcgtcaagatcctcttcaccgcgctctgccacaccgaccactacacctggagcggtctaaggatcctgagggtctttttccttgcattcttggccacgaagctgccggaattgtggaaagtgtcggtgaaggagtaactgatgtgcagcctgggggatcatgtmattccttgctaccaagcagaatgcaaggaatgcaagttttgcaaggagcggaaagaccaacctctgtg

SEQ ID NO: 1231 - protein, 117 aa, Zea mays
  misc_feature: Ceres CLONE 236975-F
  misc_feature (1)..(91): SWISSPROT Homolog: EC 1.1.1.1 Alcohol dehydrogenase
  misc_feature (66)..(99): SWISSPROT Homolog: EC 1.1.1.251 Galactitol-1-phosphate 5-dehydrogenase
  misc_feature (14)..(14): Xaa is any aa, unknown, or other
  misc_feature (36)..(36): Xaa is any aa, unknown, or other
  misc_feature (95)..(95): Xaa is any aa, unknown, or other
MASPTQGQVITCKXAVAYEPNKPLVIEDVQVAPPQXARVPRQDPLHRALPHRPLHLERSKDPEGLFPCILGHEAAGIVESVGEGVTDVQPGGSCXSLLPSRMQGMQVLQGAERPTSV

SEQ ID NO: 1232 - DNA, 126 bp, Zea mays
  misc_feature: Ceres CLONE 236978-F
aagtaggtagatcgatgccgctaacagtaacacagagcaaaagactccaattttcccacggctactgaatcacggatgcttaartctccccaatccgtatctctgtttccctcacagcgcggctgc

SEQ ID NO: 1233 - DNA, 368 bp, Zea mays
  misc_feature: Ceres CLONE 236985-F
  misc_feature: SWISSPROT Homolog: EC 3.5.1.52 Peptide-N(4)-(N-acetyl-beta-glucosaminyl)asparagine amidase
  misc_feature (134)..(134): n is a, c, t, g, unknown, or other
gagagaaagtcagatccgtgttccgtgtccgcgtccagtgtgtccgctactccgctccccctcagtcctcagttcctcacctagcggtaskgcgcgcggggagacgtagatggcggcttcggaggcggcasggnggcggcaacaccggtgacgcgaaaagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgtttgttttcctgaaagttgatgtcgatgaaatgaagaccattg

SEQ ID NO: 1234 - DNA, 173 bp, Zea mays
  misc_feature: Ceres CLONE 237010-F
  misc_feature (98)..(98): n is a, c, t, g, unknown, or other
  misc_feature (102)..(102): n is a, c, t, g, unknown, or other
accagaatccgcgaatcacagacgcgtctatctcagcttgctgcactgcactaccctgccctgccatcatatcgtacgtgagcccggccgagcgagangggnaggaggcatggctgctccgaagctcgcgacgctggcgctggccgtgctcctggcggcagaccgtggtggct

SEQ ID NO: 1235 - DNA, 475 bp, Zea mays
  misc_feature: Ceres CLONE 237026-F
  misc_feature: Encodes the peptide sequence at SEQ ID NO. 1236
  misc_feature (93)..(93): n is a, c, t, g, unknown, or other
  misc_feature (441)..(441): n is a, c, t, g, unknown, or other
aattctacgccctgctgcccaggtcggacggaccctttgccggagacgagcacacgccacagcaggaattatcgggcgtagagcagcgcrtanagaakatccaatggcggcggcggaggggcagtgggtgctcatggcaacggggcggacgcgactaacattgcggtgatcaagtactgggggaagcgggacgaggcgctcatcctccccatcaacgacagcatcagcgtaacgctcgaccctgaccatctctccgccaccaccactgtcgccgtcakhccctcattcccttccgaccgcatgtggctcaatggcaaggagatctcgctattaggaggaaggtttcagagctgcctcagagaaatcagaaagcgtgctcgtgacttttgaggacaaggagaagggcgtcaagatcaagaaagaggactggggacaagtttncatgttcacatagcctcgtacaacaacttcccac

SEQ ID NO: 1236 - protein, 29 aa, Zea mays
  misc_feature: Ceres CLONE 237026-F
MWLNGKEISLLGGRFQSCLREIRKRARDF

SEQ ID NO: 1237 - DNA, 89 bp, Zea mays
  misc_feature: Ceres CLONE 237057-F
  misc_feature: Encodes the peptide sequence at SEQ ID NO. 1238
agaaaaaatcgagaggacgccggggccgattctctgcgtgacttggggcgtcgtcgcgagttttctccggccgagggcggcgcgaccgg

SEQ ID NO: 1238 - protein, 29 aa, Zea mays
  misc_feature: Ceres CLONE 237057-F
RKNREDAGADSLRDLGRRREFSPAEGGAT

SEQ ID NO: 1239 - DNA, 144 bp, Zea mays
  misc_feature: Ceres CLONE 237086-F
  misc_feature (76)..(76): n is a, c, t, g, unknown, or other
  misc_feature (77)..(77): n is a, c, t, g, unknown, or other
  misc_feature (106)..(106): n is a, c, t, g, unknown, or other
accattcagcwgccgctgcccccgattgagccgccgccgcctcagattcgccgtcgccacctcwgtttctgccgcnncgccgccgatttggacgctgtcgccggcnaattcagcctccgccgccctggaatttggcctccgccg

SEQ ID NO: 1240 - DNA, 451 bp, Zea mays
  misc_feature: Ceres CLONE 237115-F
  misc_feature: Encodes the peptide sequence at SEQ ID NO. 1241
  misc_feature (59)..(59): n is a, c, t, g, unknown, or other
aacactcatcacgccgccactgatctgctctgttgctggtgactaggagcagtagcgangagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatc

SEQ ID NO: 1241 - protein, 89 aa, Zea mays
  misc_feature: Ceres CLONE 237115-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSGRATRRVARLSPRSKMMVIEFVATNASLVSLRVLAVNLVLTSV

SEQ ID NO: 1242 - DNA, 412 bp, Zea mays
  misc_feature: Ceres CLONE 237119-F
  misc_feature: Encodes the peptide sequence at SEQ ID NO. 1243
  misc_feature (48)..(48): n is a, c, t, g, unknown, or other
  misc_feature (49)..(49): n is a, c, t, g, unknown, or other
  misc_feature (162)..(162): n is a, c, t, g, unknown, or other
aaggaaactcactcccactttactcctatccactgcggcctggacgcnngcragavgmttgaccaagcagcagcagcagcagcagcgatggcgcctctgaagctgtacgggatgccgctgtcccccaacgtggtgcgcgtggccaccgtgctcaacgagatnggcctcgacttcgagawcgtccccgtcgacctcaccaccggcgcccacaagcagcccgacttcctcgccctcaaccctttcggccagatcccggctctcgtcgacggagacgaakycttcttcgagtcccgcgcgatcaaccggtacatcgccagcaagtacgcgtcggagggcacggacctgctccccgcgacggcgtcggcggcgactgggaagtstggctggaggtggagtcgcacacttctacccg

SEQ ID NO: 1243 - protein, 108 aa, Zea mays
  misc_feature: Ceres CLONE 237119-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (25)..(25): Xaa is any aa, unknown, or other
  misc_feature (31)..(31): Xaa is any aa, unknown, or other
  misc_feature (64)..(64): Xaa is any aa, unknown, or other
  misc_feature (98)..(98): Xaa is any aa, unknown, or other
MAPLKLYGMPLSPNVVRVATVLNEXGLDFEXVPVDLTTGAHKQPDFLALNPFGQIPALVDGDEXFFESRAINRYIASKYASEGTDLLPATASAATGKXGWRWSRTLLP

SEQ ID NO: 1244 - DNA, 538 bp, Zea mays
  misc_feature: Ceres CLONE 237220-R
gcagtaatgacktggcagggggcaccggactgtccggtgtgcaccggactgtccggtktgccatcgaacagacagaactcccaacggccatatttggtggttggggctataaataccccaaccaccccaccattcattgcatccaagttttccacttcccaactactacaagagctctagcattcaattctagacacaccaaagagatcaaatcctctccaaattccacacaacgccatagtgactagagagagtgatttgcttgtgttctttcgagctcttgcgcttggattgctttcttctttcttgattctctcattgcgatcaaactcacttgtaattgaggcaagagacaccaaacttgtggtggtccttgtgggaactttgtgttccaagtgattgagaagagaaagctcactcgatccgtgggatcgtttgagagagggaagggttgaaagagacccggcctttgtggcctcctcaacggggagtaggtttgcaagaaccgaacctcggtaaaacaaaaaaaaaaaaaaaa

SEQ ID NO: 1245 - DNA, 329 bp, Zea mays
  misc_feature: Ceres CLONE 237225-F
attcaaaatcgatcccgaccttccgctcccgcaagawaggaggagaaaaggaacagaggaagcgavrcaaagcagtcagaggcggccgcgcagcccgccgcagtagcgacacgcaaccccccttcccctatcackycacccgactccacggaggagcgagaccgcgcgccgcagatccttggtcgccgctaggttccggcgagatggacgtggtgaaggcggcgcastgtcggggcggacgctggaacgtgtagtggtgcaccccctgggtctggctcagcatcgtcgaccactacaaccgcgtcgcccgcgacacccgtaagcgcgtc

SEQ ID NO: 1246 - DNA, 413 bp, Zea mays
  misc_feature: Ceres CLONE 237285-F
  misc_feature: Encodes the peptide sequence at SEQ ID NO. 1247
  misc_feature (176)..(176): n is a, c, t, g, unknown, or other
  misc_feature (280)..(280): n is a, c, t, g, unknown, or other
cccctccgtttcgaaaaccaaatctctctgtctactaggcgggagagtgagacggccatggcggaggcgcaasctagtaccggcgcaaggtcccgacgaggcgcccctcgatgcgtccgccattcagagccgggtggagcagctctcattgaaaaggctggaggtggagccgcasnatggttggcggaggatgaggtggcactaggtttggactccacgcacaaggcggctcaggatscgatggatgagtgggactcggccactgytgcggttycaattnatgatttggatgcatacctggaacaactgagaaaggatgtagccatggcagagcaggggaatcagaaggtatctggtgagattagtgtcactgcagagacaacattcaatgatatgattcaattggatgttgg

SEQ ID NO: 1247 - protein, 118 aa, Zea mays
  misc_feature: Ceres CLONE 237285-F
  misc_feature (6)..(6): Xaa is any aa, unknown, or other
  misc_feature (40)..(40): Xaa is any aa, unknown, or other
  misc_feature (61)..(61): Xaa is any aa, unknown, or other
  misc_feature (70)..(70): Xaa is any aa, unknown, or other
  misc_feature (73)..(73): Xaa is any aa, unknown, or other
  misc_feature (75)..(75): Xaa is any aa, unknown, or other
MAEAQXSTGARSRRGAPRCVRHSEPGGAALIEKAGGGAAXWLAEDEVALGLDSTHKAAQDXMDEWDSATXAVXIXDLDAYLEQLRKDVAMAEQGNQKVSGEISVTAETTFNDMIQLDV

SEQ ID NO: 1248 - DNA, 222 bp, Zea mays
  misc_feature: Ceres CLONE 237296-F
gtcgtgaatccgtgacaaccggcggcggcgagggaagaatcgatagcgccgcagccgcaagwaggaaaccgagaacaactcaatccgctggctatggcgttgctgatggagcccggcgctgagccctgactgagagcgagcaggccgacctggccggcatcgccgccatcaaggagtcggcggcgcgcgaatacaaggagcaggggaacagttcgtccggat

SEQ ID NO: 1249 - DNA, 442 bp, Zea mays
  misc_feature: Ceres CLONE 237363-F
  misc_feature: Translation starting site: 55
  misc_feature: Pfam Name: Ribosomal_L18ae Pfam Description: Ribosomal L18ae protein family
gcctccgctcgccaccatcgtgtaggttaggctaggttcgaccagctagcggaaatggtggccttcaggttccatcagtaccaggtggtggggcgcgcgctgccgacgcccggcgatgagcaccccaagatctaccgcatgaagctctgggccaccaacgaggtccgcgccaagagcaagttctggtacttcttgaggaagttgaagaaggttaagaagagcaacggccaggtcctggcatcaacgagatctttgagcgtaacccgacgacaatcaagaactacggcatctggctgcgctaccagagcagaaccggataccacaacatgtacaaggagtaccgcgacacgaccctgaatggcgctgtggagcagatgtacaacgagatggcctctcgccaccgcgtgaggtcccccttgcatccagatcatcaagacctgcg

SEQ ID NO: 1250 - DNA, 264 bp, Zea mays
  misc_feature: Ceres CLONE 237368-F
  misc_feature: Encodes the peptide sequence at SEQ ID NO. 1251
  misc_feature (80)..(80): n is a, c, t, g, unknown, or other
gaacccaaacccaaatcccaagcaaccacttcgtcgaccatggggcagggcactccgggagggatgggcaagcagggcgngcggcgaccgcaagccgggggacgccggcgaaaagaaggacaagaagttcgagccgccggccgcgccctcccgcgtcggacaggaagcagcgcaacagaagggcgccgaggccgccgcgcgcctccccaacgtcgcgccgctctccaagtgccgactccgcctcctcaagctcgaccgggtcaa

SEQ ID NO: 1251 - protein, 87 aa, Zea mays
  misc_feature: Ceres CLONE 237368-F
  misc_feature (27)..(27): Xaa is any aa, unknown, or other
NPNPNPKQPLRRPWGRALREGWASRAXGDRKPGDAGEKKDKKFEPPAAPSRVGQEAAQQKGAEAAARLPNVAPLSKCRLRLLKLDRV

SEQ ID NO: 1252 - DNA, 362 bp, Zea mays
  misc_feature: Ceres CLONE 237394-F
  misc_feature: Encodes the peptide sequence at SEQ ID NO. 1253
accagctttccccttctctccggtccgggaatcggaagctcagggcagaaggtaagccatggggcagacgcatcttttgttgctcgcttgtttctgggtcctgtcaacatgctccttgctacttgatgcttcctccgatggactgttaagaatcaacctgaacaagagagactgggacaaggaagctttgactgctgcgaaattggcgaagaaggagagccaccttcgaaggtctgtrggtgctgaccagtatctcagtgcctcaactgatgacatagtccctttggacaactaccctggacacccagtactttgggacagatcagcatcgggcacgccacccacagaacttcacagtgata

SEQ ID NO: 1253 - protein, 101 aa, Zea mays
  misc_feature: Ceres CLONE 237394-F
MGQTHLLLLACFWVLSTCSLLLDASSDGLLRINLNKRDWDKEALTAAKLAKKESHLRRSVGADQYLSASTDDIVPLDNYPGHPVLWDRSASGTPPTELHSD

SEQ ID NO: 1254 - DNA, 424 bp, Zea mays
  misc_feature: Ceres CLONE 237467-F
  misc_feature: Encodes the peptide sequence at SEQ ID NO. 1255
atcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgcccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgttggctcccgaggagcaccccgtcctcctcaccga

SEQ ID NO: 1255 - protein, 106 aa, Zea mays
  misc_feature: Ceres CLONE 237467-F
  misc_feature: SWISSPROT Homolog: EC 2.7.10.2 Non-specific protein-tyrosine kinase
MPRISSPSSATTELAWSRLGSLATTPEGRLPQHRGAPAHTGVMVGMGQKDAYVGDEAQSKRGILTLKYPIEHGIVSNWDDMEKIWHHTFYNELRVGSRGAPRPPHR

SEQ ID NO: 1256 - DNA, 176 bp, Zea mays
  misc_feature: Ceres CLONE 237483-F
  misc_feature (18)..(18): n is a, c, t, g, unknown, or other
  misc_feature (75)..(75): n is a, c, t, g, unknown, or other
  misc_feature (83)..(83): n is a, c, t, g, unknown, or other
ctcctccgcacaaacgcntcgcatccgctccacaggmtcctctgcgccaccgcaaccgtgtgaccgcccgtgchnccggcgdnccgatccgccgacccgtcccatccccgctcgcagccatgtcgccgtcggagccgacgcggggagaagagcgtgtacatggccaagcttgcgga

SEQ ID NO: 1257 - DNA, 474 bp, Zea mays
  misc_feature: Ceres CLONE 237486-F
  misc_feature: Translation starting site: 146
  misc_feature (125)..(125): n is a, c, t, g, unknown, or other
  misc_feature (226)..(226): n is a, c, t, g, unknown, or other
  misc_feature (227)..(227): n is a, c, t, g, unknown, or other
  misc_feature (406)..(406): n is a, c, t, g, unknown, or other
agggagaagaacacagggcacacgcacggcacgcagatacatatagagagaggttagctatagcttgcacatctatttaactaactaactaactggctagctagctcgatcggcagagcaaagcnaagcagcaagamgcaaagcaatggagaaccctgcgagtgtgctagttctaccagcgcagttcaccaaactcaccttccgawacctgtacwtcckccgggcnngccgggcagcagggagataaccgaggagggcaggtgcgacctggacaagagatacgtgagtgacttccccgtctacgacgccgcggccccgacgccaggccttgtggcccgcgtgcaggggatcaccagcgaaatcggggarcgcgcaccaactgttcgtcgttgttttcgacaccggncagctcaggggctccacgctcgtcaccaatggcgtgatamggccgggtcttacgagtgggcgatctac

SEQ ID NO: 1258 - DNA, 430 bp, Zea mays
  misc_feature: Ceres CLONE 237604-F
  misc_feature: Encodes the peptide sequence at SEQ ID NO. 1259
  misc_feature (42)..(42): n is a, c, t, g, unknown, or other
attccgcctgctggacttcctcgtgctgtgtctctgtctgtngctctcgctctcagacgactgggccgccgccgcttggtgctgaggctttcgttggtctcttcggcggcgacgagcacccaccagttctgtagaaatggctgatggtgaggacatccaagcctcttgtctgcagacaatggcaccggaatggtcaaggctggttttgctggggacgatgcaccaagggcggttttccctagcattgttggccgtcctcgccacactggtgtcatggtagggatgggacagaaggatgcatatgttggcgatgaggcacagtccaagagaggtattctcacgctcaagtacccgattgagcacggtattgtgagcaactgggatgacatggagaaaatctggcatcatactttctacaacgagcttcgtg

SEQ ID NO: 1259 - protein, 80 aa, Zea mays
  misc_feature: Ceres CLONE 237604-F
  misc_feature: SWISSPROT Homolog: EC 2.7.10.2 Non-specific protein-tyrosine kinase
MVKAGFAGDDAPRAVFPSIVGRPRHTGVMVGMGQKDAYVGDEAQSKRGILTLKYPIEHGIVSNWDDMEKIWHHTFYNELR

SEQ ID NO: 1260 - DNA, 451 bp, Zea mays
  misc_feature: Ceres CLONE 237625-F
  misc_feature: Translation starting site: 235
  misc_feature: Pfam Name: DUF1218 Pfam Description: Protein of unknown function (DUF1218)
  misc_feature (264)..(264): n is a, c, t, g, unknown, or other
  misc_feature (266)..(266): n is a, c, t, g, unknown, or other
  misc_feature (280)..(280): n is a, c, t, g, unknown, or other
ggaggacaatagttggttgtyttcagggagggagagagggaaagatggagcgcaaggyggttggtggtgtgcgcggtggtcggcttcctcggcgtcctctcggcggcgctcggcttcgcggcggaggccacccgcgtcaaggtttcggacgttcaaacaagcggcagtcctggtgaatgcatatacccaagaaccccagccttggcactgggtttaatatctgccgcctctcttatgctcgcccagtccatcataaacgcakkncntggttgcatctgtngcaagaagcatcctgttccctcagacactaamtgrsagcatagccctgatttcgttcatcgtatcttggtgcactttcataatctcgttcvttctcctactgactggggctdhcctgaaacgaccagagaggcgaggagaacatgtacttcggtagcttctgctacgtggt

SEQ ID NO: 1261 - DNA, 469 bp, Zea mays
  misc_feature: Ceres CLONE 237628-F
  misc_feature: Encodes the peptide sequence at SEQ ID NO. 1262
agtccactcacaagcgacaagatatatcagccattttaagtttgataatggatccaagatatgttactttattcatcttagtacttgccttacatggagatactactttggcagaaacttgcaggcagtttgttaaagtgcatccattctgctttaaagcaatgtgcaaggcaaattgtgctatagagggaaaattctctgatggttcctatgtaaaggattacagatgtgaatcaggtggatttcactcagtgtgcgtttgcattttgtgcaaacattagttatctaaagacaagcggagatatcttcttgtattcctatatgttatttaggagtattgtccaaataattatacggtagcttagttaactagctagtttgtttatttatagacatatgtagcactagttaactagttgttgtttcttaaattctcagctatataccagtaacatgttttcagcgcttc

SEQ ID NO: 1262 - protein, 77 aa, Zea mays
  misc_feature: Ceres CLONE 237628-F
MDPRYVTLFILVLALHGDTTLAETCRQFVKVHPFCFKAMCKANCAIEGKFSDGSYVKDYRCESGGFHSVCVCILCKH

SEQ ID NO: 1263 - DNA, 197 bp, Zea mays
  misc_feature: Ceres CLONE 237645-F
  misc_feature (138)..(138): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcsaaggccggcgggcgancgaagaagtcggtgtcgcggtcmtccagggccgggctacagttccccgtcagccgcgtc

SEQ ID NO: 1264 - DNA, 146 bp, Zea mays
  misc_feature: Ceres CLONE 237674-F
  misc_feature (69)..(69): n is a, c, t, g, unknown, or other
ggaaaaaaaactgtgcggaaacgaaataaaagcaggagagagcatcttgtgtcgtctgcgcaagakggnagaacactcggggttaggagatctgactcaatggccgcgaccaaggtgtgcaacgttaggttcgagggcaacgtgat

SEQ ID NO: 1265 - DNA, 423 bp, Zea mays
  misc_feature: Ceres CLONE 237696-F
  misc_feature: Encodes the peptide sequence at SEQ ID NO. 1266
  misc_feature (73)..(73): n is a, c, t, g, unknown, or other
  misc_feature (148)..(148): n is a, c, t, g, unknown, or other
gaggcagaaaagggcggataaactgcttgaactggaagcgaccctagtccaaaccaccgcaccgacaccgaynccgagccccgccgcgccgcgctacctccgctcctctcttcgcccctgccggcgtcgaggccgaagcgaaggcgangcatgcatcacgaccccaaccccttcgacgagggcagcgcgaggacaaccccttctcaaatggaggagccggasscaagcagcagtacggcttccggccgactgagcccgtcgggttcggcggcgctacaggggcgacgcgtcgttgacgtcccgctcgacaccatgggggactctcggagcaaggtgaaggagctctcgtcgtgggaatcagatctgaagcggcgagaggcggatatcaagaggagggaagaggcgctgaagaatgctgggcgt

SEQ ID NO: 1266 - protein, 91 aa, Zea mays
  misc_feature: Ceres CLONE 237696-F
  misc_feature (24)..(24): Xaa is any aa, unknown, or other
  misc_feature (25)..(25): Xaa is any aa, unknown, or other
MHHDPNPFDEGSARTTPSQMEEPXXSSSTASGRLSPSGSAALQGRRVVDVPLDTMGDSRSKVKELSSWESDLKRREADIKRREEALKNAGR

SEQ ID NO: 1267 - DNA, 143 bp, Zea mays
  misc_feature: Ceres CLONE 237746-F
ctyccaccacgcatcactcccgggccgccgcgccgccgcctccgcgaaaaaccctagcaggcttcgcgttatcactccaagggggcgaccatggtggccacaaagaagacgaagaaatccacggacaacatcaataacaagct

SEQ ID NO: 1268 - DNA, 418 bp, Zea mays
  misc_feature: Ceres CLONE 237784-F
  misc_feature: Encodes the peptide sequence at SEQ ID NO. 1269
aaaaagaaaaacggtgagctagaaacttccaaatcgaacggcacacaaaaatcacaacccggaawgggaccagcagcgcaaaggtgagcgagctttccttcggaactctcgtgctcacctcatccgtccgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctct

SEQ ID NO: 1269 - protein, 76 aa, Zea mays
  misc_feature: Ceres CLONE 237784-F
  misc_feature (10)..(76): Pfam Name: S1FA Pfam Description: DNA binding protein S1FA
MADQFVDSANNVIIEEVNKGLNPGMVVLLVVASFLLLFFVGNYALYVYAQKTLPPKKKKPVSKKKLKREKLKQGVS

SEQ ID NO: 1270 - DNA, 270 bp, Zea mays
  misc_feature: Ceres CLONE 237785-F
  misc_feature: Encodes the peptide sequence at SEQ ID NO. 1271
  misc_feature (164)..(164): n is a, c, t, g, unknown, or other
aaccgagacaccgcgtgckaaccaagcagaccacagcaagaagcgtagtcgtcgccggaaggaaaggcgcggmsaagatgtcgtggcaggcgtacgtcgatgagcacctgatgtgcgagatcgaaggacaacatctcagcgccgccgccatcgtcggtcacgmncagcgcttgggcsagtccgagagcttccccgagttaaagcctgaggaggttgctggtatcataaatkactttgatgaacctggtactcttgcaccaactgggtctt

SEQ ID NO: 1271 - protein, 64 aa, Zea mays
  misc_feature: Ceres CLONE 237785-F
  misc_feature (29)..(29): Xaa is any aa, unknown, or other
  misc_feature (34)..(34): Xaa is any aa, unknown, or other
  misc_feature (52)..(52): Xaa is any aa, unknown, or other
MSWQAYVDEHLMCEIEGQHLSAAAIVGHXQRLGXSESFPELKPEEVAGIINXFDEPGTLAPTGS

SEQ ID NO: 1272 - DNA, 346 bp, Zea mays
  misc_feature: Ceres CLONE 237811-F
  misc_feature: Encodes the peptide sequence at SEQ ID NO. 1273
  misc_feature (143)..(143): n is a, c, t, g, unknown, or other
atcacaacaaaaggcgcaasaccgcacggagagcaagtywagaaagcatccactgcactgccactacctaacaatggcccgcgcctacgtgtttctcgtcgtgctcctcctggccgctgtcatcgtggcaccgttcgcggganacgcgtgtcgacgtcgttgagggcaggtccatggcgtccgcgacgsgccggascgccgcaccatcacccgggcctgactctgcctcgtcaccggactcctcgttcggaagcgccctccagcagcagctcctcggactagatagctctagccgctcggacgcacgatctcgctctccatctacacggcgatcgagttctagctt

SEQ ID NO: 1273 - protein, 57 aa, Zea mays
  misc_feature: Ceres CLONE 237811-F
  misc_feature (6)..(6): Xaa is any aa, unknown, or other
  misc_feature (8)..(8): Xaa is any aa, unknown, or other
MASATXRXAAPSPGPDSASSPDSSFGSALQQQLLGLDSSSRSDARSRSPSTRRSSSS

SEQ ID NO: 1274 - DNA, 247 bp, Zea mays
  misc_feature: Ceres CLONE 237821-F
attgaacgctagctgctgctttgggcgctcgcttttcctcgagggctttctgaaaagtttgggtacgtgtgcccccacattctcttcggacaggcctttcggctatgtatagaggagcaacccctgtgctccgctgcccaattccaaccccagctttgactgccctcgcttggtgctcagttctttcctctgctcctccgcctcttctcgcacctcggcgcctccttcggcaactgcgagcgagatg

SEQ ID NO: 1275 - DNA, 93 bp, Zea mays
  misc_feature: Ceres CLONE 237880-F
astagtgcattttaaatcccaagacgtctctcactcttcagccgctttacaactccccaccccatcccatccacacacttcacccagcgcggc

SEQ ID NO: 1276 - DNA, 332 bp, Zea mays
  misc_feature: Ceres CLONE 237883-F
  misc_feature: Translation starting site: 100
  misc_feature: Pfam Name: DUF662 Pfam Description: Family of unknown function (DUF662)
  misc_feature (24)..(24): n is a, c, t, g, unknown, or other
gagagaatagctaggccgcgcgancgccgaaccgcagcagacacgcgcgcggacagcgtacgagggagggagctgcctgaggtagaggaggaggagaacatgcagggmggcggcggcgtggaccagccgcaattgcagatggtgctgcgggtgaggcacccgtcgtcgctgggcggcacggggcggtacgaggacgacggcgaggggtcctctaggtcggcgctctcggtgttcaggccaaggaggagcagatcgagcggcgcaagatggaggtccgggggagaagggtgttcgcccacctcggacgcgtcgaggaggagtccaagcgactc

SEQ ID NO: 1277 - DNA, 367 bp, Zea mays
  misc_feature: Ceres CLONE 237929-F
  misc_feature: Encodes the peptide sequence at SEQ ID NO. 1278
  misc_feature (257)..(257): n is a, c, t, g, unknown, or other
akatctgatccagtcttgcggcaccgagaaccgaggaggggaacatggcgggtgacggcaacggccgcgcggacttccccggatcgcggtgatcggcgmmggcatctttgcgcgcactcagtacatcccaaggctccgcgagatcgcgcacctcgtcgtcctcaaggccatctggagccgcacccaggaatctgcaaaggcggccgcggactttgctcgtgacttcgcgcctgacatcgagtgcagatggggtgatncggggctggaggagatcatgggagatagttcaatcattggcgttrctgttgttctcgctgggcaagtccaggttgagctttccctaaagatgctcaaggctggaaaacac

SEQ ID NO: 1278 - protein, 31 aa, Zea mays
  misc_feature: Ceres CLONE 237929-F
  misc_feature (10)..(10): Xaa is any aa, unknown, or other
MGDSSIIGVXVVLAGQVQVELSLKMLKAGKH

SEQ ID NO: 1279 - DNA, 124 bp, Zea mays
  misc_feature: Ceres CLONE 237959-F
  misc_feature (86)..(86): n is a, c, t, g, unknown, or other
attggggtcgcgtccaacaagaggctggccagcatcccgcgcgastcacttcctctctcctccccatcggatccagcgccacgcgnatccgcaaggcaatccatggcctctacccaggcggaac

SEQ ID NO: 1280 - DNA, 473 bp, Zea mays
  misc_feature: Ceres CLONE 238004-F
  misc_feature: Translation starting site: 99
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacagcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttccct

SEQ ID NO: 1281 - DNA, 285 bp, Zea mays
  misc_feature: Ceres CLONE 238013-F
  misc_feature: Encodes the peptide sequence at SEQ ID NO. 1282
  misc_feature (93)..(93): n is a, c, t, g, unknown, or other
  misc_feature (97)..(97): n is a, c, t, g, unknown, or other
gatctgagatcgacatcgatccaccgaggtttcttgtgcgtgccgccatggccatggcagtagctcaccttcttcctcagctctccgccgamnattnggagctagcaggaacagaatggccadtctcttgattcttcagctttttctcttaacggcgctaggcgtggatggagcggcgtcgttcatcttcaccaacgcctgcaagcacgcggtgtgggtgggcgcgctccacggcgccagctccgccgccgctcgcgcgttcgggcttctacctggcgccgtccg

SEQ ID NO: 1282 - protein, 56 aa, Zea mays
  misc_feature: Ceres CLONE 238013-F
  misc_feature (3)..(3): Xaa is any aa, unknown, or other
MAXLLILQLFLLTALGVDGAASFIFTNACKHAVWVGALHGASSAAARAFGLLPGAV

SEQ ID NO: 1283 - DNA, 387 bp, Zea mays
  misc_feature: Ceres CLONE 238016-F
  misc_feature: Encodes the peptide sequence at SEQ ID NO. 1284
  misc_feature (180)..(180): n is a, c, t, g, unknown, or other
acttcccgaaaaaaggaagacagagaagtaaacggcagtaagtcgccggcgccgscgacaggaggaaggagggagtagcatcggcaggggaggtccggcgatctcggctgctttggcgcggtaagggaggaagcggascgcgacaggatgcactcgtttgggcaccgcgccaacgstggncaacgtttgcggtcaccatactggccgcgatgtgcttcgccgcctccttctccgacaattttaacaccctgacacccaccgcatccgtcaagatcttgaatataaactggttccagaaggaggccaacggcaatgacgaggtcagcatgacgctgaacatttcggctgacctttcatctcttttcacgtggacacaaaacaggtatt

SEQ ID NO: 1284 - protein, 59 aa, Zea mays
  misc_feature: Ceres CLONE 238016-F
MCFAASFSDNFNTLTPTASVKILNINWFQKEANGNDEVSMTLNISADLSSLFTWTQNRY

SEQ ID NO: 1285 - DNA, 517 bp, Zea mays
  misc_feature: Ceres CLONE 238061-F
  misc_feature: Translation starting site: 146
awacttccgctgtcacgagagtacgagaccacgccttccgtggatcaatcggctagggtttcggagatgttcggccgcgcgccgaagaagagcgacaacacccggtactacgagatcctgggggtttccaaggacgcgtcacaggatgacctcaagaaggcctaccgcaagccgccatcaagaaccaccccgacaaggcggcgaccccgagaagttcaaggagctagctcaggcttatgaggtcctcagcgaccctgaaaagagagagatctatgaccagtatggcgaggatgccctcaaggagggaatgggaggcggtggtgggatgcatgatccctttgacatattccagtcattctttggtggtggaagcccttttggaggtggcagcagtaggggcagaaggcaacgacgggggagatgatgtggttcatcctctgaaggtttctctggaggatttgtacaatggcacatcaaagaagctctctcttgtcccggcaaatggtctctgctcaag

SEQ ID NO: 1286 - DNA, 201 bp, Zea mays
  misc_feature: Ceres CLONE 238100-F
gaaaaagctgctccctctcccggacttcagaggccgatggacgctggagcacgcgtcggtccggcgcccccatggacccggcctgcgaggagctcgagcgccgcagccgttacctcagcgcgctcgtgscgcaccaagctcgccgacccgccccagccccagccggascaaaggcggacgtggagcctcctcagctgaagg

SEQ ID NO: 1287 - DNA, 457 bp, Zea mays
  misc_feature: Ceres CLONE 238105-F
  misc_feature: Encodes the peptide sequence at SEQ ID NO. 1288
acaagaacactcctagctagctgaagatctcgagtgcaacgaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaaactggcgagtgggctgtt

SEQ ID NO: 1288 - protein, 114 aa, Zea mays
  misc_feature: Ceres CLONE 238105-F
MAKLQVTPGAAFTECNELNFQGLYLYHTPLGPKANQAAIVESKAKIGIGATVVNNWAVYDGPGPGAKLVGRAQGLHILAGNWVNSFTLVFEDERFSGSTLEVRGITVETGEWAV

SEQ ID NO: 1289 - DNA, 477 bp, Zea mays
  misc_feature: Ceres CLONE 238159-F
  misc_feature: Encodes the peptide sequence at SEQ ID NO. 1290
  misc_feature (195)..(195): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcancttgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcac

SEQ ID NO: 1290 - protein, 77 aa, Zea mays
  misc_feature: Ceres CLONE 238159-F
  misc_feature: SWISSPROT Homolog: EC 2.3.1.74 Naringenin-chalcone synthase
  misc_feature (37)..(37): Xaa is any aa, unknown, or other
MVSSSMDTTSDKRASSMLAPNPGKATILALGHAFPQXLVMQDYVVDGFMKNTNCDDPELKEKLTRLCKTTTVRLGTW

SEQ ID NO: 1291 - DNA, 130 bp, Zea mays
  misc_feature: Ceres CLONE 238183-F
  misc_feature (55)..(55): n is a, c, t, g, unknown, or other
acaccaagaatcacatcacacagcgaaccgagaaaccaacacagcaacaagcadncagcgatccgacatccgacatccgagagatggacgcggtgatgttcgggctggagactccccttatggcggcgct

SEQ ID NO: 1292 - DNA, 454 bp, Zea mays
  misc_feature: Ceres CLONE 238193-F
  misc_feature: Encodes the peptide sequence at SEQ ID NO. 1293
gcgttcatctgcagtgcacgaacaatcgagccagcaacataaacgatcgaggcgcggtggccgttagcaaccgcagcaagcatgaataactcgcgcgctctagtgttggtgctcctgctgctggccatcgccatggcgagctgcaggctctcgctcgccgcccacgagagcagcaccagcctcgcggacaccctcggccgcgacctgcgggctccatcgccagggccgccggcaacctcttcataccggacggtggctggcgcgccgcgaacgtcaccgccgacgcagaggcaaagaacctgagggccgtggcgtcccggagcggcggcccgcaccaggaagtcctccggcggcggcgcgggctgcgtcacgccgggggcgtgccggtaagaggcgggtcatctgcggcaagagggtgctacgacggcgcctcgtcgcgcgccgccgccagcct

SEQ ID NO: 1293 - protein, 73 aa, Zea mays
  misc_feature: Ceres CLONE 238193-F
MNNSRALVLVLLLLAIAMASCRLSLAAHESSTSLADTLGRDLRAPSPGPPATSSYRTVAGAPRTSPPTQRQRT

SEQ ID NO: 1294 - DNA, 400 bp, Zea mays
  misc_feature: Ceres CLONE 238200-F
  misc_feature: Translation starting site: 138
  misc_feature: Pfam Name: SAP18 Pfam Description: Sin3 associated polypeptide p18 (SAP18)
  misc_feature (179)..(179): n is a, c, t, g, unknown, or other
acgccgtcggatcctcctgccctccccacgtccacctctctccgccgaagaatcggsgcggcggcggcggcggcgagcgcttcccttgtcaaaatccacccggcggcagagcagagcytcgttgctgaggaggggagatggcaggcatgaccgatatgccgatgaggccggcgcggcgngcccgccgatgcagcaccggggccctccgccgatggscgcctccgccccgaaccaatcgaccgcgagaagacctgccctctgctgctcagggtttttcacaaggggttgctggtcaccaccaaaatgaagagttttctgtgagagggggaaagaaccaaaggatgaagttcagatttacacatggaaggatgccactctccgtgagcttactgatcttgtg

SEQ ID NO: 1295 - DNA, 461 bp, Zea mays
  misc_feature: Ceres CLONE 238225-F
  misc_feature: Encodes the peptide sequence at SEQ ID NO. 1296
ggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgtcataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaggagtttgataatgagactccatacactattatgtttggt

SEQ ID NO: 1296 - protein, 133 aa, Zea mays
  misc_feature: Ceres CLONE 238225-F
  misc_feature (24)..(124): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYVIIKELDEPVTLNDGTVVLQFEVRLQNGLECGGAYIKYIRPQDAGWDARSLIMRLHTLLCL

SEQ ID NO: 1297 - DNA, 214 bp, Zea mays
  misc_feature: Ceres CLONE 238274-F
  misc_feature (164)..(164): n is a, c, t, g, unknown, or other
acacactcgactctcctctctcgcatccgcrcctttcgagctctactccaccccctcgatctcgaagcgcmsagcagcagtcaggcggccatggacgcgagckcmscggagccggcggggaaggcgaagaagggcgcggccgggcgcaaggtccggcgggcganggaagaagtcggtgacgaggtccgtcaaggccgggctgcagtttcccgtc

SEQ ID NO: 1298 - DNA, 308 bp, Zea mays
  misc_feature: Ceres CLONE 238284-F
  misc_feature: Encodes the peptide sequence at SEQ ID NO. 1299
  misc_feature (105)..(105): n is a, c, t, g, unknown, or other
agccgcaccgcgctcacttccgcaccctcttcccgccgcgccgccgccgccgccgcttcctccccgccgccgggcaagatgggtcgcgtgatccgcgcgcastanatgggtgcgggatccgtgttcaagtcccacacccaccaccgcaaggccccgccgttccgctccctcgacttcggcgagcgcaacgggtacctcaagggcgtagtcaccgacgtgatccacgaccccggacgcggcgccccgctcgccaaggtcaccttccgccaccccttcaggtacaagcaccagaaggagctcttcgtcgc

SEQ ID NO: 1299 - protein, 76 aa, Zea mays
  misc_feature: Ceres CLONE 238284-F
  misc_feature (11)..(76): Pfam Name: Ribosomal_L2 Pfam Description: Ribosomal Proteins L2, RNA binding domain
  misc_feature (8)..(8): Xaa is any aa, unknown, or other
  misc_feature (9)..(9): Xaa is any aa, unknown, or other
MGRVIRAXXMGAGSVFKSHTHHRKAPPFRSLDFGERNGYLKGVVTDVIHDPGRGAPLAKVTFRHPFRYKHQKELFV

SEQ ID NO: 1300 - DNA, 273 bp, Zea mays
  misc_feature: Ceres CLONE 238295-F
  misc_feature: Encodes the peptide sequence at SEQ ID NO. 1301
  misc_feature (94)..(94): n is a, c, t, g, unknown, or other
gatctgagatcgacatcgatccaccgaggtttcttgtgcgtgccgccatggccatggcagtagctcaccttcttcctcagctctccgccgaamnatcggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccactcgccgccgctcgcgcgttcgggcttctacctg

SEQ ID NO: 1301 - protein, 52 aa, Zea mays
  misc_feature: Ceres CLONE 238295-F
MAILLILQLFLLTALGVDGAASFIFTNACKHAVWVGALHGATRRRSRVRAST

SEQ ID NO: 1302 - DNA, 490 bp, Zea mays
  misc_feature: Ceres CLONE 238325-F
  misc_feature: Encodes the peptide sequence at SEQ ID NO. 1303
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaa

SEQ ID NO: 1303 - protein, 142 aa, Zea mays
  misc_feature: Ceres CLONE 238325-F
  misc_feature (24)..(142): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTN

SEQ ID NO: 1304 - DNA, 483 bp, Zea mays
  misc_feature: Ceres CLONE 238342-F
  misc_feature: Encodes the peptide sequence at SEQ ID NO. 1305
  misc_feature (81)..(81): n is a, c, t, g, unknown, or other
  misc_feature (199)..(199): n is a, c, t, g, unknown, or other
  misc_feature (200)..(200): n is a, c, t, g, unknown, or other
tttcaacctctagctgattgatctctggtttaccactctttccttccctccttcaattctaaataccacaaatcaaagttnctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggawkctggcgcaggaggggctgccgacgatgaatcagcgtctggacatctcgaacgcggcggtgacsagatggcgacggaggcgtccctgtcgtgcgtccgctcgtggggcggcgcgctctcgtccatcacc

SEQ ID NO: 1305 - protein, 93 aa, Zea mays
  misc_feature: Ceres CLONE 238342-F
  misc_feature: SWISSPROT Homolog: EC 2.3.1.74 Naringenin-chalcone synthase
  misc_feature (50)..(50): Xaa is any aa, unknown, or other
  misc_feature (51)..(51): Xaa is any aa, unknown, or other
  misc_feature (72)..(72): Xaa is any aa, unknown, or other
MQDYVVDGFMKNTNCDDPELKEKLTRLCKTTTVRTRYVVMSDEILKNYPXXGAGGAADDESASGHLERGGDXMATEASLSCVRSWGGALSSIT

SEQ ID NO: 1306 - DNA, 195 bp, Zea mays
  misc_feature: Ceres CLONE 238351-F
  misc_feature: Encodes the peptide sequence at SEQ ID NO. 1307
  misc_feature (158)..(158): n is a, c, t, g, unknown, or other
  misc_feature (161)..(161): n is a, c, t, g, unknown, or other
acaatggcatcctcctcttccctggcctccgccaaagccctagcacgctcccacgcgtccctcctcgcgccccaaacccagagaacagtgctcgcgccwkscgtcgcgctcggccgcacctccgtcagatgcgcgcctctgctgctgcgccggcgganaangaagaccgtctgggtgtggaccgagagccggcag

SEQ ID NO: 1307 - protein, 64 aa, Zea mays
  misc_feature: Ceres CLONE 238351-F
  misc_feature (33)..(33): Xaa is any aa, unknown, or other
  misc_feature (52)..(52): Xaa is any aa, unknown, or other
  misc_feature (53)..(53): Xaa is any aa, unknown, or other
MASSSSLASAKALARSHASLLAPQTQRTVLAPXVALGRTSVRCAPLLLRRRXXKTVWVWTESRQ

SEQ ID NO: 1308 - DNA, 416 bp, Zea mays
  misc_feature: Ceres CLONE 238387-F
  misc_feature: Encodes the peptide sequence at SEQ ID NO. 1309
ccgactcgttcgggctattccatctctgctctctccctatatacgactaggctaccgccgccgccagatgcgcaggtcttcgtcggctccttctacttctcaggcaacgagcacccggcagtaccgatcgggtgttcttcactgggtccgctcctgcgtgctagaactagaagaatcctctgctcggctcgaacttggaaggggggaggcgagggatggggtccctgctttgctgcatggggtgctcggaggacgtctcggcagcgscccgtgagctgcttgtgcctactatggcctttccattattaccacaatttgaactcgggctctgctgcttgtcacagatgtgatacacgggtggcacctgatggtggaaggagtcctcctgcaaatcaagtggattcattggatacttt

SEQ ID NO: 1309 - protein, 138 aa, Zea mays
  misc_feature: Ceres CLONE 238387-F
PTRSGYSISALSLYTTRLPPPPDAQVFVGSFYFSGNEHPAVPIGCSSLGPLLRARTRRILCSARTWKGGGEGWGPCFAAWGARRTSRQRPVSCLCLLWPFHYYHNLNSGSAACHRCDTRVAPDGGRSPPANQVDSLDT

SEQ ID NO: 1310 - DNA, 428 bp, Zea mays
  misc_feature: Ceres CLONE 238430-F
  misc_feature: Pfam Name: Trp_syntA Pfam Description: Tryptophan synthase alpha chain
  misc_feature: SWISSPROT Homolog: EC 4.2.1.20 Tryptophan synthase
  misc_feature (217)..(217): n is a, c, t, g, unknown, or other
actcgcaatcgcaaagtcgcaagcggatcgcaaactcgcaatcaaggctgctcccctccgtctccgtgttcgccactcggttcaccgcccgccgccgccgagacctcctcctcgccggctactcctgaccccacaaaggcagcgctcggaggtggccctctgtcgggtggagtggtggacacatccgcgcccatggcaacgsggcgctgcggccggncaagctcaccgtcgccgagaccttctccaacctcagggagcaaggcaagagtgcattcatcccgttcataactgctggtgatcctgacctggtaacsacatcgaaagcattgaagattctcaattcctgcggttcggatgttatagaggttcgcgtamcatactcgggatccactgggctgatggggccagtttatttcaaggctttctgc

SEQ ID NO: 1311 - DNA, 210 bp, Zea mays
  misc_feature: Ceres CLONE 238438-F
aacatatgtaccctctcgcgcaaacactcctctttccgcgccgcctcccctcccgcccacttgctccgccggcgcgccaccgcgcgcaccgcagcagccagtcagcagatcgtaaccatggcggattctaaggccgctvcggcgtggaccctccgcacgcgcaagttcatgaccaaccgccttctctccccgcaagcagttcgtgctcga

SEQ ID NO: 1312 - DNA, 377 bp, Zea mays
  misc_feature: Ceres CLONE 238439-F
  misc_feature: Translation starting site: 160
  misc_feature (139)..(139): n is a, c, t, g, unknown, or other
  misc_feature (144)..(144): n is a, c, t, g, unknown, or other
ctcttcgcttctaactccgctgggccaccastttgaccgccgcctcccttccccwmcgctactgctcctccccaccccactcccccgcagagcgcggcgcggcggcgaggtcgtaccccacatcggcgagcggcggcgncaccngaggsaataggcaagatgttcgggcgcgcgccgaagaagagcgacaacaccaagtactacgagatcctcggggtgcccaagtcggcgtcccaggacgatctcaagaaggcctaccgcaagctgctatcaagaaccaccccgacaagggcggtkaccccgagaagttcaaggagctcgcacaagcctatgaggttttgagtgatccagagaaacgtgagatttatgatcagtat

SEQ ID NO: 1313 - DNA, 88 bp, Zea mays
  misc_feature: Ceres CLONE 238482-F
  misc_feature (38)..(38): n is a, c, t, g, unknown, or other
accgatttgtttactgctctctccgacgcgcggcgggnactccctacgacaactgaaccatgtgcggcggcgcgatccttgccaacct

SEQ ID NO: 1314 - DNA, 157 bp, Zea mays
  misc_feature: Ceres CLONE 238505-F
  misc_feature: Encodes the peptide sequence at SEQ ID NO. 1315
accgaagagagaattggatagcagagagtttgcgtgtggaagcagagatggggtccggcatgagcccggccggcgcscggttttcggcgcaggggcgtcgggagggatgctgccactgctggcgcttcaggttctgatcgagtacggccgcgcgggc

SEQ ID NO: 1315 - protein, 52 aa, Zea mays
  misc_feature: Ceres CLONE 238505-F
  misc_feature (26)..(26): Xaa is any aa, unknown, or other
PKRELDSREFACGSRDGVRHEPGRRXVFGAGASGGMLPLLALQVLIEYGRAG

SEQ ID NO: 1316 - DNA, 380 bp, Zea mays
  misc_feature: Ceres CLONE 238523-F
  misc_feature: Encodes the peptide sequence at SEQ ID NO. 1317
  misc_feature (39)..(39): n is a, c, t, g, unknown, or other
  misc_feature (273)..(273): n is a, c, t, g, unknown, or other
  misc_feature (300)..(300): n is a, c, t, g, unknown, or other
  misc_feature (354)..(354): n is a, c, t, g, unknown, or other
ccactcctgcagtccttctccacctagctcccccgcgbnaagaacacgccagctagcaagcgcgctcgatcgaataccgttaccgtgtcgccatggccgctwccgcgwctctatcagccgtcggggcgccgctttcggtgccgggctcaggaagccgctcggcgtgtcgtcgctccggcccctgcagccgagggcggcgaggatgacgacgacggccgtgcgggcgtcggcgtcgccctcgtccacgtccatcaaggagaaggctgcggccgngctgaccgcggcggccctggcggccgncttggttgctgccggacgtcgcggaggccgcgcagtccggcgggctcacgcgtncgctcaagaacttcctcctcagcatc

SEQ ID NO: 1317 - protein, 126 aa, Zea mays
  misc_feature: Ceres CLONE 238523-F
  misc_feature (13)..(13): Xaa is any aa, unknown, or other
  misc_feature (34)..(34): Xaa is any aa, unknown, or other
  misc_feature (36)..(36): Xaa is any aa, unknown, or other
  misc_feature (91)..(91): Xaa is any aa, unknown, or other
  misc_feature (100)..(100): Xaa is any aa, unknown, or other
  misc_feature (118)..(118): Xaa is any aa, unknown, or other
HSCSPSPPSSPAXRTRQLASALDRIPLPCRHGRXRXSISRRGAAFGAGLRKPLGVSSLRPLQPRAARMTTTAVRASASPSSTSIKEKAAAXLTAAALAAXLVAAGRRGGRAVRRAHAXAQELPPQH

SEQ ID NO: 1318 - DNA, 273 bp, Zea mays
  misc_feature: Ceres CLONE 238533-F
  misc_feature (134)..(134): n is a, c, t, g, unknown, or other
  misc_feature (135)..(135): n is a, c, t, g, unknown, or other
aagtcgcggtttgcgagacgagaagcgsgcatgagtgtccactgtccacaagtccagattccaattccagtccgatcgtgagctcagctcagctccgctagtcctctccccgcacgcaccaccaccagcagcanncagcaccatgggcggcgctgctcctcacgctgctcctcgcggccgtgccctctccttgggcggcggcggcggcgcgcacccgggctactccgacgacgacgagagcgcctgcacggttgacgcgggcgcggactgctg

SEQ ID NO: 1319 - DNA, 586 bp, Zea mays
  misc_feature: Ceres CLONE 238572-R
  misc_feature: Encodes the peptide sequence at SEQ ID NO. 1320
  misc_feature (454)..(454): n is a, c, t, g, unknown, or other
  misc_feature (461)..(461): n is a, c, t, g, unknown, or other
cgattgggtaccgggccccccctcgaggtcgacggtatcgataagcttttttttttttttttttggaagttgctcatttaacagagcgctaagcagacgacccaaaaatttcctcaatgaaacatttcgcagttcatgaaatcaacagactgcaacgaccaaaagatgccgggaaccccaacagttttgttttccccagctgacctgatatgacccaaacagtcatgctaggaccttagaagaaaaaatagtcttgataatcaatcagggcttgagggccacagcaattccgaccttcgagctcttctcaatggtctttgtatcgacctcagccgagatggtgaccagcgactttggcctccactcatgctggatcagggcgctggctttgccagagttgttgatgcgtgccttcaagacggttagtgggtccagagtgtgctgccccgccaangtgaggntgttttcattggtcgagaaactgtgggtaagctctgccccacagctgtgtttgtcaatcgctcaacttggggtagtaagctccagtaaggttgcctcccttggtgttcaaataagggatgcgata

SEQ ID NO: 1320 - protein, 83 aa, Zea mays
  misc_feature: Ceres CLONE 238572-R
  misc_feature (39)..(39): Xaa is any aa, unknown, or other
  misc_feature (42)..(42): Xaa is any aa, unknown, or other
MVTSDFGLHSCWIRALALPELLMRAFKTVSGSRVCCPAXVRXFSLVEKLWVSSAPQLCLSIAQLGVVSSSKVASLGVQIRDAI

SEQ ID NO: 1321 - DNA, 330 bp, Zea mays
  misc_feature: Ceres CLONE 238603-F
  misc_feature: Encodes the peptide sequence at SEQ ID NO. 1322
  misc_feature (2)..(2): n is a, c, t, g, unknown, or other
anwccctagcgcgcacccacctcccttcccctttcccggcgtgcggtccggcgttggagatgcgggggctgctcgcgacggcgggatggcgctggcgatggcgcgggagttaacgagtcgtcgggcggtgctgcgttrtcgcagggtctgttatggtgggcgtcggagtgccacgggggtgttgtacagccttgcrtgatgctgccgtcgctggccttcgtgggattcctagcatggcaggcgcggcggasttccgtagctcagctacggccgctctcacgtcgtcgtcgtcgcgtactacgcctcctmtgggtcgtcgccgtactcaac

SEQ ID NO: 1322 - protein, 44 aa, Zea mays
  misc_feature: Ceres CLONE 238603-F
  misc_feature (18)..(18): Xaa is any aa, unknown, or other
MLPSLAFVGFLAWQARRXSVAQLRPLSRRRRRVLRLLWVVAVLN

SEQ ID NO: 1323 - DNA, 165 bp, Zea mays
  misc_feature: Ceres CLONE 238608-F
  misc_feature (117)..(117): n is a, c, t, g, unknown, or other
tcgcagaaattctccgcaacttcacagcgtatcatcgttttccatcgctcctactcctatcatccagaaaatctgagcggtattgatggcgcccaaggsgagaagaagccggcgsanagaaggtggcggaggaggagcctcggagaaggcggctccggcggagaa

SEQ ID NO: 1324 - DNA, 472 bp, Zea mays
  misc_feature: Ceres CLONE 238647-F
  misc_feature: Encodes the peptide sequence at SEQ ID NO. 1325
  misc_feature (180)..(180): n is a, c, t, g, unknown, or other
awaggtctaattactcgcctctcttgctcgccaacgccatkccagaggccaggagcttcgtcaaagacacgccgaaaagagggggaggcgactcggccgaggtccggttccgaactccggtcctccgatttgcgcgtccggatctaccagccatggcatcatcttcggacccgtggatgnaaggagtacaatgaagcatccagacttgctgatgacatcagttccatgattgctgatagagggtccttccacaatcagggccagaaattatgcggcatacttcagccatccgggagaaaaaataactattcttgggactagactgggatagcttggagtcgtttgctggcagaattcctccaaagtcaatcactgacaaggagatgcataagckccaagacatgttttccagtttgaagtctaaagcaaagcagatggcgacaagttcaacatgtcaaactttgctaacagg

SEQ ID NO: 1325 - protein, 29 aa, Zea mays
  misc_feature: Ceres CLONE 238647-F
  misc_feature (4)..(4): Xaa is any aa, unknown, or other
MHKXQDMFSSLKSKAKQMATSSTCQTLLT

SEQ ID NO: 1326 - DNA, 242 bp, Zea mays
  misc_feature: Ceres CLONE 238683-F
  misc_feature (176)..(176): n is a, c, t, g, unknown, or other
arhtcgcatctccctctccgaaatcaaggtagcgtacaccgctgcagtttctagagccctctctgccactcgtgatcccactagtcacaatgcctgcmctcgccaagcccgcctcccgcaccgccaagcccgccgcggytccgaagccgaagcctgccgccgccaagccgamstcncaccgctggtgcctcccacccgcctttaccttcgagatgatcaaaggaggctatcaccggcgctca

SEQ ID NO: 1327 - DNA, 735 bp, Zea mays
  misc_feature: Ceres CLONE 238703-R
  misc_feature: Translation starting site: 331
  misc_feature (349)..(349): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (528)..(528): n is a, c, t, g, unknown, or other
  misc_feature (529)..(529): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (546)..(546): n is a, c, t, g, unknown, or other
  misc_feature (547)..(547): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (586)..(586): n is a, c, t, g, unknown, or other
  misc_feature (588)..(588): n is a, c, t, g, unknown, or other
  misc_feature (590)..(590): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (600)..(600): n is a, c, t, g, unknown, or other
  misc_feature (601)..(601): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (627)..(627): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (640)..(640): n is a, c, t, g, unknown, or other
  misc_feature (641)..(641): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (665)..(665): n is a, c, t, g, unknown, or other
  misc_feature (671)..(671): n is a, c, t, g, unknown, or other
  misc_feature (672)..(672): n is a, c, t, g, unknown, or other
  misc_feature (678)..(678): n is a, c, t, g, unknown, or other
  misc_feature (692)..(692): n is a, c, t, g, unknown, or other
  misc_feature (694)..(694): n is a, c, t, g, unknown, or other
  misc_feature (695)..(695): n is a, c, t, g, unknown, or other
  misc_feature (711)..(711): n is a, c, t, g, unknown, or other
  misc_feature (716)..(716): n is a, c, t, g, unknown, or other
  misc_feature (717)..(717): n is a, c, t, g, unknown, or other
ccgattgggtaccgggccccccctcgaggtcgacggtatcgatattttttttttttttttttcttggctttaatacgtacttctacatttttctgtctctatagactaacagtccaaacgacaacccttaatagtagtagactacactgtactcatacagcaacagcactagctagctagtagcacataacaggagcatcactctcttcggaatcagcagcacgccagcacctcacaccacggagatttacaggaagatgacatttatacatacactgttaacgcgtagtataacagaaccgtgaccagaagctctgttaagcagatcgcatggccggggggggggggnggggggggnnnnnnnnnnnnnnnnnnnnnnnnnnnnnnnnngnnnnnngnnnnnnnnnnnnnnnnnnnnnnnnnnnnnnnnnnnnnnnnnnnnnngnnnnnnnnnnnnnnnnnnnnnnnnnnnnnnnnnnnnnnnnnnnngngnnnnnnnnnnnnnnnnggnnnnnnngnnnnnggggnngnnnnnnnngggggggnngggggnnnnngggnngngnnnngggggggnnnnnggggngngnggggnnnggnnggggggggngnngggggggnnnnngnggnnnnnnggggnngnnngnnnnggggggggggggggngggggnngggggngggggggggggggngnngggggggggggggggnggggnngggggggggggggggggc

SEQ ID NO: 1328 - DNA, 323 bp, Zea mays
  misc_feature: Ceres CLONE 238712-F
  misc_feature: Encodes the peptide sequence at SEQ ID NO. 1329
  misc_feature (187)..(187): n is a, c, t, g, unknown, or other
  misc_feature (196)..(196): n is a, c, t, g, unknown, or other
  misc_feature (235)..(235): n is a, c, t, g, unknown, or other
  misc_feature (266)..(266): n is a, c, t, g, unknown, or other
  misc_feature (306)..(306): n is a, c, t, g, unknown, or other
gccactttgccccgcctcgtcgcctcctccgacgaccaccgtccaccggcgacaaggacagcvacgatgcagtcggcggcgtggaggcgtcacctcctcgaccaccacctctccccttcaacctcggctgccatcgccgccttcagatccgcctcccagcccgggctcgctccccaagggttgtttngagcggatngcgcaagatgcatgttctgcgagggcgccggcggtcaangggtccgggcatctcgtccgcaaggcaccgnaggaggtcttctstgagtggaattgtagccacggtgtttngagctactgggtttctt

SEQ ID NO: 1329 - protein, 71 aa, Zea mays
  misc_feature: Ceres CLONE 238712-F
  misc_feature (41)..(41): Xaa is any aa, unknown, or other
  misc_feature (44)..(44): Xaa is any aa, unknown, or other
  misc_feature (57)..(57): Xaa is any aa, unknown, or other
  misc_feature (67)..(67): Xaa is any aa, unknown, or other
MQSAAWRRHLLDHHLSPSTSAAIAAFRSASQPGLAPQGLFXADXARCMFCEGAGGQXVRASRPQGTXGGLL

SEQ ID NO: 1330 - DNA, 160 bp, Zea mays
  misc_feature: Ceres CLONE 238739-F
  misc_feature (83)..(83): n is a, c, t, g, unknown, or other
atcaatcaaatactcagacaaccatggggcacagcaggcgcmacggcaaggacgacaccgaggaactgcttgcrcccaccggnagctgtggtgmatgccctgggctacgtcaagtccatggcgctcaagtgcgcmctggacctgcgacatccccgacacc

SEQ ID NO: 1331 - DNA, 250 bp, Zea mays
  misc_feature: Ceres CLONE 238775-F
  misc_feature (31)..(31): n is a, c, t, g, unknown, or other
atcagaatcggaccaccacacgcccgaggcncgactgcaagckcctgagcccaagacccatggccatggccgccgccaccgtcgcagcgtctctgcccgtgggcaggggctcgggaagcccctctgcgccggaagcwacgcscgtcgctccgggccgtcgcgggckcgccccgtcgtcggtcggccaggaccaggatggccgtcgtccgggcgtccgcgcaaaagcagcacccggccaaggagtgggcgg

SEQ ID NO: 1332 - DNA, 156 bp, Zea mays
  misc_feature: Ceres CLONE 238781-F
  misc_feature: Encodes the peptide sequence at SEQ ID NO. 1333
  misc_feature (12)..(12): n is a, c, t, g, unknown, or other
avgtgaaacggncatggcgacggtcgcagcccgccgctcctccagccgcgatgggtggccggtgggcggtgcggctgctgggcacgagcggaggcttctccgggcggagagggcgcgcgaggagggggaggtggatccggcgacgcgatctttgtg

SEQ ID NO: 1333 - protein, 47 aa, Zea mays
  misc_feature: Ceres CLONE 238781-F
MATVAARRSSSRDGWPVGGAAAGHERRLLRAERAREEGEVDPATRSL

SEQ ID NO: 1334 - DNA, 311 bp, Zea mays
  misc_feature: Ceres CLONE 238782-F
  misc_feature: SWISSPROT Homolog: EC 2.1.1.41 Sterol 24-C-methyltransferase
  misc_feature (106)..(106): n is a, c, t, g, unknown, or other
attccactagattaccaccacctccacctcgtcgtctcccaccaccgccgagcgcgascctagcccgatctagccggcgsaggcaccagatcccgccgcccgcktncccgggacgcgccccgccgaatccgccgctcctcgcactgcaacacgcccggaccacggtgmatttgatccgtcccgrccgcytacacgatgtccaagtcgggagcgctggatcttgcttctggcctcggaggggaagwtcaacaaggtggaagtcaaktcggccgtcgatgagtatgagaaatatcatggatactatggaggga

SEQ ID NO: 1335 - DNA, 419 bp, Zea mays
  misc_feature: Ceres CLONE 238814-F
  misc_feature: Encodes the peptide sequence at SEQ ID NO. 1336
agcacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcgtgtcagctgaccaacaggtctctgcctgccagaatgacatagacgcactgtggcgcagtgcaagcagttcgtccagaaggaggggcccaagatgcctccgtccgaggactgctgcaaaaccatcaaggccttagacgcgcacbccttgcatctgcgactacgtsgctccccggacgccaggaataagctagacctggamaaaggtgttcttcgttaccaaacagtgcggcgttcaccgtccccaag

SEQ ID NO: 1336 - protein, 51 aa, Zea mays
  misc_feature: Ceres CLONE 238814-F
  misc_feature (18)..(18): Xaa is any aa, unknown, or other
  misc_feature (25)..(25): Xaa is any aa, unknown, or other
  misc_feature (36)..(36): Xaa is any aa, unknown, or other
MPPSEDCCKTIKALDAHXLHLRLRXSPDARNKLDLXKGVLRYQTVRRSPSP

SEQ ID NO: 1337 - DNA, 231 bp, Zea mays
  misc_feature: Ceres CLONE 238843-F
  misc_feature (96)..(96): n is a, c, t, g, unknown, or other
atcaattcgcactcccagcttcctttaccttcgcagcaagcaagccggtagcagcaagctagatcgcggggaagcgactcgcctccaccatcggcnctgctccggckcggagaagcgtcctctcgcggcggctgggaagaccagtctccgccagthccggcgctgcttccgtgagtgcccttggctcctggrcgacgggctcgtggcggccggcgagatgaacagccatgc

SEQ ID NO: 1338 - DNA, 1438 bp, Zea mays
  misc_feature: Ceres CLONE 238877
  misc_feature: Encodes the peptide sequence at SEQ ID NO. 1339
agacgctccagaatccaaatacctttccatcgattcttggcatcgcccttctctctaaaccccaactcctcgactcgagcaatccctaggtctccgcgcgaggcggtggcggctgtgaggggattttgattgatttggctcgagatggcggaggacaaggtgcggcggatcttcgtcggcgggttgtcctggaagaccacggagcgcacgctcgagcgcaccttcggtcagtacggcaaggtcatcraggcacaggttgtagtgaaaaagraaacaggccgctcgaggggatttgratttgtcacattctcagaacctcgggctgtggatgctgccatttgtggaatgcataatgcggaactggatggcccgtaatattactgtgaacaaagctaaacctaggattgctgactatggctatggtggtggtggtggtggttactcgtctggtgctagaggtggatatcgtagtggcggtgatgtagttccagcagtgagtgatgaatgtttcaaatgcggcctttctggacattgggctcgtcaatgcccttattcagatggcagtggtagaactggaagatattctcccgcttcaaggtatggtggtggcactgggagacatggtgaccgctttggaggatcagatcgttttgctcgctatgatgatgaccgatatgatggtggccgctatgtagacagcagggatacttattatggtgctgggcgagatcgttatgctaacgatcgccatccgccagcaacagacctctattctggtgacaggtacagtggtgcagatcgttacgcgtccagtggctttgccgggcgagatcgttatgctaacgatcgccatccgccagcaacagaccgctattctggtgacaggtacagtggtgcacgtcgttccgcgtccagtggctttgccagagaaaggagctatgagagagatggaggcaggtccactggaacttactaccgtgatgttccgaggggcactggtggctatggcagaggtggttcacgtggcggtagcggcggcggcggcgggcctgctcgctttggtgggagttaccgagataggcctgctccgtatgaccgtcctagcaggggcggggcagctcgtgcttatgatgatcgttactgaagaatgtttccttgaagtagaacagagatgttggtgtattttagttttgcatcagtatttgcacttgccagcttgatccttcaattctatgctattcagcagcgcagtttgttttagtggtctctgaagacaatggttcagtatgtcagttactatcagtatgttggtaccataatctgtaggcagtgatcctggtccatttgacatgtttgtgtaattgcttggagtctgcactaaataatgaactaatcgcagcatgtgatctttgaatcaaaaaaaaaaaaaaaaaatatc

SEQ ID NO: 1339 - protein, 271 aa, Zea mays
  misc_feature: Ceres CLONE 238877
  misc_feature (58)..(75): Pfam Name: zf-CCHC Pfam Description: Zinc knuckle
MLPFVECIMRNWMARNITVNKAKPRIADYGYGGGGGGYSSGARGGYRSGGDVVPAVSDECFKCGLSGHWARQCPYSDGSGRTGRYSPASRYGGGTGRHGDRFGGSDRFARYDDDRYDGGRYVDSRDTYYGAGRDRYANDRHPPATDLYSGDRYSGADRYASSGFAGRDRYANDRHPPATDRYSGDRYSGARRSASSGFARERSYERDGGRSTGTYYRDVPRGTGGYGRGGSRGGSGGGGGPARFGGSYRDRPAPYDRPSRGGAARAYDDRY

SEQ ID NO: 1340 - DNA, 219 bp, Zea mays
  misc_feature: Ceres CLONE 238884-F
  misc_feature: Encodes the peptide sequence at SEQ ID NO. 1341
  misc_feature (120)..(120): n is a, c, t, g, unknown, or other
  misc_feature (121)..(121): n is a, c, t, g, unknown, or other
atcccaaaccatccattaccatattcctaagctatcatggtgcaccggacttccatagccgatgtgcatgtgtatgtgcatggatctaagcccaaagaaacccaacaaggccagcgccanncggcggastactacgactggtcccccgccgatctgcccatgctcggcgttgcctccattggtgmcgccaagctctgcctcaccgccggagtcttgccc

SEQ ID NO: 1341 - protein, 61 aa, Zea mays
  misc_feature: Ceres CLONE 238884-F
  misc_feature (28)..(28): Xaa is any aa, unknown, or other
  misc_feature (29)..(29): Xaa is any aa, unknown, or other
  misc_feature (31)..(31): Xaa is any aa, unknown, or other
  misc_feature (50)..(50): Xaa is any aa, unknown, or other
MVHRTSIADVHVYVHGSKPKETQQGQRXXAXYYDWSPADLPMLGVASIGXAKLCLTAGVLP

SEQ ID NO: 1342 - DNA, 221 bp, Zea mays
  misc_feature: Ceres CLONE 238917-F
  misc_feature (119)..(119): n is a, c, t, g, unknown, or other
aggaccagtgcctcttcggtcaaaaatatccttgtacctgcatctcgacctcaccggcgtccgcggtggtatcacgatggtggcgttgctgggccggcggatcggggtggctgcggcantgcsgtttcatcgccctcgtggcgttcggatccgcctcatcctcgcccaagtccttcgttgaagtccaccgtcttccgcccacgacgtcgtcatctttctcc

SEQ ID NO: 1343 - DNA, 264 bp, Zea mays
  misc_feature: Ceres CLONE 239081-F
  misc_feature: Encodes the peptide sequence at SEQ ID NO. 1344
  misc_feature (24)..(24): n is a, c, t, g, unknown, or other
gcattcccctgctcgatcmcmggngaggmmttcgccccgaatccatcgatttgmtcagtccagtccgccgatccgtggatcgattcgtgcgtggrctctgtcctccccggvgttccgatctggtcctcgcctcgccggagaggagctggaggagatgaacggcaccgggggcagccaccaccagcagcagcacaggctccggcagcagcagcagcagcaggcgctcctgatgcagcaggcgctsagcagcagagcagcaacatc

SEQ ID NO: 1344 - protein, 36 aa, Zea mays
  misc_feature: Ceres CLONE 239081-F
MNGTGGSHHQQQHRLRQQQQQQALLMQQALSSRAAT

SEQ ID NO: 1345 - DNA, 225 bp, Zea mays
  misc_feature: Ceres CLONE 239085-F
  misc_feature: Encodes the peptide sequence at SEQ ID NO. 1346
ggatccggactatggtctgtytatattgaataatcactcttctccgttcacaccctgtgcgcgcgggctctcttcgtcgtgcggcaactgcgcgaccgccgacgcccgacggcaggtgcaccaggtcttcgtcgaccccttcgcaaggcctcggttccatccttcgccggrvccggcccgttcaacaggacttgatctactactcactagcggtttagagggcga

SEQ ID NO: 1346 - protein, 74 aa, Zea mays
  misc_feature: Ceres CLONE 239085-F
  misc_feature (7)..(7): Xaa is any aa, unknown, or other
  misc_feature (57)..(57): Xaa is any aa, unknown, or other
DPDYGLXILNNHSSPFTPCARGLSSSCGNCATADARRQVHQVFVDPFARPRFHPSPXPARSTGLDLLLTSGLEG

SEQ ID NO: 1347 - DNA, 502 bp, Zea mays
  misc_feature: Ceres CLONE 239086-F
  misc_feature: Encodes the peptide sequence at SEQ ID NO. 1348
  misc_feature (379)..(379): n is a, c, t, g, unknown, or other
atcacaagccagaacagccaagaacagagatacccaagtyaccgaagcamccgctcacaatcccaatctcccgcgtcactcaaaacccgaagtaacacaaccgtcggtccgaccaacaatgtcgctgattcgccgtggaaacgcattcgaccccttctmcctcgacctctgggaccccttcgagggcttcttccccttcggctccggcgacgtccgcagcctcgttccctcgttgccgcgcaccagctcggagaccgcggcatttgccggcgcgcggatcgactggaaggagacacccgaagcgcacgtgttcaaggcggacgtgccggggctgaggaaggaggaggtcaaggtggaggtcgaggacggcaacgtctgncagatcagcggcgagcgcaacaaggagcacgaggagaagaacgacaggtggcaccggggtggagcgcmagkcggcaagttccttcgcaggttcagactgccggacaacgccaaggcagaccag

SEQ ID NO: 1348 - protein, 128 aa, Zea mays
  misc_feature: Ceres CLONE 239086-F
  misc_feature (55)..(128): Pfam Name: HSP20 Pfam Description: Hsp20/alpha crystallin family
  misc_feature (14)..(14): Xaa is any aa, unknown, or other
  misc_feature (87)..(87): Xaa is any aa, unknown, or other
  misc_feature (110)..(110): Xaa is any aa, unknown, or other
  misc_feature (111)..(111): Xaa is any aa, unknown, or other
MSLIRRGNAFDPFXLDLWDPFEGFFPFGSGDVRSLVPSLPRTSSETAAFAGARIDWKETPEAHVFKADVPGLRKEEVKVEVEDGNVXQISGERNKEHEEKNDRWHRGGAXXGKFLRRFRLPDNAKADQ

SEQ ID NO: 1349 - DNA, 316 bp, Zea mays
  misc_feature: Ceres CLONE 239087-F
  misc_feature: Encodes the peptide sequence at SEQ ID NO. 1350
  misc_feature (44)..(44): n is a, c, t, g, unknown, or other
  misc_feature (152)..(152): n is a, c, t, g, unknown, or other
  misc_feature (163)..(163): n is a, c, t, g, unknown, or other
awcttctcccccagctccccagcaccagtccccaattatttggnctccgtcagagaggggagaaagacccgttcgaggcggcggcgatgtcggggcgcggcaagggcggcaaggrtctgggcaaggsmtggagccaagcgccaccggaaggnctccgcgacancatccagggcatcaccaagccggcgatccggaggctggctcggaggggcggcgtgaagcsatctcggggctcatctacgaggagacccggcggcgtgctcaagatcttmctcgagaacgtcatccgckacgccgtcacctacaccgagcacgc

SEQ ID NO: 1350 - protein, 76 aa, Zea mays
  misc_feature: Ceres CLONE 239087-F
  misc_feature (10)..(10): Xaa is any aa, unknown, or other
  misc_feature (14)..(14): Xaa is any aa, unknown, or other
  misc_feature (26)..(26): Xaa is any aa, unknown, or other
  misc_feature (46)..(46): Xaa is any aa, unknown, or other
  misc_feature (62)..(62): Xaa is any aa, unknown, or other
  misc_feature (69)..(69): Xaa is any aa, unknown, or other
MSGRGKGGKXLGKXWSQAPPEGLRDXIQGITKPAIRRLARRGGVKXSRGSSTRRPGGVLKIXLENVIRXAVTYTEH

SEQ ID NO: 1351 - DNA, 96 bp, Zea mays
  misc_feature: Ceres CLONE 239108-F
aataagaaaaatactcccgtgttcttcgaccggcggcggtggtgcgamgaggcggtaagggagacgagatgagggggacgaagcggccgctcggcg

SEQ ID NO: 1352 - DNA, 166 bp, Zea mays
  misc_feature: Ceres CLONE 239115-F
  misc_feature (121)..(121): n is a, c, t, g, unknown, or other
aaaaatcgaaacaaagaaagaaaaaatcgagaggacgccagggccgattctytgcgtgacttggggcgtcgtcgcgagttttctccggccgagggcggcgcgaccggacaaccagcgtganctgaccggcgacatgactcgcggcaaccagcgtgaccgcgaccgt

SEQ ID NO: 1353 - DNA, 257 bp, Zea mays
  misc_feature: Ceres CLONE 239204-F
  misc_feature: Encodes the peptide sequence at SEQ ID NO. 1354
  misc_feature (179)..(179): n is a, c, t, g, unknown, or other
  misc_feature (180)..(180): n is a, c, t, g, unknown, or other
atctcctcacttcacaccactcccgccattgtyctgcgcctttctgcaccgccacacacaccccgckssaatccaatggcgcctcgcaagccgtcctcgcggtcgtggtcctcgccgcgctgctcccgctcgcyctctctcgcgggctgcggcttggccaccaccgcgcccagccgcanncgaggccgcacggtcacgcaccgctcggaggtggcgcgtggtcctcggcccacgccaccttctacggcggcggcgac

SEQ ID NO: 1354 - protein, 85 aa, Zea mays
  misc_feature: Ceres CLONE 239204-F
  misc_feature (11)..(11): Xaa is any aa, unknown, or other
  misc_feature (22)..(22): Xaa is any aa, unknown, or other
  misc_feature (23)..(23): Xaa is any aa, unknown, or other
  misc_feature (59)..(59): Xaa is any aa, unknown, or other
  misc_feature (60)..(60): Xaa is any aa, unknown, or other
LLTSHHSRHCXAPFCTATHTPXXSNGASQAVLAVVVLAALLPLALSRGLRLGHHRAQPXXRPHGHAPLGGGAWSSAHATFYGGGD

SEQ ID NO: 1355 - DNA, 109 bp, Zea mays
  misc_feature: Ceres CLONE 239205-F
  misc_feature (2)..(2): n is a, c, t, g, unknown, or other
  misc_feature (51)..(51): n is a, c, t, g, unknown, or other
angctcgcagcctcgcttagacagacacacacacacactcaacagcaacanctaagcckctcccaccagacagcaacatggctgaggaggaggccaagaaggtggaggt

SEQ ID NO: 1356 - DNA, 215 bp, Zea mays
  misc_feature: Ceres CLONE 239213-F
atgcctctgccaacaaacaaagaacagacctatcgctacacagtccgccgtggctctctgcaattatggctgcctccacagcgtcgtcgtcatactctgccggtctaagcgccgcctgctgtgtgtctcgcgccatggcagcagcttcgtcaagccgcagcgctctggacggccggcggggcggcgacgcgaccctgccgcgtcagcgcgaccag

SEQ ID NO: 1357 - DNA, 185 bp, Zea mays
  misc_feature: Ceres CLONE 239220-F
  misc_feature (10)..(10): n is a, c, t, g, unknown, or other
  misc_feature (86)..(86): n is a, c, t, g, unknown, or other
  misc_feature (87)..(87): n is a, c, t, g, unknown, or other
attgcaagcnttcccggttacttgttcactagcaaggtcgggacggcatggccttggagctgcgtaccatcactacctgcagctcnncggcgaccatggcaccgcacacacgcactgckcctcggcgtacttatcttcctcgtcatccgcctagtatccgcaaggcgaaccggcacaacctcagc

SEQ ID NO: 1358 - DNA, 397 bp, Zea mays
  misc_feature: Ceres CLONE 239239-F
  misc_feature: Encodes the peptide sequence at SEQ ID NO. 1359
  misc_feature (168)..(168): n is a, c, t, g, unknown, or other
  misc_feature (175)..(175): n is a, c, t, g, unknown, or other
accctggttcgtcgaagcaccctagtcgtcgtagcggcctacgggctcttggtgyagagagagaagctgcatagccagtcgctcctgcatatgctccagctgctgcgcgcaatgatggcactgacggagcggcaccgcagctggagaagaagccggcgcgcgggaggncgcsctntcggggaaggccgtcgcggcgctgtgstgacgagcttcgtcgtggggctgctgcttagcggcaacgtgtcgctcatgtcggcctcggcgtcgstccgttcctcgagcacggacagcgccgacagcgacaagagcattcgtgtttccggttgcgacaatgagcgtaaactcggagagaaccaccccaagggatctcctgaacgaggtgtcgagaactcatcaa

SEQ ID NO: 1359 - protein, 132 aa, Zea mays
  misc_feature: Ceres CLONE 239239-F
  misc_feature (19)..(19): Xaa is any aa, unknown, or other
  misc_feature (58)..(58): Xaa is any aa, unknown, or other
  misc_feature (59)..(59): Xaa is any aa, unknown, or other
  misc_feature (68)..(68): Xaa is any aa, unknown, or other
  misc_feature (90)..(90): Xaa is any aa, unknown, or other
TLVRRSTLVVVAAYGLLVXREKLHSQSLLHMLQLLRAMMALTERHRSWRRSRRAGGRXXGEGRRGAVXTSFVVGLLLSGNVSLMSASASXRSSSTDSADSDKSIRVSGCDNERKLGENHPKGSPERGVENSS

SEQ ID NO: 1360 - DNA, 94 bp, Zea mays
  misc_feature: Ceres CLONE 239241-F
aataagaaaaatactcccgtgttcttcgaccggcggcggtggtgcgamgaggcggtaagggagacgagatgagggggacgaagcggccgctcgg

SEQ ID NO: 1361 - DNA, 383 bp, Zea mays
  misc_feature: Ceres CLONE 239254-F
  misc_feature: Encodes the peptide sequence at SEQ ID NO. 1362
  misc_feature (178)..(178): n is a, c, t, g, unknown, or other
  misc_feature (269)..(269): n is a, c, t, g, unknown, or other
accctggttcgtcgaagcaccctagtcgtcgtagcggcctacgggctcttggktcagagagagaagctgcatascagtcgctcctgcatatgctccagctgctgcgcgcaatgatggcactgacggagcggcaccgcagctggagaagaagccggcgcgcgggarggcscctgtcggngaaggccgtcgcggcgctgtgstgacgagcttcgtcgtggggctgctgcttagcggcaacgtgtcgctcatgtcggcctcggcgtcgcgtncgtcctcgagcacggacagcgccgacagcgacaagagcattcgtgtttccggttgcgacaatggagcgtaaactcggagagaaccaccccaaggatctcctgaacgaggtgtcg

SEQ ID NO: 1362 - protein, 30 aa, Zea mays
  misc_feature: Ceres CLONE 239254-F
  misc_feature (8)..(8): Xaa is any aa, unknown, or other
MSASASRXSSSTDSADSDKSIRVSGCDNGA

SEQ ID NO: 1363 - DNA, 248 bp, Zea mays
  misc_feature: Ceres CLONE 239264-F
  misc_feature: Encodes the peptide sequence at SEQ ID NO. 1364
  misc_feature (49)..(49): n is a, c, t, g, unknown, or other
  misc_feature (120)..(120): n is a, c, t, g, unknown, or other
  misc_feature (165)..(165): n is a, c, t, g, unknown, or other
  misc_feature (182)..(182): n is a, c, t, g, unknown, or other
acaagccaaacgtgcagctgaggaatcgcacggcagtgacgtgtgcgcnttgccaaataaagctactatactagtcaccgctcgattgccgtcgcagccgcccgcyggccggagatktgntgcgccggcgctgtcgtccgtcgtcgtggtgagccacggcggcantargtttgcctgtgcgnggcctttgcgcaggcgcaggacatggacagcgagtgggcgcggccgkcctaccgcgggttcttcgg

SEQ ID NO: 1364 - protein, 82 aa, Zea mays
  misc_feature: Ceres CLONE 239264-F
  misc_feature (39)..(39): Xaa is any aa, unknown, or other
  misc_feature (40)..(40): Xaa is any aa, unknown, or other
  misc_feature (55)..(55): Xaa is any aa, unknown, or other
  misc_feature (56)..(56): Xaa is any aa, unknown, or other
  misc_feature (61)..(61): Xaa is any aa, unknown, or other
QAKRAAEESHGSDVCALPNKATILVTARLPSQPPAGRRXXAPALSSVVVVSHGGXXFACAXPLRRRRTWTASGRGRPTAGSS

SEQ ID NO: 1365 - DNA, 379 bp, Zea mays
  misc_feature: Ceres CLONE 239284-F
  misc_feature: Translation starting site: 65
  misc_feature: Pfam Name: Ribosomal_L6e_N Pfam Description: Ribosomal protein L6, N-terminal domain
  misc_feature (187)..(187): n is a, c, t, g, unknown, or other
atttttcgaccgccgccgcccccagtccccgatccgaagctgtgcctcgtaccatttcgatccaatggcgccgacgtcgaagctgtcgacgggcatcaagcgcgcttcsgtcgcacacgtaccatcgccgtgggctgtgggccatcaaggcaagaacggcggcgcttccccaaggccgacaaggccncgccgrccgtggaacccaagttctaccctgccgacgacgtcaagccccgcgtttcccagcacccgcaagcytaagcctaccaagctcaggtcgagcatcacgcctgggacggtgctgatcctcctcgcaggggcgcttcatggggaaragagtggtgtttctcaagcaggctcaagtctgggcctgctcctt

SEQ ID NO: 1366 - DNA, 429 bp, Zea mays
  misc_feature: Ceres CLONE 239292-F
  misc_feature: Encodes the peptide sequence at SEQ ID NO. 1367
  misc_feature (115)..(115): n is a, c, t, g, unknown, or other
ctaccggagcgcgtctcggggaggagagagaaagtcagatccgtgttccgtgtccgcgtccagtgtgtccgctactccgctccccctcagtcctcagttcctcacctagcggtankkgcgcgcgggagacgtagatggcggcttcggaggcggcacggcggcgcaacaccggtracgcgacagaggggacggtgatcgcgatccacagcctggaggagtggagcatccagatcgaggaggccaacaggcgccaagaagctggtggtgattgacttcactgcaacatggtgtcctccgtgccgcgccatggctccaatttttgctgatatggccaagaagtccccaaakgttgttttcctgaaagttgatgtcgatgaaatgaagaccattgctgagcaattcagcgtagaggccatgcaacattcctgt

SEQ ID NO: 1367 - protein, 41 aa, Zea mays
  misc_feature: Ceres CLONE 239292-F
  misc_feature (14)..(14): Xaa is any aa, unknown, or other
MAPIFADMAKKSPXVVFLKVDVDEMKTIAEQFSVEAMQHSC

SEQ ID NO: 1368 - DNA, 292 bp, Zea mays
  misc_feature: Ceres CLONE 239310-F
  misc_feature (57)..(57): n is a, c, t, g, unknown, or other
  misc_feature (171)..(171): n is a, c, t, g, unknown, or other
aaaaaacaataagcacttgttcatcatcatcagagtaaacacagcagaaccctagcnbgccgttcctccgacgactcacatcccacccactcacccaccccatggcggccaagctctccaccagcgccgacgccccggcctcggtgcggctctccgcagcagcgcaggcgnctgattccagccctcctctccgcgcttcttcttctcctcgctggccgggaccaacccggcttccccgcatcgccgcatcgccattgccgtcgatctctccgacgagtccgcchttcgccgt

SEQ ID NO: 1369 - DNA, 383 bp, Zea mays
  misc_feature: Ceres CLONE 239417-F
atctaaattaacacaagcagtcaaacgcatgcacacacaaggttgttgttagcaatttttctgctgctgctatacatacacgagctgcgcgcgattggccgccctggcagctgcacttgttgcgctcctcgccgtgcttgctgtcgcgcatcctgtcgccgtcgcacaatcggtggcgaaccgcacctccgccgtccgycagctccgcgttactccagcgaaggcgttggctggcggccaaggccacctggtatggcacgcccaacggcgccggccccgacgacaacggcggcgcgtgcdggttcaagaacaccaaccggtacccgttcatgtccatgacgtcgtgcggcaaccaghycctgttccaggacggccagggctgc

SEQ ID NO: 1370 - DNA, 467 bp, Zea mays
  misc_feature: Ceres CLONE 239428-F
  misc_feature: Encodes the peptide sequence at SEQ ID NO. 1371
ctctctctacataaacaaaaaccagtcctttgttcttcttcccccggcacgcccagcgccagttcaccaaccttccactccctccctccgtcgccatggcgcgcaagaagatccgggagtacgactccaagcgcctcctcagggagcacctcaagcgcctcgccggcatcgacctcaccatcctctccgcccagatcacgcaatcaacggacttcgcggasttgtgagccagcagccatggctgtcaaccatgaagctagtggtgaagcctgatatgctgttcgggaagcgtgggaagagcggcctcgtggctctcaacttggatttcaatcaagtcaaggagtttgtcaaggagcggctgggggttgaggttgagatgggtggctgcaaggctccaatcacgaccttcatcgtcgagccatttgtgccacatgatcaagagtactacctttcgattgtctcagaga

SEQ ID NO: 1371 - protein, 72 aa, Zea mays
  misc_feature: Ceres CLONE 239428-F
  misc_feature: SWISSPROT Homolog: EC 2.3.3.8 ATP citrate synthase
  misc_feature: Functional homolog of the protein sequence given in SEQ ID NO 96860
  misc_feature: Useful for making plants with modulated root development
MKLVVKPDMLFGKRGKSGLVALNLDFNQVKEFVKERLGVEVEMGGCKAPITTFIVEPFVPHDQEYYLSIVSE

SEQ ID NO: 1372 - DNA, 201 bp, Zea mays
  misc_feature: Ceres CLONE 239458-F
  misc_feature (29)..(29): n is a, c, t, g, unknown, or other
  misc_feature (30)..(30): n is a, c, t, g, unknown, or other
  misc_feature (52)..(52): n is a, c, t, g, unknown, or other
atcttcgcatctggcacgagcagccaagnnaataaaagtagagcggcgagcncgaccggcctgggccactctttcggccgagcgtacgcagcaggtcgtcgtcgtcgtcgtcgtcgcagcacccggccggctagcatggccacgaggaggcagtggtggtggtggtgcctgctgctgctggcggcgtggtgctgcgccgcg

SEQ ID NO: 1373 - DNA, 398 bp, Zea mays
  misc_feature: Ceres CLONE 239529-F
  misc_feature: Encodes the peptide sequence at SEQ ID NO. 1374
  misc_feature (140)..(140): n is a, c, t, g, unknown, or other
  misc_feature (153)..(153): n is a, c, t, g, unknown, or other
ttatccccccggagctggtgcgcgagtcggagctggtgcagggtcaccttcccctcggcctcaagagctctgcgttgccgcggcacaagggcgtccgtgagagaagmgggacaggtggcggcgatggaagagcaaggcgnccaggcggcgctngggtgggcggccarggacgactccggcgactmtccccctacagcttctccagaagggttcctaaagacgacgatktcacgatcaaggtgctctactgcgggatctgccacaccgacctgcacgtcatcaagaacgactggcgaaacgcatggtacccagtcgtcccggggcacgagatcgtgggcgtggtgaccggcgtcggcggcggcgtcacgcggttcaaggccgggcgacacggtcggcgt

SEQ ID NO: 1374 - protein, 132 aa, Zea mays
  misc_feature: Ceres CLONE 239529-F
  misc_feature (73)..(131): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (35)..(35): Xaa is any aa, unknown, or other
  misc_feature (51)..(51): Xaa is any aa, unknown, or other
  misc_feature (76)..(76): Xaa is any aa, unknown, or other
IPPELVRESELVQGHLPLGLKSSALPRHKGVRERXGTGGGDGRARRPGGAXVGGQGRLRRLSPYSFSRRVPKDDDXTIKVLYCGICHTDLHVIKNDWRNAWYPVVPGHEIVGVVTGVGGGVTRFKAGRHGRR

SEQ ID NO: 1375 - DNA, 96 bp, Zea mays
  misc_feature: Ceres CLONE 239555-F
  misc_feature: Encodes the peptide sequence at SEQ ID NO. 1376
  misc_feature (44)..(44): n is a, c, t, g, unknown, or other
agattccgcattcctctctgtcacctccgcggcgtcgccagcbngccatcacataacttcggcttctatcccttcgtaaacccttctctcttcttc

SEQ ID NO: 1376 - protein, 32 aa, Zea mays
  misc_feature: Ceres CLONE 239555-F
  misc_feature (15)..(15): Xaa is any aa, unknown, or other
RFRIPLCHLRGVASXPSHNFGFYPFVNPSLFF

SEQ ID NO: 1377 - DNA, 353 bp, Zea mays
  misc_feature: Ceres CLONE 239556-F
  misc_feature (162)..(162): n is a, c, t, g, unknown, or other
  misc_feature (209)..(209): n is a, c, t, g, unknown, or other
  misc_feature (344)..(344): n is a, c, t, g, unknown, or other
aaagctctaaagtccaatccctcgctagccacttgccatctgatcaaccagccagccgatctcagcgatccgccatggccaccgcgtattacgagaggccccgtggcggcgcgtcgaggaggcggacgacttcgatgagttcgaccccacgccgtacgsttnggttaacgacctcgccgtcacmttcggtcgcccgctgcyaccgtccnaggaaacctgctacccgtgctcggcgccctcgacctcctacgacgcaccgcactacgccgcctccgagccgtccccctacggtcaccasgccaagccaaagcccaactatgggttccgcccccagcaggagcaanagccgtctt

SEQ ID NO: 1378 - DNA, 299 bp, Zea mays
  misc_feature: Ceres CLONE 239560-F
  misc_feature: Encodes the peptide sequence at SEQ ID NO. 1379
awaccgcatcgcatcgtcttctagggtttcctcctcccgccgccacttgccgccccacgagcccattcccctcagcccttcaccatctccggcggccgcagtggcatcagcagctccggctcacgcgcagtgaaggaacgacaatatggcgaccatcgtaaacacgacggaggaggagchgmtgctggccgtggtccgcttcaccgctgagctcgcctgggccgacgcgggcccgggagtcgccgacccgaggtcacccgcctatgtctcgaggcgcaggagcattatcctcgcggggc

SEQ ID NO: 1379 - protein, 51 aa, Zea mays
  misc_feature: Ceres CLONE 239560-F
  misc_feature (12)..(12): Xaa is any aa, unknown, or other
  misc_feature (13)..(13): Xaa is any aa, unknown, or other
MATIVNTTEEEXXLAVVRFTAELAWADAGPGVADPRSPAYVSRRRSIILAG

SEQ ID NO: 1380 - DNA, 449 bp, Zea mays
  misc_feature: Ceres CLONE 239567-F
  misc_feature: Encodes the peptide sequence at SEQ ID NO. 1381
awagaaaaacggtgagctagaaacttccaaatcgaacggcacacaaaaatcacaacccggaaagggaccagcagcgcaaaggtgagcgagctttccttcggaactctcgtgctcacctcatccgtccgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctmtgcgccgggagagtwagacggccatgctgccgat

SEQ ID NO: 1381 - protein, 87 aa, Zea mays
  misc_feature: Ceres CLONE 239567-F
  misc_feature (10)..(80): Pfam Name: S1FA Pfam Description: DNA binding protein S1FA
  misc_feature (76)..(76): Xaa is any aa, unknown, or other
  misc_feature (81)..(81): Xaa is any aa, unknown, or other
MADQFVDSANNVIIEEVNKGLNPGMVVLLVVASFLLLFFVGNYALYVYAQKTLPPKKKKPVSKKKLKREKLKQGVXAPGEXDGHAAD

SEQ ID NO: 1382 - DNA, 1504 bp, Zea mays
  misc_feature: Ceres CLONE 239575
  misc_feature: Encodes the peptide sequence at SEQ ID NO. 1383
gaaaaacctcaccggctccattccaatccatcttttccttatcccctctccctcccttcgttcgccatggcaaccgtgttcctccgttccctcgccatggccatggccgacaccgcgctcccgcccacccatcaagctcctccctacggtttccctgccgctcctcccctcgtccacccgcgccgcgccgctcctcctctgcgccaccgccgcctgccgcccgcgcccctcgttgcctcctccgacgccgtcgagacgagcattgaatgggttgacgacgaggaggaggaggctggagaagccttcgacgaggagggtgaggatgttgaggaggaggtgctggcctcaggcgacgagggggaaggggagtacgccgcggtggagccgcccgaggaggcaaaggtctacgttgggaacctcccctacgacatcgaaagcgagggactcgcgcagctcttcgaccaggccggcgtcgtcgaggtcgccgaggttatttacaacaaagagactggccagagccgtgggtttggctttgttaccatgagcactattgaggaagctgataaagccattgagatgttcaaccgctatgacattagtgggaggcttctgaatgtaaacagggcatctcctaggggcactcgcatggaaaggcctccgagacaatttgcgcctgctttcagagcttatgttggcaacttgccatggcaagctgatgactctaggctggtgcaattgttcagcgagtacggagaagtcgttaatgctgcggttgtctatgatagagaaaccgggcgctcacgaggattcggttttgtaacgatggtgtcgaaggaggaactcgacgacgctatctctgccctggatggacaggaattggacggccgccctcttcgggtgaacgttgcagcagagcgaccacagaggggcttttgatgcggcggtacgagagagatggctgcttgtttgtgatgagagcacggagacacaacgcaggaggaacggtacaaattagcggaagctgatgctgtcacaagttgctagatccctcccttagcttcctgattttggttcttgtcgacatcatcatgagttaaattatccaagtaggcttctatgtttgatctatcccgattcccgatgccttatcaatttatcatcgttggcaaatgttttgttggtaaaaccataggagcaaacggagattatttatatctgacgtataaaaccgtacccagtgtgttgcatttaacattcatctctccttgacacttcgacggtgtattggtcaaccagttctcgcttcagtctggaagcgttcccaattaggtcatgttccgttttcacggattggaggcttgaaacaatttctagccagcatttatataagttttaatgacttggaacaaattctggtcgaatcctggagaaacgaatgtatcggaatgagaccaagaactatttcagctcaaataaacatatcattccaaaaaaaaaaaaaaaa

SEQ ID NO: 1383 - protein, 289 aa, Zea mays
  misc_feature: Ceres CLONE 239575
  misc_feature (207)..(278): Pfam Name: RRM_1 Pfam Description: RNA recognition motif. (a.k.a. RRM, RBD, or RNP domain)
  misc_feature (113)..(184): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MATVFLRSLAMAMADTALPPTHQAPPYGFPAAPPLVHPRRAAPPLRHRRLPPAPLVASSDAVETSIEWVDDEEEEAGEAFDEEGEDVEEEVLASGDEGEGEYAAVEPPEEAKVYVGNLPYDIESEGLAQLFDQAGVVEVAEVIYNKETGQSRGFGFVTMSTIEEADKAIEMFNRYDISGRLLNVNRASPRGTRMERPPRQFAPAFRAYVGNLPWQADDSRLVQLFSEYGEVVNAAVVYDRETGRSRGFGFVTMVSKEELDDAISALDGQELDGRPLRVNVAAERPQRGF

SEQ ID NO: 1384 - DNA, 447 bp, Zea mays
  misc_feature: Ceres CLONE 239719-F
  misc_feature: Encodes the peptide sequence at SEQ ID NO. 1385
  misc_feature (44)..(44): n is a, c, t, g, unknown, or other
  misc_feature (136)..(136): n is a, c, t, g, unknown, or other
  misc_feature (392)..(392): n is a, c, t, g, unknown, or other
atcgcctccaccgttctctcttcctctgctcttctctgcctgcntgagctcaccgcacctcgcctcctcaccgcgtttcctccgttaatccggtagaaaatggccgatgccgaggatatccagcccctcgtctgcnacaacggaactggcatggtcaaggctgggttcgccggcgacgacgccccgagggccgtcttccccagcatcgtggggcgcccgckcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctaacaacgagctccgcknggctcccgaggagcaccccgtcctcctcacccgaggcgccctgaaccccaaggct

SEQ ID NO: 1385 - protein, 47 aa, Zea mays
  misc_feature: Ceres CLONE 239719-F
  misc_feature: SWISSPROT Homolog: EC 2.7.10.2 Non-specific protein-tyrosine kinase
MVGMGQKDAYVGDEAQSKRGILTLKYPIEHGIVSNWDDMEKIWHHTF

SEQ ID NO: 1386 - DNA, 714 bp, Zea mays
  misc_feature: Ceres CLONE 239759-R
  misc_feature: Translation starting site: 286
ccgaattgggtaccgggccccccctcgaggtcgacggtatcgataagcttttttttttttttttttcgagctgattaggaacgaaaacttatttatttctgagaagttcaccacaggccgcagctattgcgaccacacctcacaaacaaccatcagagttcaggcacttcacacctcaccaaaccaaacctcgaacactaaccaacttaatccacctcctcgatgttgggaccagcaccgctcccaccagacggggcatcctcatccatgccagcagcagcgcccatgcccgcgccctcgccctggtacatcttcgcgatgatggggttgcagatcccctcaagctctttcatcttgaactcgaactcctacacgacagccagctgggtgctgtcaagacagctgatgccgcccgtcacgggatcgtagaatctcttgcaggcctcaggggggagcttggaggcatcttgccggcctggagggggccctcaggtgggagcataatctcgagggggtctatgggtccaccttctcttgcccccagggcccgggcgtggaactctcagccccggggacaatttccaatccccccctgaaaaccggcccttgcttagggaaccaaaattttgttttgggcgggggggtggccccgggaaaaacttgggaaacccctgggggccaatgggaaggaccccggtttgggggccccccggg

SEQ ID NO: 1387 - DNA, 159 bp, Zea mays
  misc_feature: Ceres CLONE 239816-F
  misc_feature (47)..(47): n is a, c, t, g, unknown, or other
  misc_feature (135)..(135): n is a, c, t, g, unknown, or other
gaaacctagaaccctcttcccccgcgatggccgcaggagcgcggcgnctcgcggcgcgcgcgtccgaacgtgctagtgacggggacgccggggacgggaagacgaccacgtgctcgctccttgccgacgccgcmntccgccacgtcaacatcggcgacc

SEQ ID NO: 1388 - DNA, 371 bp, Zea mays
  misc_feature: Ceres CLONE 239831-F
  misc_feature: Encodes the peptide sequence at SEQ ID NO. 1389
  misc_feature (259)..(259): n is a, c, t, g, unknown, or other
  misc_feature (366)..(366): n is a, c, t, g, unknown, or other
aaacctagaaccctcttcccccgcgatggccgcaggagcgcggcgctcgcggcgscgcgtccgaacgtgctagtgacggggacgccggggacgggaagacgaccacgtgctcgctccttgccgacgccgcmstccgccacgtcaacatcggcgacctagtccgcgagaagagccttcacgacggctggggacgccgacctcgagtgccatgtcatcaacgaggacctggtgtgcgacgagcttgaggacatgatggaanaaggtggtatactagtagattaccacggatgtgatttctttccagaacgttggtttgacctcgtagttgtgctccagactgacaactcaattctgcatgatcgcctnacggg

SEQ ID NO: 1389 - protein, 40 aa, Zea mays
  misc_feature: Ceres CLONE 239831-F
  misc_feature: SWISSPROT Homolog: EC 2.7.4.3 Adenylate kinase
  misc_feature (4)..(4): Xaa is any aa, unknown, or other
MMEXGGILVDYHGCDFFPERWFDLVVVLQTDNSILHDRLT

SEQ ID NO: 1390 - DNA, 258 bp, Zea mays
  misc_feature: Ceres CLONE 239874-F
  misc_feature: Encodes the peptide sequence at SEQ ID NO. 1391
  misc_feature (137)..(137): n is a, c, t, g, unknown, or other
gaagggaggagagcaaagcaggcagcacgggatccaaaatccaccacgatgagcagcggtggcggcggaaggcggcgggccccggcggcgagcaggcggaggtggaggcgcttatccgggcggcgcaggacgcggtngctcctgaagctcaaggcgaactcccacctcgtctcctcggcctccagccctccttcgctcgacgcggcggastcgatcccctggacagcgacctcgcccggcgcttcgacgcgctcaagt

SEQ ID NO: 1391 - protein, 85 aa, Zea mays
  misc_feature: Ceres CLONE 239874-F
  misc_feature (70)..(70): Xaa is any aa, unknown, or other
REESKAGSTGSKIHHDEQRWRRKAAGPGGEQAEVEALIRAAQDAVAPEAQGELPPRLLGLQPSFARRGGXDPLDSDLARRFDALK

SEQ ID NO: 1392 - DNA, 321 bp, Zea mays
  misc_feature: Ceres CLONE 239938-F
  misc_feature: Encodes the peptide sequence at SEQ ID NO. 1393
  misc_feature (133)..(133): n is a, c, t, g, unknown, or other
awccatcaatcctcatcrccacccaacccgccgagtccccaagcaagttgagcatccatccatccatggcgggaggcaagtccaccggcaatgcscgmgcaaggaagckcgtcgaggcaaccgtcctcaagcnctccagggacgggagcscttcaccagatarckaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgcmaagggaggtggta

SEQ ID NO: 1393 - protein, 85 aa, Zea mays
  misc_feature: Ceres CLONE 239938-F
  misc_feature (15)..(15): Xaa is any aa, unknown, or other
  misc_feature (23)..(23): Xaa is any aa, unknown, or other
  misc_feature (29)..(29): Xaa is any aa, unknown, or other
  misc_feature (33)..(33): Xaa is any aa, unknown, or other
  misc_feature (34)..(34): Xaa is any aa, unknown, or other
MAGGKSTGNARARKXVEATVLKXSRDGSXSPDXXACNKDVPVVLIDMHSCSLDEKIRMTLEAQVVEKTVEVASADRKKSSAKGGG

SEQ ID NO: 1394 - DNA, 240 bp, Zea mays
  misc_feature: Ceres CLONE 239981-F
  misc_feature (19)..(19): n is a, c, t, g, unknown, or other
  misc_feature (130)..(130): n is a, c, t, g, unknown, or other
  misc_feature (131)..(131): n is a, c, t, g, unknown, or other
  misc_feature (150)..(150): n is a, c, t, g, unknown, or other
cccacctccgcacaaackngtcgcttccgctccacaggatcctctgcgccacccacaaccgtgcgaccgtccgtgctgccggcgaccccgatccgccramccgtcmcgtcccaccacaccctaccgccgnncgcagctatgtcgccgtcngagccgacgcggcgaggagagcgtgtacawggccaagctggcagagmaggcggasggtacgaggagatggtcgagttcatggagcgcgtc

SEQ ID NO: 1395 - DNA, 365 bp, Zea mays
  misc_feature: Ceres CLONE 239992-F
  misc_feature: Encodes the peptide sequence at SEQ ID NO. 1396
  misc_feature (207)..(207): n is a, c, t, g, unknown, or other
  misc_feature (208)..(208): n is a, c, t, g, unknown, or other
gttctaacctgcgatctccgtccatccagccgagaggtcgtgtgcgcgtggatctctgcgtggaagcgatgaagattacggcgctcctggtgctgaagccgtcgacctctggagccgggagctcctcgtccggcggcgagtcgggcccggagcggtggtgctcgcgaacgcataraacgtcagccacttcggctacttccagcgcanncggcccgcgagttcatcgtcttcgttgcccgcaccgtcgctcagcgcacccagccaggccagcgcagtccgtccagcacgaagaatacaaggtccactcccacaatagaaatgggctttgtgcggttgcattcatggatgatcattatccggtacga

SEQ ID NO: 1396 - protein, 99 aa, Zea mays
  misc_feature: Ceres CLONE 239992-F
  misc_feature (36)..(36): Xaa is any aa, unknown, or other
  misc_feature (47)..(47): Xaa is any aa, unknown, or other
MKITALLVLKPSTSGAGSSSSGGESGPERWCSRTHXTSATSATSSAXGPRVHRLRCPHRRSAHPARPAQSVQHEEYKVHSHNRNGLCAVAFMDDHYPVR

SEQ ID NO: 1397 - DNA, 418 bp, Zea mays
  misc_feature: Ceres CLONE 239994-F
  misc_feature: Encodes the peptide sequence at SEQ ID NO. 1398
gttctaacctgcgatctccgtccatccagccgagaggtcgtgtgcgcgtggatctctgcgtggaagcgatgaagattacggcgctcctggtgctgaagmcgtcgacctctggagccgggagctcctcgtccggcggcgagtcgggcccggagcggtggtgcatcgcgaacgcatagacgtcagccacttcggctacttccagcgcmsccgcccgcgagttcatcgtcttcgttgcccgcaccgtcgctcagcgcacccagccaggccagcggcadmtccgtccagcacgaagaatacaaggtccactcccacaatagaaatgggctttgtgcggttgcattcatggatgatccattatccggtacgagtgcatttttctcttctgaatcaggttctygatgagtaccagaaggcttat

SEQ ID NO: 1398 - protein, 35 aa, Zea mays
  misc_feature: Ceres CLONE 239994-F
  misc_feature (11)..(11): Xaa is any aa, unknown, or other
MKITALLVLKXSTSGAGSSSSGGESGPERWCIANA

SEQ ID NO: 1399 - DNA, 520 bp, Zea mays
  misc_feature: Ceres CLONE 240063-F
  misc_feature: Encodes the peptide sequence at SEQ ID NO. 1400
  misc_feature (466)..(466): n is a, c, t, g, unknown, or other
agcacattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcaactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtactcccaggctgactgtgctgtcctgatcattgactccaccactggtgnttttgaggccggtatctctaaggatggccagaccgtgagcatgctctccttgct

SEQ ID NO: 1400 - protein, 113 aa, Zea mays
  misc_feature: Ceres CLONE 240063-F
  misc_feature (5)..(113): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVNSGKSTTTGHLIYKLGGIDKRVIERFEKEAAEMNKRSFKYAWVLDKLKAERERGITIDIALWKFETTKYYCTVIDAPGHRDFIKNMITGTPRLTVLS

SEQ ID NO: 1401 - DNA, 667 bp, Zea mays
  misc_feature: Ceres CLONE 240094-R
  misc_feature: SWISSPROT Homolog: EC 3.4.21.92 Endopeptidase Clp
  misc_feature (1)..(1): n is a, c, t, g, unknown, or other
  misc_feature (646)..(646): n is a, c, t, g, unknown, or other
ncgattgggtaccgggccccccctcgaggtcgacggtatcgataagcttttttttttttttttttcgagaaagaaacaaaagaggaaaaagtttgaatgtcctggcatggaattgatacaaatatagtacaacatacacaatactgtgtcaatttatcagtatcaacagtgcagaatttccttagagttgcaataattatatccccaatagctcaattgaagcaatttaagcaacaaggacaatggggagccggacgtttccataaccataataacaaggttaaccttgtatagtaagaattgaacctttggatctaacaacaaacaacacatccaccggatgaggaaggatttcacctttgaggccaatcctcacaccgcggaaggttcctcgacgtccctcccccgtccgccgccaacgccaccgagcctgggcacatcgaggcctccaccgattccgtcgggcatgaacgaggcaggtcgattctcgatgacctcgtcgatgaggccccagtcgcgcgcctcttcagggtccatgaagaggtccctctccatgcactgctcaatcttatcgatgggctggcgcgtgtgcttctggtagatcttgttgaggcggtcgcgcattttgaggatctccttggcctgnatggcgatgtcggtggcttgc

SEQ ID NO: 1402 - DNA, 317 bp, Zea mays
  misc_feature: Ceres CLONE 240145-F
  misc_feature: Translation starting site: 76
  misc_feature: SWISSPROT Homolog: EC 1.1.1.219 Dihydrokaempferol 4-reductase
agcgcggctgcctgtaaccactccaggtccccagcgamaggctcaggcgcaacgcaacaacacaaggcggcggttatggcctctgctgctgcgacggctacgatggggacggggaaggtggtttgcgtcaccggcgcatcagggtacatcgcgtcctggattgtcaggctcctactcgaccgcggctacaccgtccgcgccaccgtgcgagacaccgctgacccaaaagaaaacattgcacctgactgctttggatggtgctaaggataggctgcacttaatttaaaggctagcctgcttaaaagagggttctttcg

SEQ ID NO: 1403 - DNA, 443 bp, Zea mays
  misc_feature: Ceres CLONE 240161-F
  misc_feature: Encodes the peptide sequence at SEQ ID NO. 1404
atacgcacctaccctccgccaccgttccccccctctgcatctcgcccgccgttctcgtccttgtagatctcctcgcacctcgcccattcgcttcaccaagggtttaagaccggcggcgatggcggcgaacgtggcgcacgtgcgcacacaggtaacgcgtgcggcggagttcgcctcgaagcacggctgctcctactacaaggaggtaatggagaagaacaagcagtacgtcgttcagccccccaccgtcgagaagtgccagcagctctccaagcagctcttttacacccgcctcgcaagcctaccaggtcgctatgagtcattctggaaggagcttgattgtgtcaagcaggtatggaagaacaggaaggacctcacggttgaggaccttggcattgccagtttgtttggagttgagctctatgcatggttctgcgtaggcg

SEQ ID NO: 1404 - protein, 108 aa, Zea mays
  misc_feature: Ceres CLONE 240161-F
  misc_feature (8)..(108): Pfam Name: ATP-synt_G Pfam Description: Mitochondrial ATP synthase g subunit
MAANVAHVRTQVTRAAEFASKHGCSYYKEVMEKNKQYVVQPPTVEKCQQLSKQLFYTRLASLPGRYESFWKELDCVKQVWKNRKDLTVEDLGIASLFGVELYAWFCVG

SEQ ID NO: 1405 - DNA, 740 bp, Zea mays
  misc_feature: Ceres CLONE 240168-R
cgattgggtaccgggccccccctcgaggtcgacggtatcgataagcttttttttttttttttttcttttttttttttttttttttttttttttttttttttttttttgcaatgaatcaacgatctatttgctttagtcagaacattgtaactgatccaagaactaacaagtcatcgtttcttgagatcaacacccccccccactagactactctcgatcagttcgaagaatgcccagaccaacaaaacccacagggttttggctctcgagaaagcagatgaagcaactgacgtcaagtactactgcaagaaattagcaaaccatactgccaacagttcatactgagaattgaacagagtattatagctgatccaagaactaacaagtcatcgtttcttggcattcaaacattttggttcgttaagggggactcaaatctgaagtctgaacaaaagaacaggaacgcaactaagcttgatgagttcgaagcaagcaaaagctgaacaccgatcatcagaaagacgcactaccctcgatcagttccaaagaatgccgaaaaagaaatgaccaaagaatccttgaagaacctctgcgagaactgatccagttccagaccggcccacaggacgtgtcaacagcgtcctatccaagcttgatcacgcgcgtgtccactgccatgaaagcgcctcctctactatctcgctgtccaccggaactgaagcggcctcggcgtccgtttc

SEQ ID NO: 1406 - DNA, 474 bp, Zea mays
  misc_feature: Ceres CLONE 240185-R
  misc_feature: Encodes the peptide sequence at SEQ ID NO. 1407
agctgcagcagkttgtagctgaggagcatagtcaccacatgaacgccactcttgtcgaagcaaaaagacaagctactcaataccagcgagaagccgaaaagtgtaatgcagctacagagacctgcgaggaagctcgggagcagtctgaagtagcaatttcaaaggagaagaaactcacagcaatgtgggaacagcgagctcggcaactgggttggcatgattctcgagccacgagcatgtgacagctttagttctgaaatttcaggtgaaattatttctggtagctgcattacacttttcggcttctcgctggtattgagtagctgcttttatgcttgtggtgtggattctgttgtgccttgctttcatgattctgttttcctgtggtgaattggtgatagcctgagcagcaggttatcttctcctatatatcacatatttcggacctggttttttccaaaaaaaaaaaaaaaa

SEQ ID NO: 1407 - protein, 79 aa, Zea mays
  misc_feature: Ceres CLONE 240185-R
  misc_feature (4)..(4): Xaa is any aa, unknown, or other
LQQXVAEEHSHHMNATLVEAKRQATQYQREAEKCNAATETCEEAREQSEVAISKEKKLTAMWEQRARQLGWHDSRATSM

SEQ ID NO: 1408 - DNA, 294 bp, Zea mays
  misc_feature: Ceres CLONE 240189-F
  misc_feature (31)..(31): n is a, c, t, g, unknown, or other
atgccttgcctcctcctcctgcctgcctgcntttccctcgccgctcgcgsaagatccacatgcagtagtaggagtaggagcagcaagcaacaagggagggagggagcgaggtcttkggctctcgctctcttgttagttcctgcgtgcttgcyctgccctggatcggctttcaaatcgggaacaacgacagatccgaggctttctcgaatcgggcaggtccatcaaatcgcaagtttagccagccccagccccaggcacagccagctagccgtcaaatcactcacactcatcaaa

SEQ ID NO: 1409 - DNA, 341 bp, Zea mays
  misc_feature: Ceres CLONE 240235-F
  misc_feature: Encodes the peptide sequence at SEQ ID NO. 1410
  misc_feature (56)..(56): n is a, c, t, g, unknown, or other
  misc_feature (262)..(262): n is a, c, t, g, unknown, or other
aacgtctacttctgtgatttcccccggcggcgttgggcgctggtttaggagaaganaaggcggcgcgcggcggaaaaccctagcttagctcctctccggcgtcaagtgmtctccggtttgagggcgcgatgagggtgaaggtgatttcgcgttmcaccgacgactaaacgcgcgasagccaggacctgcagaaagtattccgcaactatgatccagcgmttcgtagtcaagagaaagctgttgagtatactcgggcactcantgctgccaagttyasagaagatatttgctaagccatttatcggagctatggatgggcatattgamgcggtatcgtgcat

SEQ ID NO: 1410 - protein, 44 aa, Zea mays
  misc_feature: Ceres CLONE 240235-F
  misc_feature (19)..(19): Xaa is any aa, unknown, or other
  misc_feature (23)..(23): Xaa is any aa, unknown, or other
  misc_feature (24)..(24): Xaa is any aa, unknown, or other
  misc_feature (40)..(40): Xaa is any aa, unknown, or other
MIQRFVVKRKLLSILGHSXLPSXXKIFAKPFIGAMDGHIXAVSC

SEQ ID NO: 1411 - DNA, 375 bp, Zea mays
  misc_feature: Ceres CLONE 240244-F
  misc_feature: Translation starting site: 77
accagagtcaccgcggcgagttcaaatcccacaatcttcttgtagcacaccactgtcttcgtccaactcggcggcgatgtctgggcgcggcaagggcggcaaggggctgggcaagggcggcgcgaaacgcaccgtaagttctccgcgacaacatccagggtatcamgaagccggcaatccaggaggctggcgaggaggggcggcgtgaagcgtatctccgggcttatctacgaggaaacccgmggcgtgctcaggatcttcctcgagaatgtcatccgcgacgstcacctacaccgagcacgctcgccagcaagaccgtcaccgcmatggatgttgtgtacgcctcaagcgccagggccgcactctgtacgggtt

SEQ ID NO: 1412 - DNA, 208 bp, Zea mays
  misc_feature: Ceres CLONE 240278-F
  misc_feature (73)..(73): n is a, c, t, g, unknown, or other
aacccagtgtgcgcacttcaccccccctctcggtctcaccctcctggcgacgactgggcggccgaacgscggnccgccgccccacgccaggtttcaaagtcttcgtcaggcccttctccggcgacttcgagcaccayagggtgacaaggatagctttctcgggtcactgaaggaagacatcttctcgacgcggtagaccttctgacgg

SEQ ID NO: 1413 - DNA, 204 bp, Zea mays
  misc_feature: Ceres CLONE 240307-F
  misc_feature (10)..(10): n is a, c, t, g, unknown, or other
  misc_feature (129)..(129): n is a, c, t, g, unknown, or other
accgcctctnaacctccgccgccgctcgcmcggggctcacccacccgcgcagaaggcccccgccgctcaaactaccggtgccctaaaccccgatattcttcttcgcctccctttcctcctcagcacccnaaccccgaccttcagggttccgccccatgccgcaggagaccacatcgagcttcaccagaagcgccatggcaagcg

SEQ ID NO: 1414 - DNA, 362 bp, Zea mays
  misc_feature: Ceres CLONE 240382-F
  misc_feature: Encodes the peptide sequence at SEQ ID NO. 1415
acgcataggcaattaggcatagcgctctctctcccgctcgycccgtcgagtcccgactctcrgtcctcgatcgaaattccccgaatcttccagctattagacagttttcctgctgattttcgcgggttcttttcttttgctccccgggagataggatggagaggatactcagatgcttcaatctagggccaacaggatccgaagatgatgatataagtttcacactgaccgtggaaacgtttagcttcgaagagctctctgctgcaactgataatttcagtagcaccctcaggataggctctggggggcaagccacagtctatcgaaggccacataccccacattsgacaggttgctgtcaa

SEQ ID NO: 1415 - protein, 69 aa, Zea mays
  misc_feature: Ceres CLONE 240382-F
  misc_feature (64)..(64): Xaa is any aa, unknown, or other
MERILRCFNLGPTGSEDDDISFTLTVETFSFEELSAATDNFSSTLRIGSGGQATVYRRPHTPHXTGCCQ

SEQ ID NO: 1416 - DNA, 424 bp, Zea mays
  misc_feature: Ceres CLONE 240397-F
  misc_feature: Encodes the peptide sequence at SEQ ID NO. 1417
  misc_feature (64)..(64): n is a, c, t, g, unknown, or other
  misc_feature (223)..(223): n is a, c, t, g, unknown, or other
caaaccaacgagagcacccggaccagacgcccaagtygatcgccatgggatgaagccggcgggncggctccccctaccccggccgcggcgcacaggtgttcgtctacggcagcctgatggcgaacgaggtggtccgcaccatcctcaagcgcgtcccgcccgccgacccggccctcctcccaaactaccaccggttcaacatcaagggccgcatttacccggngatcctgcccgttgagagcaagagagttgctgggagggttatcatgggtgttactgatgaagagctccagcttcttgacgcgtttgaagacgtggagtacacgaggacaagagtygagatatcactyggctgactcttccgagaacatgctggctgacacttacgtgtgggagtgatgcagaggatctcaatctttatgga

SEQ ID NO: 1417 - protein, 79 aa, Zea mays
  misc_feature: Ceres CLONE 240397-F
  misc_feature (1)..(80): Pfam Name: AIG2 Pfam Description: AIG2-like family
  misc_feature (36)..(36): Xaa is any aa, unknown, or other
MANEVVRTILKRVPPADPALLPNYHRFNIKGRIYPXILPVESKRVAGRVIMGVTDEELQLLDAFEDVEYTRTRVEISLG

SEQ ID NO: 1418 - DNA, 337 bp, Zea mays
  misc_feature: Ceres CLONE 240441-F
  misc_feature: Encodes the peptide sequence at SEQ ID NO. 1419
  misc_feature (69)..(69): n is a, c, t, g, unknown, or other
  misc_feature (294)..(294): n is a, c, t, g, unknown, or other
ggatccaccggagagatctggtctgccattccctcgctccttcccgtgaaccacaaacctaacgcggwncgcgagccggccgccgggcgaggtgcgcgtmtgccgtcgatttcgccggatccatccaccatgggcggtggcaacggccagaagtccaagatggcccgcgagcgcaacttggagaagaacaagggggccaaggggagccagctcgagaccaacaagaaggccatgagcatccagtgcaaagtktgcatgcaaacattcatgtgtaccacgactgaaagtaaattnccgggarcacgccgaggccaagcatcccaagacagacgtgtac

SEQ ID NO: 1419 - protein, 69 aa, Zea mays
  misc_feature: Ceres CLONE 240441-F
  misc_feature (4)..(56): Pfam Name: DUF1909 Pfam Description: Domain of unknown function (DUF1909)
  misc_feature (55)..(55): Xaa is any aa, unknown, or other
  misc_feature (58)..(58): Xaa is any aa, unknown, or other
MGGGNGQKSKMARERNLEKNKGAKGSQLETNKKAMSIQCKVCMQTFMCTTTESKXPGXRRGQASQDRRV

SEQ ID NO: 1420 - DNA, 185 bp, Zea mays
  misc_feature: Ceres CLONE 240456-F
  misc_feature: Encodes the peptide sequence at SEQ ID NO. 1421
  misc_feature (27)..(27): n is a, c, t, g, unknown, or other
gctgcgtatgtagtgtcatcttatctnttcctcctaccttcactctcaaaatcttcagggagtcgtagaggagcagcaggtgcaccaaaaggwtggcagcgcaggttccctgcgacttctccaggccccgtccttcgctgcggccaagtgccagccggtgggtggccgggcatccgcgcggcgag

SEQ ID NO: 1421 - protein, 61 aa, Zea mays
  misc_feature: Ceres CLONE 240456-F
AAYVVSSYLFLLPSLSKSSGSRRGAAGAPKGWQRRFPATSPGPVLRCGQVPAGGWPGIRAA

SEQ ID NO: 1422 - DNA, 405 bp, Zea mays
  misc_feature: Ceres CLONE 240467-F
gtctctcgcgcaaggkatctcgttctccgcggcastggtgtttcgctcccttctcgccctccgacggctggttggcagcggcsccggcgccccaaacgctaggtgctgaggccttcgccagtgtcttcgacggcgacgagcacgtaccagcatcatgtcggaaagaggtcgcctggcaggacgattgattgataaccgcagcagagggtacatgtagtccctctagttgaggatcccagaggccatcctgaagtcctcgtggatggggatcggaggggctaytctgacattcgtgggggttcagcaacgtcggggctacctgacacccatctggcttgaggaacctaggggctacctggtgttcgtgtggtcgaccatagggggctatcctggcagtcgtggggt

SEQ ID NO: 1423 - DNA, 241 bp, Zea mays
  misc_feature: Ceres CLONE 240489-F
  misc_feature: Translation starting site: 62
  misc_feature: SWISSPROT Homolog: EC 3.4.25.1 Proteasome endopeptidase complex
  misc_feature (199)..(199): n is a, c, t, g, unknown, or other
awacgcgsgaccacaaacacacaccagcccagctccgagagatcatccggcggccggcgagatgagccgcggcacgggcgcgggttatgaccgccacatcaccattttctcccctgagggacgcctgtaccaagtcgagtacgcgttcaaggcggtgaagtcggcgggtgtcacgtcgatcggcgtccgcggcgcgatnaccgtctggcgtcgtcacccagaagaaagtcccggacaagtt

SEQ ID NO: 1424 - DNA, 718 bp, Zea mays
  misc_feature: Ceres CLONE 240493-R
  misc_feature: Pfam Name: Tubulin_C Pfam Description: Tubulin/FtsZ family, C-terminal domain
  misc_feature (413)..(413): n is a, c, t, g, unknown, or other
  misc_feature (459)..(459): n is a, c, t, g, unknown, or other
  misc_feature (519)..(519): n is a, c, t, g, unknown, or other
  misc_feature (546)..(546): n is a, c, t, g, unknown, or other
  misc_feature (567)..(567): n is a, c, t, g, unknown, or other
cgattggggaccgggccccccctcgaggtcgacggtatcgataagcttttttttttttttttttggttttagtcgggcaaggcgccgaaggcacgcacgacccgaatttggtgagtttattgggatttggggcaatgcaaaaacaccccccaaaagcacagagatctttagaaccaagagtgcttaaagcgacagacttcaattacaaatgcaaatactagagcagttcagcaagtgatgatggaaggaaacacccaaacattacccaggacacaaacaaaggtttttcaacaccacaacctggctcgacagccaaacagattcatgcaagcagatcagtattcctcctcctcgtcgccgtcatcactgccgccctctgcggcgacctcctcgtagtccttctccagggcggncaggtcctcgcgtggctcggagaactccccctcctcatgccctcgncgacgtaccagtgcacgaacgcgcgcttggcgtacatgaggtcgaactttgctgtgatgncggagaacactcgacgaacgctgtggnagtggagatcatgcacacggnacgctgcaccttggcgaggtcggcaccccggaccactggtgggcgctggtaatggatgccgcactgaaccccgtcggggacaagtccacgaactggagggggggcttcgcctggatggggccaccgggggggttacgtcttgtggaacacg

SEQ ID NO: 1425 - DNA, 238 bp, Zea mays
  misc_feature: Ceres CLONE 240578-F
  misc_feature: Encodes the peptide sequence at SEQ ID NO. 1426
atcacatatgcacatcagttccacgggcacatcaactaccgtcgtagggagccaaaccagagtgtgtccctgagacgatggcagctgcgccgttggtcgccgaggctccaccaccagcaccttcgtctccctcgccgtcgccatggccatcgatgcactctcgtcrattcctccgagcagcaccgccgccaaggcracccgtgctcaagccacaccttctcgggcacaccggcgggca

SEQ ID NO: 1426 - protein, 32 aa, Zea mays
  misc_feature: Ceres CLONE 240578-F
MAIDALSSIPPSSTAAKATRAQATPSRAHRRA

SEQ ID NO: 1427 - DNA, 96 bp, Zea mays
  misc_feature: Ceres CLONE 240630-F
aagggcactccgggaggaatgggcaagcagggcgcgcggcgaccgcaagccgggggacgccggcgacaagaaggacaagaagttcgagccgccggc

SEQ ID NO: 1428 - DNA, 176 bp, Zea mays
  misc_feature: Ceres CLONE 240636-F
  misc_feature: Encodes the peptide sequence at SEQ ID NO. 1429
  misc_feature (96)..(96): n is a, c, t, g, unknown, or other
  misc_feature (100)..(100): n is a, c, t, g, unknown, or other
gtttaatcaatccttcaagcgcaaskgcctcctcctcgtcgtccggtcgtgagaagggatggcgggccgtggcaaggctatcggcgctggcgccgnaagnaaggcaacgtcgaggagctccaaggccggactccagttccccgtcggcaggattccaggttcctcaaggcgggcaa

SEQ ID NO: 1429 - protein, 39 aa, Zea mays
  misc_feature: Ceres CLONE 240636-F
  misc_feature (13)..(13): Xaa is any aa, unknown, or other
  misc_feature (14)..(14): Xaa is any aa, unknown, or other
MAGRGKAIGAGAXXKATSRSSKAGLQFPVGRIPGSSRRA

SEQ ID NO: 1430 - DNA, 217 bp, Zea mays
  misc_feature: Ceres CLONE 240683-F
gaaccctcttccccctcgatggccgtaggagcggcggcgactcgcggcgcgcgcgtccgaacgtgctagtgacggggacgccggggacgggaagacgacaacgtgctcgctccttgccgacgccgcastccgccacgtcaacatcggcgacctcgtccgcgagaagagcctccacgacggctggggacgccgacctcgagtgccatgtcatcaacga

SEQ ID NO: 1431 - DNA, 299 bp, Zea mays
  misc_feature: Ceres CLONE 240697-F
  misc_feature (41)..(41): n is a, c, t, g, unknown, or other
awaaccctactaaccgcgtctcctctccagcgcccgccgtngccgccgccctcctcttggtcccgccgtccgtcgaggtcatcatggtgagggtcagtgtgctcaacgatgcgctcaagtccatgtacaatgcagagaagagggggcaagakggcaggtcatgatcagggccgtcgtccaaggtgatcatcaaktycctgacggtcatgcagcgtcatggatacattggcgaktycgagwacgtggatgaccacagagctgggaarattgtggtggactgaacggcagactaaacaaat

SEQ ID NO: 1432 - DNA, 160 bp, Zea mays
  misc_feature: Ceres CLONE 240706-F
  misc_feature (137)..(137): n is a, c, t, g, unknown, or other
gaaccttccctttccccaggcacagatccggctctccgccgccgctatggccgctcgccgcctcctccttctcctcgccgttgtcgccgcgtccctcctggtctgccgacgcgcggccgtgcacgcttcctcgtcgncatcccgtccgatcccadccccg

SEQ ID NO: 1433 - DNA, 364 bp, Zea mays
  misc_feature: Ceres CLONE 240708-F
  misc_feature: Translation starting site: 112
  misc_feature (83)..(83): n is a, c, t, g, unknown, or other
  misc_feature (262)..(262): n is a, c, t, g, unknown, or other
  misc_feature (306)..(306): n is a, c, t, g, unknown, or other
agtattctgctcaagccgagcaccgcagaaaaagaaaaagaaaagccaaaggcaaaggcaaaggaatcccaatcaggcaagcnaaaggaagaaccagctgctgcgccggagatgtcgtcgcagctgatcgaggagcaccggtcgggcgcggaggtgcacgtcgggcacgagctgtgcgagcgcaagtygcgcgagttcatggtggagctgggcctccccgacggctcctcccgctgcccagcctggacgaggtgggctacanccggtcgacggggttcgtgtggctgcggcaggccgccggctkanccccacaccttcggctccatcggcaagcaggtgtggtacgacaggggaggtgacggcg

SEQ ID NO: 1434 - DNA, 287 bp, Zea mays
  misc_feature: Ceres CLONE 240748-F
  misc_feature: Encodes the peptide sequence at SEQ ID NO. 1435
  misc_feature (114)..(114): n is a, c, t, g, unknown, or other
  misc_feature (116)..(116): n is a, c, t, g, unknown, or other
aatccagacccctctctccctcactcacagtccccgccggcgccgcgtccgcgtcctgtgcgcctcgctcactctgcttccgccgccgccgcagcagtcgtctcgcagcggagnancccggagcctaccatggcagcggcaatctcgctggaggccggcggggcctggcatgacctagggtctgcagtcgtcacaggtggtgtcgccctcgcgctcctcaaattctttgaggagctcgccaagcgcggcgtcttcgagcagaaactcagcaggaagcttgttcatat

SEQ ID NO: 1435 - protein, 52 aa, Zea mays
  misc_feature: Ceres CLONE 240748-F
MAAAISLEAGGAWHDLGSAVVTGGVALALLKFFEELAKRGVFEQKLSRKLVH

SEQ ID NO: 1436 - DNA, 191 bp, Zea mays
  misc_feature: Ceres CLONE 240806-F
  misc_feature (101)..(101): n is a, c, t, g, unknown, or other
  misc_feature (162)..(162): n is a, c, t, g, unknown, or other
cttggagatgctctaaggcaccgactcgccggggacagagagagagaccgacgcgccggcagatcccaagctcaccctagagggggaagagggcgaccganagcggcgatgggtttcatcatggacttcgcggagaatctgatcctccgtctgatggagggncccggacaagcgcgaccaggttcggcggg

SEQ ID NO: 1437 - DNA, 473 bp, Zea mays
  misc_feature: Ceres CLONE 240818-F
  misc_feature: Translation starting site: 179
accgcagccctagcgcgccgccaccttcaccttcccaggccgccgccgccgccgcctccattgctgctaaacccgcaaccatgggtcccgtgctgaagcgcccgaccccgggcacgtgcagtgcttcgggcgcaagaagacggccgtggcstgggcctacacgaagccaggccgggggatgatcaaggtgaacggcgtcccgatcgagctgctccgtcccgagatgctgcggctcaaggccatggagcccgtgctgcttggcggggcggtccaggttcaaggacatcgacatgcggatccgcgtgcgcgccggcggtgaagacgtcgcagatctacgccatccgccaggccgtcgccaagggtctcgtgggcctactaccagaagtacgtggacgaggcggcgaaaaaggagatcaaggacatcttcatgcgctacgagcsaccctcctcgtcgccgacccccgccgctgcga

SEQ ID NO: 1438 - DNA, 116 bp, Zea mays
  misc_feature: Ceres CLONE 240854-F
  misc_feature (48)..(48): n is a, c, t, g, unknown, or other
  misc_feature (49)..(49): n is a, c, t, g, unknown, or other
  misc_feature (107)..(107): n is a, c, t, g, unknown, or other
agttcaagtgccacaccggccgctcgtcgccttcccatctcgccgcgnnatggatttctgcagccacctccgtctcgcggctgtgctcgcgctcctcamcggatgcncttctgcgg

SEQ ID NO: 1439 - DNA, 243 bp, Zea mays
  misc_feature: Ceres CLONE 240865-F
  misc_feature (57)..(57): n is a, c, t, g, unknown, or other
  misc_feature (142)..(142): n is a, c, t, g, unknown, or other
  misc_feature (144)..(144): n is a, c, t, g, unknown, or other
  misc_feature (211)..(211): n is a, c, t, g, unknown, or other
  misc_feature (214)..(214): n is a, c, t, g, unknown, or other
atcaccaatcagtcagtcacagctcacagcaaacaccgcgamcgcccccgctcccanacccgaccgagcaaagcgsaaagccccccaaccgcggatcaatccgcagcatcgatggcgcccaaggcggagaaaaagccggcgnanagaagcccgcggaggaggagcccgcgaccgakaaggcggagaaggctccggcagggaagaagccgansangtaaacgcytccccgcgggcaattccggc

SEQ ID NO: 1440 - DNA, 434 bp, Zea mays
  misc_feature: Ceres CLONE 240895-F
  misc_feature: Translation starting site: 126
  misc_feature: Pfam Name: MMR_HSR1 Pfam Description: GTPase of unknown function
  misc_feature (67)..(67): n is a, c, t, g, unknown, or other
  misc_feature (346)..(346): n is a, c, t, g, unknown, or other
awaaacttctcctttctccatcctcaaccctactccccctttcatccgcacgaacgaagcagcgcrnrtggagcagacgatccttcccgacctcgaagcctacccccccccctccagccgcggccatggcgaccgtcatgcagaagatcaaggacatcgaggacgagatggcaaggacacagaagawtaaagcmactgctcaccatcttggtcttcttaaggctaaayttgcaaaattgcggcgggagttgctcactccaatcatccaaaggtggtggtggtgcaggtraaggatttgatgtracgaagagtggagatgcacgtgttggttwagttggctttcctncggttgggaaatcaacattgttgaacaagctaacagggacattttcagaggtatttcctacgagtttacaactttaacatgtattcct

SEQ ID NO: 1441 - DNA, 345 bp, Zea mays
  misc_feature: Ceres CLONE 240900-F
  misc_feature: Encodes the peptide sequence at SEQ ID NO. 1442
  misc_feature (2)..(2): n is a, c, t, g, unknown, or other
anaacgcatcgtcgtctcccacaacacgctccactaaccctagcgacasctcgggtcgtcgtttgatccccgcgggagctctagttccgccaagcgtgcgtaccggcgtccggatccgggaccgaagatgacggatccctggtgcggaacaagccggggatggccagcatcaaggagatgccggtggtgcaggacgggccgccgccgggstttcrmgccctgrmcttcgcccgccggatccccacctcggggcccagcgccaccgccatcttcctcaccaccttcggtgctttcgcatatggcatgtaccaggtcggccagggggaacaaggtccgccgggcgct

SEQ ID NO: 1442 - protein, 62 aa, Zea mays
  misc_feature: Ceres CLONE 240900-F
  misc_feature (19)..(19): Xaa is any aa, unknown, or other
  misc_feature (22)..(22): Xaa is any aa, unknown, or other
MASIKEMPVVQDGPPPGFXALXFARRIPTSGPSATAIFLTTFGAFAYGMYQVGQGEQGPPGA

SEQ ID NO: 1443 - DNA, 374 bp, Zea mays
  misc_feature: Ceres CLONE 240903-F
  misc_feature: Encodes the peptide sequence at SEQ ID NO. 1444
  misc_feature (214)..(214): n is a, c, t, g, unknown, or other
  misc_feature (224)..(224): n is a, c, t, g, unknown, or other
gaggcacgcaacaattagaacacatctygccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgncggcggccgngtatcccttccctgaagccttctcctccccgaccaaggcttctcaagatgccgctgaggccggagaggacaacctgagctcgatgtgggagtaagctggccacgccgacgacatctttgcctcccctggcagcgcgacgcccgtagcccg

SEQ ID NO: 1444 - protein, 62 aa, Zea mays
  misc_feature: Ceres CLONE 240903-F
  misc_feature (55)..(55): Xaa is any aa, unknown, or other
MMWRSRARALLLLRSTITRPPPPPPQPYPTRTLTRVPPPRFLSSSPDPIPDSSSXGGRVSLP

SEQ ID NO: 1445 - DNA, 1297 bp, Zea mays
  misc_feature: Ceres CLONE 240921
  misc_feature: Encodes the peptide sequence at SEQ ID NO. 1446
ctctcgagagggccacacacaaaaaccccaatgcgagcgcccctggcttgtcggcgtcgcctccttcagccaaaaccctagcttgcatacgcgcccgaacaaagcttcgtctgcgaggggcgtcctcctgccgccagaagctttcaggagcatcagcgatggtgtggttccaatgcgaggactgtggcgagaacctcaagaagcccaaacttgccggccacttccgctcctgctccgcgtacaagctgtcatgcatcgattgcggcgagttattcagccaggacaccgtgcaggggcacacgcagtgcatctccgaggccgagaagtacggtcctaagggacagaccaaaccatccaatggtgcacagggtaaggcagataagccaaagccaaatgcagatgtcgatatcaatgttgggctgtcgacacggcctccttggttctgtagcctatgcaagaccactaccacaagcaagcaaactctcttactacatgctgatgggaagaagcatagggcaaaggcgaaagccttccatgtgtctcagaaacaaaaagatggtgcagaacaaactccagatgtgaaggaagctggagttgtacccacaaaagaatctgctcaagtaaatggtggcgtgagtggtgatcatgaaagaaatgaagataaagatgctgggaaaaggaaacgaatggatgacatgaccatagagccaggtaacacaaaaagacagttgacacagtctggagatgagaagtcagaaaacaaagcgaagagtaaggccgatgaactagcaagtggtactgactgcaaaagtgttcaaaagcaaaagatcaaatggaagaagattattactaaaacattgaaggcgaacgcagatggagttatgaagctaaagaagctacaaaagatagtctccaaggagcttcaggaatgtggtgtctccaaagacaaggaggagctccgtgctaccttgatggataaaatagcttcaagttccagattttctgttgatggcaagaatgttagactggtggccaagaatgaagaagaatcttacgaaagaggttgtcagtcattttttggcattgttgctggtttcattctttggtgtcaactttcagatggcttatagccaagtgttggttaaattgagtccatgaaccatcaattatatccatgacctgtagacggtatgggaatttagcatctgaattttctcgacaaccgttcaaaagtgaaatgtttactctttatgctgtcaagcaatggcaatgatggttgataaaaaaaaaaaaaaaa

SEQ ID NO: 1446 - protein, 323 aa, Zea mays
  misc_feature: Ceres CLONE 240921
  misc_feature (30)..(57): Pfam Name: zf-LYAR Pfam Description: LYAR-type C2HC zinc finger
MVWFQCEDCGENLKKPKLAGHFRSCSAYKLSCIDCGELFSQDTVQGHTQCISEAEKYGPKGQTKPSNGAQGKADKPKPNADVDINVGLSTRPPWFCSLCKTTTTSKQTLLLHADGKKHRAKAKAFHVSQKQKDGAEQTPDVKEAGVVPTKESAQVNGGVSGDHERNEDKDAGKRKRMDDMTIEPGNTKRQLTQSGDEKSENKAKSKADELASGTDCKSVQKQKIKWKKIITKTLKANADGVMKLKKLQKIVSKELQECGVSKDKEELRATLMDKIASSSRFSVDGKNVRLVAKNEEESYERGCQSFFGIVAGFILWCQLSDGL

SEQ ID NO: 1447 - DNA, 349 bp, Zea mays
  misc_feature: Ceres CLONE 240955-F
  misc_feature: Encodes the peptide sequence at SEQ ID NO. 1448
  misc_feature (305)..(305): n is a, c, t, g, unknown, or other
atttthactggcagaagaagccatggggcagaagccgtcgtacctcctgctgctcgtcggcctcctcgccatcgccatgctctgcgccggcccgggtcacgcgctgcgccaactgaacgacgccaacgsttgggcctggagttctccttgggctccaaggcggccacggmcggcggccaagaccgagccgctggacccgtccctgagcgacgactacgagaacgwtacaagccacgtggagttcgagccagagctcggccgcgcgacgtccgtccccgccgcgaccaccgtcactgtcactgtcngccgcggkgctgaccacggagccttcgacgtcccggaacgccgc

SEQ ID NO: 1448 - protein, 109 aa, Zea mays
  misc_feature: Ceres CLONE 240955-F
  misc_feature (36)..(36): Xaa is any aa, unknown, or other
  misc_feature (50)..(50): Xaa is any aa, unknown, or other
  misc_feature (68)..(68): Xaa is any aa, unknown, or other
  misc_feature (95)..(95): Xaa is any aa, unknown, or other
MGQKPSYLLLLVGLLAIAMLCAGPGHALRQLNDANXWAWSSPWAPRRPRXAAKTEPLDPSLSDDYENXTSHVEFEPELGRATSVPAATTVTVTVXRGADHGAFDVPERR

SEQ ID NO: 1449 - DNA, 152 bp, Zea mays
  misc_feature: Ceres CLONE 240966-F
  misc_feature (34)..(34): n is a, c, t, g, unknown, or other
gtgtagggactagggaccgtagagtaagcgacanaggagggagagggggatggccgggatcggccgatcagacaggactgggagccggtggttgtgcggaagaaggcacccaccgccgctgccaagaaggatgagaaggccgtcaacgccgc

SEQ ID NO: 1450 - DNA, 492 bp, Zea mays
  misc_feature: Ceres CLONE 241036-F
  misc_feature: Encodes the peptide sequence at SEQ ID NO. 1451
  misc_feature (293)..(293): n is a, c, t, g, unknown, or other
aagggaaaaaaaaccaggtctgtgtgtgtgtgagagagagagagaggcgaaggcaactcaggcgacgcgatggcgatggcggcgctgcgacsgaggggaggcgcctcatcctctcctccaccgtccccaacccgtctctggcggccgcttcctctgcggtgacggatcctccgccgtctcgcaaccggagatggctccacttggtgcacggtctatttcaactcaaatcgtgaggaaccggatgaagagtgtcaggaatatccagaagatcacaaaggctatgaagatggttncagcatcaaagctccggggcagttcagacaaggactgaaaaattcacgtggcttgtggcaaccgtttcaccgcccttcttggggatgctcctagtgttgacgtcaagagaatgtgattgtggccattacctctgataagggactctgtgggtggtattaattcaacatcagtgaagttagcaggggccttcacaaattg

SEQ ID NO: 1451 - protein, 46 aa, Zea mays
  misc_feature: Ceres CLONE 241036-F
  misc_feature: SWISSPROT Homolog: EC 3.6.3.14 H(+)-transporting two-sector ATPase
  misc_feature (35)..(35): Xaa is any aa, unknown, or other
MAPLGARSISTQIVRNRMKSVRNIQKITKAMKMVXASKLRGSSDKD

SEQ ID NO: 1452 - DNA, 352 bp, Zea mays
  misc_feature: Ceres CLONE 241063-F
  misc_feature: Translation starting site: 91
  misc_feature (47)..(47): n is a, c, t, g, unknown, or other
cccaaatttyagatcaaatcctcgaaatctccgacacctagcccaynggagacttctccccaacagtgtcgcgatccgtctcgatccggcatggagcgcgtcttctccgtggaggagatccccaakccctactgggttccgccgcaccctcaatcggcggccgcgrmgctgttgctgcacmagcgggggaggcggcggggctgmtgaaccggtgcccgtcggaatggtacttccagaagttcctggaggaggccgtgctcgacagcccggttcccgtagccggcgtcagtaggggcagcgttggagctggagttgaggctgcggagaggaagacaccggggaccgcggcggc

SEQ ID NO: 1453 - DNA, 281 bp, Zea mays
  misc_feature: Ceres CLONE 241064-F
  misc_feature: Translation starting site: 106
  misc_feature: SWISSPROT Homolog: EC 1.8.1.9 Thioredoxin-disulfide reductase
  misc_feature (79)..(79): n is a, c, t, g, unknown, or other
  misc_feature (80)..(80): n is a, c, t, g, unknown, or other
atagaccgacgaggtgtgaactgtaatttcagatttcagagcgcgcaagaaccctcttgaccaccgccgccgccgccgnnmscaagccaaactgagtaagcagctatggagggatccgccgccgctccgctccgcacgcgcatctgcatcatcgggagcggtcccgmtgcgcacacggcagccatctacgcggcccgcgcggactcaagcctgtgctcttcgagggctggatggcaacgacatcgccgcggsggggcagctcaccaccaccaccgacgtcg

SEQ ID NO: 1454 - DNA, 198 bp, Zea mays
  misc_feature: Ceres CLONE 241188-F
akagcagagctgcctccagacgakacgaggaggacgcggcgccgttcgggcttggcagcaaccagcgtctagcgcagtgcccttctgttctcctatctccccggaagtycccgctgcccagcccggtctcactttccagtctccgagactccgagttctcggctcgsaccccgttccctgcagcctgtgctctggggt

SEQ ID NO: 1455 - DNA, 202 bp, Zea mays
  misc_feature: Ceres CLONE 241195-F
gtccccggccgccgccgctcccagtctccacgcggaagcagcgcctcgcaacgctcctacccaatggcgccgacgtcgaagctgtcgatgggcatcaagcgcgcgttcsstcgcacgsgtaccaccgccgtggctctgggccatcaaggcaagaacggcggcgtcttccccaaggccgagaagcccgccgccrccgcggaac

SEQ ID NO: 1456 - DNA, 246 bp, Zea mays
  misc_feature: Ceres CLONE 241205-F
  misc_feature: Encodes the peptide sequence at SEQ ID NO. 1457
  misc_feature (78)..(78): n is a, c, t, g, unknown, or other
  misc_feature (79)..(79): n is a, c, t, g, unknown, or other
  misc_feature (138)..(138): n is a, c, t, g, unknown, or other
  misc_feature (238)..(238): n is a, c, t, g, unknown, or other
atcactaccaccgctctctcttcctctcctccatctctcaacgcctgaagctcaccgcacctcccctcctcgccgcgnntcccccactactccggtagaaaatggctgacgctgaggatatccagcccctcgtctgcnacaacggaactggcatggtcaaggctgggttcgccggcgacgacgctccgagggccgtcttccccagcatcgtttggcgcccgcgcacaccggtktgatngtggggat

SEQ ID NO: 1457 - protein, 44 aa, Zea mays
  misc_feature: Ceres CLONE 241205-F
  misc_feature: SWISSPROT Homolog: EC 2.7.10.2 Non-specific protein-tyrosine kinase
  misc_feature (13)..(13): Xaa is any aa, unknown, or other
MADAEDIQPLVCXNGTGMVKAGFAGDDAPRAVFPSIVWRPRTPV

SEQ ID NO: 1458 - DNA, 475 bp, Zea mays
  misc_feature: Ceres CLONE 241218-F
  misc_feature: Translation starting site: 141
  misc_feature (381)..(381): n is a, c, t, g, unknown, or other
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtngtggcagcagtaggggcagaaggcagcgaaggggagaggatgtggttcatcctctgaaggtttctctggaggatttkgtacaatggcacatcgg

SEQ ID NO: 1459 - DNA, 339 bp, Zea mays
  misc_feature: Ceres CLONE 241233-F
  misc_feature: Translation starting site: 13
  misc_feature: SWISSPROT Homolog: EC 1.1.1.219 Dihydrokaempferol 4-reductase
  misc_feature (201)..(201): n is a, c, t, g, unknown, or other
  misc_feature (203)..(203): n is a, c, t, g, unknown, or other
gagtctgagagaatggctaacactgctaagggtaaggtctgtgtcactggggcgtctggtttcatcgcctcctggctcgtcaagcggcttcttgagtctgggtacatgtcctgggaacagtcagagacccagggaatggcaagawagtagggcactctggggcctggaasgcaaaggaaaggctgcagctcgtgagaskantnctcttggaggaagggagcttcgacgacgctgtgatggcttgcgtagggcgtcttccacaccgcatcgcccgtcgtcaccggatctaattccaaggacgagatgcttgattcagcaataaacggcaacgatgaacgt

SEQ ID NO: 1460 - DNA, 460 bp, Zea mays
  misc_feature: Ceres CLONE 241325-F
  misc_feature: Encodes the peptide sequence at SEQ ID NO. 1461
  misc_feature (111)..(111): n is a, c, t, g, unknown, or other
ctttttttcctcgagtttcctattttcctctcctcccccacagcagcccggcgaaaaccctagtaagcaaaccaccggagcagcggcgcttgcsgagcggasccatggcgnacgacgattacaacgaaattgacatggggtatgaggatgagcccccagaaccggagattgaggaaggagctgaagaagagcctgagaacaatgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggagaaactgaccctcttgagattgcaatgaaggagctgagagcgcgcaagatacccttcacgatcagacgttactttacctgatg

SEQ ID NO: 1461 - protein, 117 aa, Zea mays
  misc_feature: Ceres CLONE 241325-F
  misc_feature (61)..(114): Pfam Name: RNA_pol_Rpb6 Pfam Description: RNA polymerase Rpb6
  misc_feature: SWISSPROT Homolog: EC 2.7.7.6 DNA-directed RNA polymerase
  misc_feature (3)..(3): Xaa is any aa, unknown, or other
MAXDDYNEIDMGYEDEPPEPEIEEGAEEEPENNEDAPDDVIGGEGEDKEQEKTKRERKTTKYMTKYERARILGTRALQISMNAPVMVELEGETDPLEIAMKELRARKIPFTIRRYFT

SEQ ID NO: 1462 - DNA, 1433 bp, Zea mays
  misc_feature: Ceres CLONE 241331
  misc_feature: Encodes the peptide sequence at SEQ ID NO. 1463
agtttctctttcttcgtcccgtcaggaatgccctccttcctctgagatctcggagtcgccctcctcttgcccaagcccagaccgatcgaggaccagccctgcatccagatctatgttttttgtgcccctccacgtgatccctgctggcggaggtagcactgtgtgggagaatgacgcccccccacttcggcaatatggtcagcacggtcgcacccgtggtggcctggccacatctacaaagtcaggctcaccgtctcatcgatgacgatgaggtacaccgcggctaccgcgacgggttcatcctggtcgtcttcttcggcgacaagagcacgggtggttcgagcccggcgagctcgtccccttcgaggaccgcttcaccgagaaggcagcccacgccgaggccgtcgacaagcgacgtcattttcttccttgtcaatctcccggcattcgacaccaacgttgactaccaccgccaccagacccaggccgcgcggcaacgatttgtgcgcagaaggagctcgactaagtgcttaacgctgccatggctgatggctcaacgggacgcggcggaaaaggctgcacacaccgtgccagggatggagatgaccacgttgttctcagcgtaccgtcgcgcagtgttttcgcccatagaccacctacgcccaagcgttgggacttcggggtggatcccgagcttccgcttgctacggactagagagccacggcggcagagcgagctcaacaagaaccactttggggccaacagtgtcgtaacaagagggcccctatcgtgcccacctttgggcgtttcccggcgctcgtgggctaacacaagcgagccccttcactcgctctcaaaacccgggctgtgagaggaggggaaatctcacttataagctcaccacggccccctccggctagcgaggtggtactaaagccgggcgctaacggctaggctcctgacatcccatcccccttttcgggcggtatggcgactgtctgcctctgataccaattgtcagcgaccttcccggcctagcccactcaacgctacacctttgggcgtttcccggcgctcgtgggctaacacaagcgagccccttcactcgctctcaaaacccgggctgtgagaggagggaaaatctcacttataagctcaccacggccccctccggctagcgaggtggtactaaagccgggcgctcctccatattatgctgctaatataacatctagatatttttttactgtaagaaccctcagtgtaggctccaagcggtaagcaccactgcagtctgcagttaaaatgcgtgtttccctctacattgattatgcatctatttaaatttggcagtgttctgctcaacaaatctgcttaacatatcagcaacaataccgtctggaagacaatttctgcaaaaaaaaaaaaaaaa

SEQ ID NO: 1463 - protein, 233 aa, Zea mays
  misc_feature: Ceres CLONE 241331
MTPPHFGNMVSTVAPVVAWPHLQSQAHRLIDDDEVHRGYRDGFILVVFFGDKSTGGSSPASSSPSRTASPRRQPTPRPSTSDVIFFLVNLPAFDTNVDYHRHQTQAARQRFVRRRSSTKCLTLPWLMAQRDAAEKAAHTVPGMEMTTLFSAYRRAVFSPIDHLRPSVGTSGWIPSFRLLRTREPRRQSELNKNHFGANSVVTRGPLSCPPLGVSRRSWANTSEPLHSLSKPGL

SEQ ID NO: 1464 - DNA, 147 bp, Zea mays
  misc_feature: Ceres CLONE 241334-F
  misc_feature: Encodes the peptide sequence at SEQ ID NO. 1465
aaaaaaawtttcgaaacgagaggtgtctgcctatcacttgcgaraaatcgcgaggraaagcgtgacacctgacgagctgagcaggcaggcggtattggccgagcgaaasatcctcgatctcgtcgtatcgtagctgccgccgctcag

SEQ ID NO: 1465 - protein, 43 aa, Zea mays
  misc_feature: Ceres CLONE 241334-F
  misc_feature (3)..(3): Xaa is any aa, unknown, or other
  misc_feature (15)..(15): Xaa is any aa, unknown, or other
  misc_feature (19)..(19): Xaa is any aa, unknown, or other
  misc_feature (36)..(36): Xaa is any aa, unknown, or other
KKXSKREVSAYHLRXIARXSVTPDELSRQAVLAERXILDLVVS

SEQ ID NO: 1466 - DNA, 419 bp, Zea mays
  misc_feature: Ceres CLONE 241384-F
  misc_feature: Encodes the peptide sequence at SEQ ID NO. 1467
  misc_feature (101)..(101): n is a, c, t, g, unknown, or other
  misc_feature (269)..(269): n is a, c, t, g, unknown, or other
  misc_feature (282)..(282): n is a, c, t, g, unknown, or other
  misc_feature (293)..(293): n is a, c, t, g, unknown, or other
atccagtcgcatctycctctccgaaatcaaggtagcgtacaccgctgcagtttctagagccctctctgccactcgtgatcccactagtcacaatgcctgcnctcgccaagcccgcctcccgcaccgccaagcccgcmgcggctccgaagccgaagcctgccgccgccaagccgavggccaccgctggtgcctcccacccgccttacttcgagatgatcaaggaggctatcacggcgctcaaggagaggaccggctccagctcgcaagcnatcgccaagtatntgggggacaancacggcgcgtctctgccggccaacttcaagaagatgctttccatccagctccgtgggtccgcagccaaggggcaagctcgtgaaggtcaaggcttcgtacaagctctcggacgccgccaagaaggc

SEQ ID NO: 1467 - protein, 109 aa, Zea mays
  misc_feature: Ceres CLONE 241384-F
  misc_feature (34)..(95): Pfam Name: Linker_histone Pfam Description: linker histone H1 and H5 family
  misc_feature (28)..(28): Xaa is any aa, unknown, or other
  misc_feature (64)..(64): Xaa is any aa, unknown, or other
  misc_feature (67)..(67): Xaa is any aa, unknown, or other
MPALAKPASRTAKPAAAPKPKPAAAKPXATAGASHPPYFEMIKEAITALKERTGSSSQAIAKYXGDXHGASLPANFKKMLSIQLRGSAAKGQAREGQGFVQALGRRQEG

SEQ ID NO: 1468 - DNA, 429 bp, Zea mays
  misc_feature: Ceres CLONE 241399-F
  misc_feature: Encodes the peptide sequence at SEQ ID NO. 1469
  misc_feature (166)..(166): n is a, c, t, g, unknown, or other
tgccgccgtagccgtctgcctcctcgctttcctttcgtccgtacgccgccggctcgcaccgccgacagtcctcagtccagaactccagatcgagcctctctcttcccagatcgggtcctaggctacagcagccgccgcatccgtcaccttcacaccgcgtgcgtkntctctctcccccctccccctctccgtgcgacgactgggtgggctaccgccgccttacgcaaggtgccgagaacttcgccaaaatctgcgccggagaagagcgcccaccagatcaggagctgatgaaggcgcgctggtcggtggatgacgatggcgggtggcgggggactgaaccggtcttcatcgagggggcagctgccgccgcaagagctgcttgacgatctctgcagccggttccttctgaatgtgcccaaggagggaact

SEQ ID NO: 1469 - protein, 38 aa, Zea mays
  misc_feature: Ceres CLONE 241399-F
MAGGGGLNRSSSRGQLPPQELLDDLCSRFLLNVPKEGT

SEQ ID NO: 1470 - DNA, 481 bp, Zea mays
  misc_feature: Ceres CLONE 241475-F
  misc_feature: Encodes the peptide sequence at SEQ ID NO. 1471
aaaacctagcgggtgcagaccttggtgggggagcgaggagtcgaaacaagaaccatgagtgaaacagggcacactgtacaagtcactaacctctcgagcagagtatctgaaagtgatctttatgagttctttttgttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaattgaatacacgagctatcaatcatgccagtacaacactactccgcagaagctcttacagtggctcaagatatcgtgaagacgatgctagcaaaggggtacgtgctcagcaggacgctttggctaaggctaga

SEQ ID NO: 1471 - protein, 123 aa, Zea mays
  misc_feature: Ceres CLONE 241475-F
MSETGHTVQVTNLSSRVSESDLYEFFLFSGPIEHVELIRSGEYGATAYVTFKERFALETAVLLSGATIVDQPVCITYWGQPEETFNFWDRPTWEVEEEIEYTSYQSCQYNTTPQKLLQWLKIS

SEQ ID NO: 1472 - DNA, 123 bp, Zea mays
  misc_feature: Ceres CLONE 241586-F
  misc_feature (74)..(74): n is a, c, t, g, unknown, or other
  misc_feature (75)..(75): n is a, c, t, g, unknown, or other
aacaacagcgaacacatctcctcgcatttyttcccatccgatccccccttcgcaaccaaaaccccaactcgccnncatcgatggcgcccaaggccgagaagaaacccgcggcgaagaagccgg

SEQ ID NO: 1473 - DNA, 442 bp, Zea mays
  misc_feature: Ceres CLONE 241602-F
  misc_feature: Translation starting site: 102
  misc_feature (416)..(416): n is a, c, t, g, unknown, or other
  misc_feature (419)..(419): n is a, c, t, g, unknown, or other
gcaagaggaagaggtggccatacgcaacaagcaaagcatacccccaaatccccaatccccaatccccaatccccaaaccctaggttatctcggcgcggaavatggcggcggcgggcctgaggaaggggaatgcgcgcctcccgccggagwgaaccgggtgctamtamgtgcggaacctarccgttcaacatctcgagcgaggagatgtacgacatcttcggcaagtacggcgcgatccggcagatccgtctgggcaacgcaaggacacgcgcgggaccgcttacgttgtctacgaggacatctacgacgccaagaacgccgtcgaccacctctccggcttcaacgtcgccaaccgctacccttatcgtgctctactaccagcccgccaagatgtccaagaagtcggatatcaaganganggaggacgagatcaccaggctcc

SEQ ID NO: 1474 - DNA, 778 bp, Zea mays
  misc_feature: Ceres CLONE 241605
  misc_feature: Encodes the peptide sequence at SEQ ID NO. 1475
agagttgaaaaatcagtaagctcacattgataaggctttagaagtgtgccactaaaatattggaatacatggcaaaagaaatactctgtgtgtctgggcttaaggttggcaatcatttcataaccatacttgactaggaatgccaccagttttgacaataacgtcagcttaacagctcctcaagagggctgcttgcaaaagactagattagcgacgcagaaaccgcatgaaagctaacggaatcgagactgagaaagacaaatgtttggatttggtccagaactgataaaaccaacgagcgacctggcacaagaagcaaggggatccgtggaacatgagcgaggcagggtcgctggcctaccggcgagaggaggaaaaagcaatccaagcagagacaggcggatctccagttgtcccctccacgccgcgctagcccagagggsggggcaacggcgacgcctccctgcgagggaggaatggcctcgggcctggctctacgccgacggtggcgccgctcgccgacggcgaggcgcgagaaactaggaggtggcggtaatggaggacagaatgacagagccggtggagggaagggagttgagaggaacaagtgcagactgaagacggggaataccatcgtttttttttaaaaaacaacgaacttcgtagcggttttcgaatatttttttagaaaaaaaatgattcacgaaaaccgtttttttattttggatttgkaaactgatcgaaaaattcgaaattttgtcaaaaaaaaaaaaaaaaa

SEQ ID NO: 1475 - protein, 93 aa, Zea mays
  misc_feature: Ceres CLONE 241605
  misc_feature (61)..(61): Xaa is any aa, unknown, or other
MFGFGPELIKPTSDLAQEARGSVEHERGRVAGLPARGGKSNPSRDRRISSCPLHAALAQRXGQRRRLPAREEWPRAWLYADGGAARRRRGARN

SEQ ID NO: 1476 - DNA, 630 bp, Zea mays
  misc_feature: Ceres CLONE 241610-R
cgattgggtaccgggccccccctcgaggtcgacggtatcgataagcttgatgggctcaccagcaggcagtggcttaggagcttgaagttgaccgggtccacccgaagcttgtgcgcgtgcaggtcgctcagggcggacagcgcgttgggcatgtcgtccacgtgcgccacggcgttggtcagcgcgtcggccaccttcttgccgtggcccttaacctgggcagagccgtggctcaggtcgaagtgcgggaagtaggtcttggtggtggggaaggacaggaacatcctctccagggcctccgcaccatactcgccagcgtgcgcgccgaccttaccccaggcggccttgacgttggtcttgtcatcgttttttttttttttttttagttcaaggggcaattcccactctatttcgattttttatacgtccacacgaactgtaattcaatcagagagggttcaaccaaaactgtaaccaaacaagctaggaactgacaaatcaactaggcagcctcgcaggtcccagaacgctagtgcctgcctaaacattatctccgtcctagcccacacctgtaacaatccaatggagcaaagatgagagcccaaaagttttattggaaaaaaccaaggc

SEQ ID NO: 1477 - DNA, 458 bp, Zea mays
  misc_feature: Ceres CLONE 241610-F
  misc_feature: Encodes the peptide sequence at SEQ ID NO. 1478
gactaggctattgccgccgccgccctacaccagatgcccagttcttcgtcagccccttctccggcaacgagcacctaacagaggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattaagcaactcagacaaagaacgagtgctccaatcaaagatgtcaaggcctctctagttacctgcaactgggatattgaggctgcacagaaggacctaaggaagagaggtgttgctcttgctgccaaaaagtcttcacgcactgctgctgaaggtttgctagctatc

SEQ ID NO: 1478 - protein, 118 aa, Zea mays
  misc_feature: Ceres CLONE 241610-F
  misc_feature (58)..(95): Pfam Name: UBA Pfam Description: UBA/TS-N domain
MAWGQGAKRSILGLLFRSQHQTARAYSSSAFQTHQLSTHVPQDGVFIRRFGSEVSSSEQMNLIKQLRQRTSAPIKDVKASLVTCNWDIEAAQKDLRKRGVALAAKKSSRTAAEGLLAI

SEQ ID NO: 1479 - DNA, 298 bp, Zea mays
  misc_feature: Ceres CLONE 241625-F
  misc_feature: Encodes the peptide sequence at SEQ ID NO. 1480
acctccaccgacccaaaccctagcgcgcacccacctcccttcccctttcccggcgtgcggttccggcgttggagatgcgggggctgctcgcggacggcgggatggcgctggcgatggcgcggagttaacgagtcgtcgggcggtgctgcgttgtcgcaggggtctgttatggtgggcgtcggagtgccacggggtgttgtacagccttgcggtgatgctgccgtcgctggccttcgtgggattcctagcatggcaggcgcggcggacttccgtagctcagctacggccgctchcacgt

SEQ ID NO: 1480 - protein, 99 aa, Zea mays
  misc_feature: Ceres CLONE 241625-F
  misc_feature (98)..(98): Xaa is any aa, unknown, or other
PPPTQTLARTHLPSPFPACGSGVGDAGAARGRRDGAGDGAELTSRRAVLRCRRGLLWWASECHGVLYSLAVMLPSLAFVGFLAWQARRTSVAQLRPLXR

SEQ ID NO: 1481 - DNA, 195 bp, Zea mays
  misc_feature: Ceres CLONE 241639-F
  misc_feature (121)..(121): n is a, c, t, g, unknown, or other
  misc_feature (141)..(141): n is a, c, t, g, unknown, or other
gtagggtagcagcaggtagcggagggggagagagakagaggggatggattctcaagcgccgcttcgtcctcctctagctttcgcctgcttcatcttcctttgctcatccttctgcgcaaantgakatgtacgacagggttngtgcggcggcgtcagatggggagagcaggaggatgcggctgcacaccgacggga

SEQ ID NO: 1482 - DNA, 412 bp, Zea mays
  misc_feature: Ceres CLONE 241738-F
  misc_feature: Translation starting site: 178
  misc_feature (148)..(148): n is a, c, t, g, unknown, or other
attctcttggtttcttctttctcctcccaataaacacacccacccggtcgctccgctccaccgttccgccctcgaccgcgcgcgasctcctcaacccttcagacctccgcctcccaccgcttccgtagcctcgcgtcctygtctcgbngcgcctcgtccttctcctccgtcccaaccatgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggcgtttcgtcccgcgcgccgtgctcatggacctcgagcccggcaccatggactccgtgcgctccgg

SEQ ID NO: 1483 - DNA, 181 bp, Zea mays
  misc_feature: Ceres CLONE 241743-F
  misc_feature: Encodes the peptide sequence at SEQ ID NO. 1484
awacctagaaccctcttcccccgcgatggccgcaggagcgsggcgctcgcggcgscgcgtccgaacgtgctagtgacggggacgccggggacggggaagacgaccacgtgctcgctccttgccgacgccgcastccgccacgtcaacatcggcgacctagtccgcgagaagagccttcacg

SEQ ID NO: 1484 - protein, 59 aa, Zea mays
  misc_feature: Ceres CLONE 241743-F
  misc_feature (13)..(13): Xaa is any aa, unknown, or other
  misc_feature (18)..(18): Xaa is any aa, unknown, or other
  misc_feature (44)..(44): Xaa is any aa, unknown, or other
PRTLFPRDGRRSXALAAXRPNVLVTGTPGTGKTTTCSLLADAAXRHVNIGDLVREKSLH

SEQ ID NO: 1485 - DNA, 227 bp, Zea mays
  misc_feature: Ceres CLONE 241757-F
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
ctccgttcwyycggngtbnnnctctgcctctntctctctctcgtgcaggaccgccgacgcgcttcgccagaccttcgccggcgacgagcactcaccagggcgtgaaaatgtcaacaagctcttgaaagaacccaatgtttctcaatcaaaagacgtrgagaatggaaatsacaattctgtgaaatycctgcattaccaagcctgtgttgaatggcaacaaatgtgcc

SEQ ID NO: 1486 - DNA, 378 bp, Zea mays
  misc_feature: Ceres CLONE 241764-F
  misc_feature: Pfam Name: Ribosomal_L10e Pfam Description: Ribosomal L10
  misc_feature (235)..(235): n is a, c, t, g, unknown, or other
  misc_feature (363)..(363): n is a, c, t, g, unknown, or other
agacgcaccccttcctcgtttcgccgcctccgccgacaccgactgcctacctcagctgccgtcgccatgggcagaaggctgctagatgctatcgccagatcaagaacaagccataccctaagtccaggtactgcmgtggtgtccctgaccccargatcaggatctacgatgttggratgaagaggaagggtgttgatgagttcacctattgtgtgcaccttgtctcttgggaganggagaatgtctccagtgaggcgcttgaggctgcccgcattgcaacaactacatgaccaagtctgcaggaaaggatgctttccaccttarggtccgggttcaccgtttccatgtcctccgtatcaacangatgctttcgtgtgc

SEQ ID NO: 1487 - DNA, 306 bp, Zea mays
  misc_feature: Ceres CLONE 241771-F
  misc_feature: Encodes the peptide sequence at SEQ ID NO. 1488
  misc_feature (25)..(25): n is a, c, t, g, unknown, or other
  misc_feature (26)..(26): n is a, c, t, g, unknown, or other
  misc_feature (117)..(117): n is a, c, t, g, unknown, or other
  misc_feature (185)..(185): n is a, c, t, g, unknown, or other
  misc_feature (214)..(214): n is a, c, t, g, unknown, or other
acgcaacctcccactgcattctcdnnttacgattcccaatccagcaaaccctaccagccttttgcaaactcagagagggacccgatggcacccaaggcggagaagaagccggcgsanagaagcccgcagaggaggagcccgcggccccggcggagaaggcccccgctgggaagaagccgavgtangaagcggctcccggcgggaaaatccgcsncaaggaaggcggtgttgacaagaaggggcggaataaggccaagaagagcgtggagacgtacaagatctacatcttcaaggtgctgaagcagg

SEQ ID NO: 1488 - protein, 101 aa, Zea mays
  misc_feature: Ceres CLONE 241771-F
  misc_feature (8)..(8): Xaa is any aa, unknown, or other
  misc_feature (38)..(38): Xaa is any aa, unknown, or other
  misc_feature (39)..(39): Xaa is any aa, unknown, or other
  misc_feature (60)..(60): Xaa is any aa, unknown, or other
  misc_feature (61)..(61): Xaa is any aa, unknown, or other
  misc_feature (71)..(71): Xaa is any aa, unknown, or other
ATSHCILXLRFPIQQTLPAFCKLREGPDGTQGGEEAGXXKPAEEEPAAPAEKAPAGKKPXXEAAPGGKIRXKEGGVDKKGRNKAKKSVETYKIYIFKVLKQ

SEQ ID NO: 1489 - DNA, 196 bp, Zea mays
  misc_feature: Ceres CLONE 241865-F
  misc_feature: Encodes the peptide sequence at SEQ ID NO. 1490
  misc_feature (92)..(92): n is a, c, t, g, unknown, or other
  misc_feature (94)..(94): n is a, c, t, g, unknown, or other
aaggcagcaagcaggagcagacaggaggcgccgagagcccagcgtcggagatctccgccgccatggagacgctggccagsccatgcggcgangnaaccgccggtccaaggccccgccctcctcctctgcttcctccgccctcgcctcgggcagggtccctctcgtcatggccttcctctcctgcctcgcctggctc

SEQ ID NO: 1490 - protein, 38 aa, Zea mays
  misc_feature: Ceres CLONE 241865-F
  misc_feature (4)..(4): Xaa is any aa, unknown, or other
MRRXNRRSKAPPSSSASSALASGRVPLVMAFLSCLAWL

SEQ ID NO: 1491 - DNA, 99 bp, Zea mays
  misc_feature: Ceres CLONE 241965-F
attcacgctccccgctgctccggttccgccacaccgtccgctttaaatccaaaggctccggtcactcgccgcccttcacaagaccgcacgctccccctc

SEQ ID NO: 1492 - DNA, 96 bp, Zea mays
  misc_feature: Ceres CLONE 241995-F
agggaagactcaaacgagtatctccgagagaggagtgtggtaggcaggaagaaagaatwaggcgagccgagagccattcgcatgtgaggcggcgat

SEQ ID NO: 1493 - DNA, 1692 bp, Zea mays
  misc_feature: Ceres CLONE 242012
  misc_feature: Encodes the peptide sequence at SEQ ID NO. 1494
gtctttggactcggtaatcccggtcctgtcctcccccgaccaaacacagtccctggatccatgggtgtcgaggaggagcgcgacggcgaggagcaacgccgccccctcctctcctccaccccgccagccgcggcggacccgcagcagcagcagtaccagttcctgggccggagcacctcttcagtgctgcgcggcggtggcgggggctgggaagggcctgaggtgagcgccgacgaggtcaggtcggccgctggcttccacacgttccagggcccacctcccaacggcgacaacgcctatgcttacccgccgtccattcatagcgccatgctctccccgtccccatctcatgccccaccgtctccccatccaaatgaagggttggcgattgttcctcaagggccatatccgtatggtggcagttaccagccttctgagagcgtcgggagggatgtactggatgaggtggagatccgacagctactcattgaccatattggacatcgatgctgttggggaagtcaccctgcccgcacatggaaaattacctccattgaggactgcaatgtctatgttggcaccttggaaaccttcatcgaggaaagatacattattacaaaaaaggagccctttgaaagtgggaatatagatggaagagaaaaaggtcctttgcctggattgtgggaacttgatttgaggtctaagtttcctgtactttttgtaccagagaaagaagtgaccgtcaagattccacattcagatattattgaaaagtgctcagattgtgagggtcgtggagagaaaccatgccctacatgcaatgctggtcaggctcacgggttttataaagcaaatcagatgacccagtgtggtgcatgtcatggcagaggtttacttgctcaccaagatggatctgatacagtatgtggaatgtgcaatggtaaaggaatgttaccttgtatagcatgtggatcacgtggattagtgacatgcaacacatgtactggatatggttccctacttgcacaaagcatggctcatgttcaatggaagacgctgtcagctagaaaagttagtgcagctagaggggctgcttcggtccctgaagaagttttccacagagccaaaggagtgcagctatgcaacatacaggcataccagtgcactcctgcattttttgctgattcatacccactcaaccagttttcatcagaagtcatcgctagccggctgccagttccaccatctgcaagggttatttccgagagacacatcatttcagttgtgcctgtaacccgtgtcacaatggcgcgtcgcaagcagtcatttagcttctatgtcgttggctacagcagggatgtgttcataagagactatccttcgaagttttgctggggcctctgctgctgcttcgagtggctggggaaatagttatttcctgggcacgaatgaatgccttctttcagtgtgcagtgtttcattgtacagaaggctgcgtgattcttgtattttctattaaagaagatatctgtgcgtattgcagtattagattctgcatatttggatttcctgtgtataagtacatcactgtatatattgttcagtgaaaataaaaaatggcgacgtctggccatttcaaaaaaaaaaaaaaaaaaaaaaaaaaaaaaaaaaaaargaaaaaaaaaaaaaaaa

SEQ ID NO: 1494 - protein, 456 aa, Zea mays
  misc_feature: Ceres CLONE 242012
MGVEEERDGEEQRRPLLSSTPPAAADPQQQQYQFLGRSTSSVLRGGGGGWEGPEVSADEVRSAAGFHTFQGPPPNGDNAYAYPPSIHSAMLSPSPSHAPPSPHPNEGLAIVPQGPYPYGGSYQPSESVGRDVLDEVEIRQLLIDHIGHRCCWGSHPARTWKITSIEDCNVYVGTLETFIEERYIITKKEPFESGNIDGREKGPLPGLWELDLRSKFPVLFVPEKEVTVKIPHSDIIEKCSDCEGRGEKPCPTCNAGQAHGFYKANQMTQCGACHGRGLLAHQDGSDTVCGMCNGKGMLPCIACGSRGLVTCNTCTGYGSLLAQSMAHVQWKTLSARKVSAARGAASVPEEVFHRAKGVQLCNIQAYQCTPAFFADSYPLNQFSSEVIASRLPVPPSARVISERHIISVVPVTRVTMARRKQSFSFYVVGYSRDVFIRDYPSKFCWGLCCCFEWLGK

SEQ ID NO: 1495 - DNA, 409 bp, Zea mays
  misc_feature: Ceres CLONE 242061-F
  misc_feature: Encodes the peptide sequence at SEQ ID NO. 1496
gctgaacgcagagttcgatctagcacgcgcvcggccgccgccacaatggcgtcccttttcaaggacccgagcaagctctcagcgtacagggaccgccgattcaagggcacacaggaggagtatgaggcaacgctgcatgcgtcgacaagcgctgtacattgggaatatgtccttctacaccacggaggagcaggcctacgagctcttctcccgcgctggcgagatcaagaagatcatcatggggctcgacaagaactctaagaccccatgcggtttctgcttcgtactgtactactccagggaggatgctgaagatgctgtcaaatacatcagtggaacgattgcttgacgattcgtccaatccgtgttgatttcgattggggctttgaagaaggcaggcaatggggcc

SEQ ID NO: 1496 - protein, 75 aa, Zea mays
  misc_feature: Ceres CLONE 242061-F
  misc_feature (11)..(70): Pfam Name: RRM_1 Pfam Description: RNA recognition motif. (a.k.a. RRM, RBD, or RNP domain)
MRQRCMRRQALYIGNMSFYTTEEQAYELFSRAGEIKKIIMGLDKNSKTPCGFCFVLYYSREDAEDAVKYISGTIA

SEQ ID NO: 1497 - DNA, 194 bp, Zea mays
  misc_feature: Ceres CLONE 242063-F
  misc_feature: Encodes the peptide sequence at SEQ ID NO. 1498
gcactctccaggcgtctgcaatccgaaacgaaacccacccgtagcaaaccaggactgagattgagcggagagcagcacaggtcatggcggggcaggaggtggcgaacaagcgggtggtactgaagcgctacgtgaccgggttccccggcgcggacgacatggaggtggtcaccggcaccgcgcgcgtggccgtg

SEQ ID NO: 1498 - protein, 37 aa, Zea mays
  misc_feature: Ceres CLONE 242063-F
MAGQEVANKRVVLKRYVTGFPGADDMEVVTGTARVAV

SEQ ID NO: 1499 - DNA, 302 bp, Zea mays
  misc_feature: Ceres CLONE 242064-F
  misc_feature: Encodes the peptide sequence at SEQ ID NO. 1500
atgggcctattgccatttgtaggatagggccatagcgcgattagaagggacacgagcaaccgatgctgccgcagcctcacactcaaccaatattttatacaaagaaaaagaaatcttccatacatcagactttgactcgcttctatctcgcgcaascgagaagaaaggagcccgtctacgcgagagatgggcggctacgagaacggcgagtcgacgggggccgcggcgcttgctgacggtggtgtgattctgggcgtggatggcggcaccaccaacaccgtttrcgtctgcctgccggctgc

SEQ ID NO: 1500 - protein, 38 aa, Zea mays
  misc_feature: Ceres CLONE 242064-F
  misc_feature (33)..(33): Xaa is any aa, unknown, or other
MGGYENGESTGAAALADGGVILGVDGGTTNTVXVCLPA

SEQ ID NO: 1501 - DNA, 121 bp, Zea mays
  misc_feature: Ceres CLONE 242089-F
  misc_feature (56)..(56): n is a, c, t, g, unknown, or other
  misc_feature (57)..(57): n is a, c, t, g, unknown, or other
  misc_feature (121)..(121): n is a, c, t, g, unknown, or other
atcggaatcaatcgtgtttctcgcctccacgccgagaccaatccagccaccgccannctttgcctcgcctctccgattcgagggaacgatggagtgcgtcaccgatatgcccctcgcgayn

SEQ ID NO: 1502 - DNA, 296 bp, Zea mays
  misc_feature: Ceres CLONE 242114-F
  misc_feature: Encodes the peptide sequence at SEQ ID NO. 1503
  misc_feature (188)..(188): n is a, c, t, g, unknown, or other
  misc_feature (189)..(189): n is a, c, t, g, unknown, or other
  misc_feature (237)..(237): n is a, c, t, g, unknown, or other
  misc_feature (283)..(283): n is a, c, t, g, unknown, or other
ctgtggaagaaccgttgagctgagccgagcagggagaaggacgcgagamagcatggagacggcggagaggggcacaccgtgtgcgtgaccggcgcggrgrgctttawrgcatcgtggctcgtcaagctcctcctctccaccggccgctacaccgtccggggtacgtgcgtcatctcgrtgatggcawnnatgcccatcttaagacactcggaagatgccggggagaggctgcagttngtcaaggctgacatgctggactatggcagcgttgcgtccgcggtcnccggctgtcaggg

SEQ ID NO: 1503 - protein, 38 aa, Zea mays
  misc_feature: Ceres CLONE 242114-F
  misc_feature (3)..(3): Xaa is any aa, unknown, or other
  misc_feature (19)..(19): Xaa is any aa, unknown, or other
  misc_feature (35)..(35): Xaa is any aa, unknown, or other
MAXMPILRHSEDAGERLQXVKADMLDYGSVASAVXGCQ

SEQ ID NO: 1504 - DNA, 206 bp, Zea mays
  misc_feature: Ceres CLONE 242147-F
agcgtagaaactagaaagtccagtccccaaactccccagcgggcgagcagaggaggaagagtagccgccgccatgtctgggggaatcgcccgcggccgcctcgccgaggagcgcaaggcctggcgcaagaaccacccgcacgttttcgtcgcgavcggagtcgmtgcccgacgggacggtgaacctgatgatctggcagtgcacca

SEQ ID NO: 1505 - DNA, 241 bp, Zea mays
  misc_feature: Ceres CLONE 242160-F
  misc_feature: Encodes the peptide sequence at SEQ ID NO. 1506
atttttytcctccacgccgccccctccgcatttcccgtgctcctcttgttccggcatggcggasagacgcagccacaaggggaaggcggcgctasccaagcacgagtccctgatggagaagctcgccgacaagctccacgtcggcgtcggcaaggccgatcctcctcctcctcggactccgacagtgacgagcggccccgcccctcggcaaccgcctgccgacgagctcaagcagtcctcc

SEQ ID NO: 1506 - protein, 62 aa, Zea mays
  misc_feature: Ceres CLONE 242160-F
  misc_feature (3)..(3): Xaa is any aa, unknown, or other
  misc_feature (14)..(14): Xaa is any aa, unknown, or other
MAXRRSHKGKAALXKHESLMEKLADKLHVGVGKADPPPPRTPTVTSGPAPRQPPADELKQSS

SEQ ID NO: 1507 - DNA, 389 bp, Zea mays
  misc_feature: Ceres CLONE 242163-F
  misc_feature (222)..(222): n is a, c, t, g, unknown, or other
akgagtttccgtgccgtagcaacagacaagggagagtkgkgagactagcgcaacaggacagcgcacggaaagcgaggggaggggagacggagagggcgcatcggacggcggcgagatgctggcggtgttcgatcccacggtggccaagtgcccggagtctccgcagccccccggtcgccggggcggccgctggagcaggcggggccgcgcgggcgcctgatnaagggcttctccgactcgcacgacggcgccgtcaccgtcagcctgggcccctccggcgcgctggcctactcggcggccaaccagagccccctcgtgccaagtttgtttgtgctgtgaatgacatcttctgcttgtttccaagggcatatkgagaacattgccaacct

SEQ ID NO: 1508 - DNA, 236 bp, Zea mays
  misc_feature: Ceres CLONE 242193-F
  misc_feature: Encodes the peptide sequence at SEQ ID NO. 1509
aacaaaaaccctcgcaaaaatctgggatctatctagaagcatcactcaacaaaccctaggttgcctgatcggttgatcgctccatggcgatcatctccgacttcaaggacgacgaggcaccggagcagcagctggcggccggccacgttcgaggtggccctcgtggcggcgttggagaggagcgcggcgcgctccccttcctacaggcggctatggatgtcgcccaccgcagtccg

SEQ ID NO: 1509 - protein, 51 aa, Zea mays
  misc_feature: Ceres CLONE 242193-F
MAIISDFKDDEAPEQQLAAGHVRGGPRGGVGEERGALPFLQAAMDVAHRSP

SEQ ID NO: 1510 - DNA, 507 bp, Zea mays
  misc_feature: Ceres CLONE 242209-F
  misc_feature: Translation starting site: 63
  misc_feature: Pfam Name: Calreticulin Pfam Description: Calreticulin family
  misc_feature (151)..(151): n is a, c, t, g, unknown, or other
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtntgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggagcgtgcctacattaagtacatccgccctcaggatgctggatgggatgccaaggagtttgataatgagactccatacactsattatgtttggtccagataaatgtgggtcaaccaacaaggttcatttcatcct

SEQ ID NO: 1511 - DNA, 238 bp, Zea mays
  misc_feature: Ceres CLONE 242226-F
  misc_feature: Encodes the peptide sequence at SEQ ID NO. 1512
  misc_feature (110)..(110): n is a, c, t, g, unknown, or other
  misc_feature (119)..(119): n is a, c, t, g, unknown, or other
  misc_feature (126)..(126): n is a, c, t, g, unknown, or other
acacactcgactctcctctctcgcatccgcrcctttcgagctctactccaccccctcgatctcgaagcgcasagcagcagtcaggcggccatggacgcgagckcmscggnagccggcgngaaggcnaagaagggcgcggccgggcgcaaggccggcgggcgagggaagaagtcggtgacgaggtccgtcaaggccgggctgcagtttcccgtcggccgcatcgggcggtacctgaaga

SEQ ID NO: 1512 - protein, 49 aa, Zea mays
  misc_feature: Ceres CLONE 242226-F
  misc_feature (5)..(5): Xaa is any aa, unknown, or other
  misc_feature (6)..(6): Xaa is any aa, unknown, or other
  misc_feature (7)..(7): Xaa is any aa, unknown, or other
  misc_feature (10)..(10): Xaa is any aa, unknown, or other
MDASXXXAGXKAKKGAAGRKAGGRGKKSVTRSVKAGLQFPVGRIGRYLK

SEQ ID NO: 1513 - DNA, 194 bp, Zea mays
  misc_feature: Ceres CLONE 242288-F
actcatacatttcgactctcaactcccaaggtccctttttttctcgatctggaagcgccgcagtagcagccatggacgtgagcggacaggcggtaaggcgaagaagggcgcggcggggccaaggccggcgggcgacgaagaagtcggtgtcgcggtcctccagggccgggctgcagttccccgtcagccgcgtc

SEQ ID NO: 1514 - DNA, 157 bp, Zea mays
  misc_feature: Ceres CLONE 242289-F
  misc_feature (57)..(57): n is a, c, t, g, unknown, or other
  misc_feature (58)..(58): n is a, c, t, g, unknown, or other
ctacccatttcgctaatctccctccacgagccgaccaaatcgaatcgaatcgcgcgnngccgcgcagattgccggcgatggcgagcctcaccctgccgccgggccccccaacccacggcaggacgccatcggaccttccaaaaggcctttcaaaggg

SEQ ID NO: 1515 - DNA, 464 bp, Zea mays
  misc_feature: Ceres CLONE 242300-F
  misc_feature: Encodes the peptide sequence at SEQ ID NO. 1516
  misc_feature (120)..(120): n is a, c, t, g, unknown, or other
  misc_feature (187)..(187): n is a, c, t, g, unknown, or other
  misc_feature (216)..(216): n is a, c, t, g, unknown, or other
  misc_feature (224)..(224): n is a, c, t, g, unknown, or other
  misc_feature (384)..(384): n is a, c, t, g, unknown, or other
atctaccggagcgcgtctcggggaggagagagaaagtcagatccgtgttccgtgtccgcgtccagtgtgtccgctactccgctccccctcagtcctcagttcctcacctagcggtaskgncgcgcgggaracgtagatggcggcttcggargcggcacggcggcggcaacaccggtkacgccgacanaggggacggtgatcgcgatccacarcctngaggaatngagcatycagatcsaggaggccaacagcgccaagaagctggtggtgattgacttcactgcaacatggtgtcctccgtgccgcgccatggctccaatttttgctgatatkgccaagaagtccccaaatgttgttttcctgaaagttgatgtggatgaaatnaagaccattgctgagcaattcagcgtagaggccatgccaacattcctgttcatcagggaaggcgacgtcaaggacagggg

SEQ ID NO: 1516 - protein, 51 aa, Zea mays
  misc_feature: Ceres CLONE 242300-F
  misc_feature: SWISSPROT Homolog: EC 1.8.1.8 Protein-disulfide reductase
  misc_feature (8)..(8): Xaa is any aa, unknown, or other
  misc_feature (25)..(25): Xaa is any aa, unknown, or other
MAPIFADXAKKSPNVVFLKVDVDEXKTIAEQFSVEAMPTFLFIREGDVKDR

SEQ ID NO: 1517 - DNA, 436 bp, Zea mays
  misc_feature: Ceres CLONE 242321-F
  misc_feature: Encodes the peptide sequence at SEQ ID NO. 1518
  misc_feature (188)..(188): n is a, c, t, g, unknown, or other
gtcatccgtgcatacatgctcattgctcaccaagggcaagggaggaggagaggacacacagcagtagcgccgaaatggcggcgatgatgatggatagtaccgcggagaaagacctcgccggcgacgcttgcggtgagcgggcacgggcaggacttggagcggtcttgccatagaccaggagcccgccnctgcagatggtgcgagcagcagaggcctagccatcggggcgtttcgtacgggagctgatggtggagggcgttggcgtcgttcctgctggtgttctggtccgcggttggcgcgctgatgcaggagatgcacggcacgctgacgttccccatggtgtgcctcgtcgtcgcgctcaccgtcgtcttcgtgctctgctggctcggccccgcgcacttcaaccccgccgtcaccggtmaccttcaccgtattc

SEQ ID NO: 1518 - protein, 44 aa, Zea mays
  misc_feature: Ceres CLONE 242321-F
  misc_feature (40)..(40): Xaa is any aa, unknown, or other
MQEMHGTLTFPMVCLVVALTVVFVLCWLGPAHFNPAVTGXLHRI

SEQ ID NO: 1519 - DNA, 377 bp, Zea mays
  misc_feature: Ceres CLONE 242333-F
  misc_feature: Encodes the peptide sequence at SEQ ID NO. 1520
  misc_feature (185)..(185): n is a, c, t, g, unknown, or other
agcacggacaactctacccctccgcctcgaccctgaccccccacctcgtcggcgatgagttcctcttccaacggcgggaagaagccggctcccgsgcggccgcaggggtcccgccatccgcacgctcgctgacataagccgtgggcccaccggcttcccaggtgccggasgcgacacggcagcrncgacgacgagccacaggaatactacaccggttggcgagaagagtggaatgcttgttcaagatccaacaagaagaaatgatgtggatgcgatatttgaacaagccagacaagcgggtatcaaaggaatgcctcctcctcttgatggcgagtyttccaagctctaggagctttacaggggactggccgacttct

SEQ ID NO: 1520 - protein, 38 aa, Zea mays
  misc_feature: Ceres CLONE 242333-F
  misc_feature (35)..(35): Xaa is any aa, unknown, or other
MLVQDPTRRNDVDAIFEQARQAGIKGMPPPLDGEXSKL

SEQ ID NO: 1521 - DNA, 278 bp, Zea mays
  misc_feature: Ceres CLONE 242359-F
  misc_feature: Encodes the peptide sequence at SEQ ID NO. 1522
aacttgcaccattttggcaaccccgcagrcaaaagaaaggcgaaacgaggccaccagctcaccgccgagcgaasscgccgagcaaccaacccctctmctcgtccgcmgccgtctccccggaccatggccatggcgccgcctcctcccggctgctctgggcgtccgcgccgccgcctacctcaggatctccaccttccccagggccttctccaccgtgctgaaggatctgaagtatgctgwcactcatgaatgggtgaaakttgagggtgattcagcaa

SEQ ID NO: 1522 - protein, 92 aa, Zea mays
  misc_feature: Ceres CLONE 242359-F
  misc_feature (10)..(10): Xaa is any aa, unknown, or other
  misc_feature (25)..(25): Xaa is any aa, unknown, or other
  misc_feature (36)..(36): Xaa is any aa, unknown, or other
  misc_feature (80)..(80): Xaa is any aa, unknown, or other
  misc_feature (87)..(87): Xaa is any aa, unknown, or other
TCTILATPQXKERRNEATSSPPSEXAEQPTPLLVRXRLPGPWPWRRLLPAALGVRAAAYLRISTFPRAFSTVLKDLKYAXTHEWVKXEGDSA

SEQ ID NO: 1523 - DNA, 495 bp, Zea mays
  misc_feature: Ceres CLONE 242407-F
  misc_feature: Translation starting site: 86
  misc_feature: Pfam Name: DUF1664 Pfam Description: Protein of unknown function (DUF1664)
  misc_feature (252)..(252): n is a, c, t, g, unknown, or other
aacgccttccacgggcacacctcgacgtgccttgagctagggtttcctctgccgctacctccgttttacgcggccggcgcgcascatggcgattggtgcaggcgggcatgggcctcacccgggtcgtggtcctcgttggcgctggcgtcgcggctccgtcgttctccgcaacggtcgcctcgccgagatcctcggtgagcttcaggggatactcgacaaggggaacaakggggaaggacggwgkaggggganacggggaaacgatctcaacgaggctcttacctcgcaggtgcgccgccttgccatggagatccggcaacttgctaattcacgaccaataactgttctcaatggaggttctgggacaatcaggagtatcaggcctgatagtacctgcagcaactgttggagcactagggttatggttatatgtggtggaaagggatctcgttctcagacctaatgtatgtcaccaagcgcaacatggcaaatgct

SEQ ID NO: 1524 - DNA, 477 bp, Zea mays
  misc_feature: Ceres CLONE 242436-F
  misc_feature: Translation starting site: 130
  misc_feature: Pfam Name: Ribosomal_S8e Pfam Description: Ribosomal protein S8e
  misc_feature (75)..(75): n is a, c, t, g, unknown, or other
  misc_feature (77)..(77): n is a, c, t, g, unknown, or other
  misc_feature (297)..(297): n is a, c, t, g, unknown, or other
aatccgacgccggacgccccatgatttcgctctcttcttcccgtcgagacccaaccataccagcggcgccgcasngnacgaggaggcggagtagagtggccggactacctcgacacctccactgcaaccatgggtatctcacgtgattcgatgcacaagcgccgggccaccgtgggaaagcagaagacgtggcgcaagaagcgaaagtatgagcttggccgccagccttgctaacaccaaactgtctagcaataagacagtgaggagggtccgtatacgtggaggcaacgtaagtgnagggctctccgattggatacaggtaactactcgtggggaaktgaggctcttacccgcaagacccgcatcctgggatgtggtctataatgcatcaaacaatgagcttgtgaggactcagactcttgtgaaagagcgccattgtacaagttgatgctgctccattcaagcagtggtacctca

SEQ ID NO: 1525 - DNA, 335 bp, Zea mays
  misc_feature: Ceres CLONE 242454-F
  misc_feature: Encodes the peptide sequence at SEQ ID NO. 1526
  misc_feature (38)..(38): n is a, c, t, g, unknown, or other
  misc_feature (165)..(165): n is a, c, t, g, unknown, or other
  misc_feature (209)..(209): n is a, c, t, g, unknown, or other
arttcgacacgaaacacacagcaaaaccggaacagaangccttggaagagccgaggcgaasagaactgggaaggggagaagattccgatggggactaagaaacagggaggaggcggaggagatcagaaggtcctcctctggagctgccggagtcacctctaaggngctcggcaagataggccccgcmctcggaatcggcatcggctgcngcgccggcgcaggcatcggattcttcggtggtgcagggttaggctatggatttmctggactcacattaggctttggagttcgagctsgatgtggtgtcggaattggctttggttatgggttgggca

SEQ ID NO: 1526 - protein, 110 aa, Zea mays
  misc_feature: Ceres CLONE 242454-F
  misc_feature (12)..(12): Xaa is any aa, unknown, or other
  misc_feature (19)..(19): Xaa is any aa, unknown, or other
  misc_feature (54)..(54): Xaa is any aa, unknown, or other
  misc_feature (69)..(69): Xaa is any aa, unknown, or other
  misc_feature (87)..(87): Xaa is any aa, unknown, or other
  misc_feature (98)..(98): Xaa is any aa, unknown, or other
RHETHSKTGTEXLGRAEAXRTGKGRRFRWGLRNREEAEEIRRSSSGAAGVTSKXLGKIGPALGIGIGCXAGAGIGFFGGAGLGYGFXGLTLGFGVRAXCGVGIGFGYGLG

SEQ ID NO: 1527 - DNA, 193 bp, Zea mays
  misc_feature: Ceres CLONE 242497-F
  misc_feature (163)..(163): n is a, c, t, g, unknown, or other
adggcttcggggacagccaaagaagacggacggacccagtgaggcgagcacgggcgctcaccggcgatggcgacgagggcatgggtggccgcggcggtggcttgaaccctcaactgctgcctctccgctcctgctcgcccacgaatcggtctccccagcgcantcggcgtcgatggggctccggctgcgccgg

SEQ ID NO: 1528 - DNA, 153 bp, Zea mays
  misc_feature: Ceres CLONE 242510-F
  misc_feature (2)..(2): n is a, c, t, g, unknown, or other
  misc_feature (78)..(78): n is a, c, t, g, unknown, or other
  misc_feature (79)..(79): n is a, c, t, g, unknown, or other
antcgagccagccagccagccagcaagccgcttgggcgccatctctctagagcttcgtaccctcgaagaagatccggnncggcccaataaacacccggcttactacagactcgcagatggccggcctcaggatgaagttcgtcgccgtaacca

SEQ ID NO: 1529 - DNA, 188 bp, Zea mays
  misc_feature: Ceres CLONE 242566-F
  misc_feature: Encodes the peptide sequence at SEQ ID NO. 1530
attacatttgatccgccgcgscgcccgatcgacgagcgagacctcattcacaccccgatctagctagctagctagtttacgaaaaawaaatctggccacagggatgcggtggcggctgcagcggtcgccggcgcsacgctgctcctcgtcctgctggtggccaccgtcgccgccgtcgtcgtggtggt

SEQ ID NO: 1530 - protein, 28 aa, Zea mays
  misc_feature: Ceres CLONE 242566-F
  misc_feature (11)..(11): Xaa is any aa, unknown, or other
MRWRLQRSPAXRCSSSCWWPPSPPSSWW

SEQ ID NO: 1531 - DNA, 118 bp, Zea mays
  misc_feature: Ceres CLONE 242586-F
  misc_feature (25)..(25): n is a, c, t, g, unknown, or other
aacccccaccaaaacccctcctcgnctccctcccctccatccaatcctcgaaacgagcgcgcgggbaggaggtccccctctccgagatcggctagggtttttcgcgggtycctcctcc

SEQ ID NO: 1532 - DNA, 442 bp, Zea mays
  misc_feature: Ceres CLONE 242590-F
  misc_feature: Translation starting site: 103
  misc_feature: SWISSPROT Homolog: EC 5.2.1.8 Peptidylprolyl isomerase
tccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaascatcgagggcatgaacggcaaggagctggacggccgcaacatcaccgtcaacgaggcccagtcccgcggcggccgtggaggcggcggcggtgggtacggtggtggccgtggaggcggcggctacggcaaccaccgtaccagctatttct

SEQ ID NO: 1533 - DNA, 142 bp, Zea mays
  misc_feature: Ceres CLONE 242595-F
  misc_feature (63)..(63): n is a, c, t, g, unknown, or other
arattagatagagctcgccgagcaagcaagcaagccaactcggccgtccgaacgaaakcgavngagtccaaactcactcgctaaacgctcccgttctcctccgcctgcccccaccggctccccttgtacacgagcgccggag

SEQ ID NO: 1534 - DNA, 173 bp, Zea mays
  misc_feature: Ceres CLONE 242609-F
  misc_feature (97)..(97): n is a, c, t, g, unknown, or other
atcacaattcacagcgctcaagttctcgcgcccacagccaaatttttctccactcaatcgcggcataagctgcactgcmgcatggacgccagcggancggtagcaaggcgaagaagggggcggctaggcgcaaggytggcggccccaggwagaagtcggtgtksgcggtccgt

SEQ ID NO: 1535 - DNA, 378 bp, Zea mays
  misc_feature: Ceres CLONE 242616-F
  misc_feature: Translation starting site: 49
  misc_feature: Pfam Name: Transket_pyr Pfam Description: Transketolase, pyrimidine binding domain
  misc_feature: SWISSPROT Homolog: EC 1.2.4.1 Pyruvate dehydrogenase (acetyl-transferring)
gaattcctccatctaccgcgccggccgccgaggccgagggggaggaggatgctgggcgccgcgaggaggcagcttggatcccgtcccatgctgggacaggttttgcgaaggctccgccggcgcgcggcggctgaggtggcgaggggctactccgctgcggcgaaggagatgactgtccgtgatgcattgaactctgcactggatgaagagatgtctgctggatcctttctgtttttctgatgggagaagaggttggagagtatcaaggtgcatacaagatttctaaggggcttgcttgacaagtatggtcccgatagtttcttgacacacctatcacagagggctggctttactggcattggtgttsggtgcagctta

SEQ ID NO: 1536 - DNA, 185 bp, Zea mays
  misc_feature: Ceres CLONE 242640-F
  misc_feature (121)..(121): n is a, c, t, g, unknown, or other
gacttccctagggtttagtcgcgccgccgccgccgccgaaacagcacattgctctctcgatctcagccatggcgtaggtggagcagccccaggacgcggtgaagctcttcaaccgctggancytcgacgatgtccaggtgaacgatatctcgctcgaacgactacctggctgtgactgcggcgaa

SEQ ID NO: 1537 - DNA, 333 bp, Zea mays
  misc_feature: Ceres CLONE 242704-F
  misc_feature (97)..(97): n is a, c, t, g, unknown, or other
  misc_feature (151)..(151): n is a, c, t, g, unknown, or other
aaccctagccgcactgcgctcatttctgcatccccctcccgccgcgccgcctcaccgccgccggagaagatgggtcgcgtgatccgcgcgcagtaangggtgcggggtccgtgttcaagtcccacacccaccaccgcaaggccccgccgcnttccgctccctcgamttcggcgagcgcaacgggtacctcaagggcgtcgtcaccgagtcatccacgaccccggccgtggcgcgccgctcgccaaggtcactttccgccacccattcaggtacaagcaccagaaggagctctttgtcgcagccgagggcatgtacacgggccagttcgtctac

SEQ ID NO: 1538 - DNA, 174 bp, Zea mays
  misc_feature: Ceres CLONE 242723-F
  misc_feature: Encodes the peptide sequence at SEQ ID NO. 1539
gcaaaaaacgccgcaggaggaagagagagagggccaggctgagcttactggcggcgagctggagaagaaggaaggagcatggccatgccggcggcgctgctactcttcctcctagtcctctccgccttcgaggccggggagcttccacgctgctcggctgctgctgcaggtaaa

SEQ ID NO: 1539 - protein, 32 aa, Zea mays
  misc_feature: Ceres CLONE 242723-F
MAMPAALLLFLLVLSAFEAGELPRCSAAAAGK

SEQ ID NO: 1540 - DNA, 95 bp, Zea mays
  misc_feature: Ceres CLONE 242727-F
aaataagaaaaatactcccgtgttcttcgaccggcggcggtggtgcgamgaggcggtaagggagacgagatgagggggacgaagcggccgctcgg

SEQ ID NO: 1541 - DNA, 296 bp, Zea mays
  misc_feature: Ceres CLONE 242752-F
  misc_feature (49)..(49): n is a, c, t, g, unknown, or other
  misc_feature (135)..(135): n is a, c, t, g, unknown, or other
  misc_feature (136)..(136): n is a, c, t, g, unknown, or other
gcaaaattccccatcccccaaggaagtcaggccctcgcgcaccagvtcncggaccacaccgcccgtytgaccgacgcaacccagccgtccagacgcgccgccgaccgtccttccaccaccacgcccgcgccgtcnnacgctccctagggttcmgmaggccggggatcgccggagatggacwggagcgcggtgacggcggaggacttggtggacgcgctgcgggaggtggactsggtccatgccgccgcggcctggtcccggagttcttctcccgcttcaccgtcccacgctcctac

SEQ ID NO: 1542 - DNA, 234 bp, Zea mays
  misc_feature: Ceres CLONE 242755-F
  misc_feature (119)..(119): n is a, c, t, g, unknown, or other
  misc_feature (128)..(128): n is a, c, t, g, unknown, or other
  misc_feature (223)..(223): n is a, c, t, g, unknown, or other
aagtctaaagcaagcgcactactcctcggactcggatagccacggcgcasggcasagcagccatggcttgctccgcgcaccttgtgtcccagagcctctactcgtcccaccgcgccasncagcccggnctaggaatctccgctcccagggccgaccgccggcgcggcgtctccctctgcgaggcctggytcgagggtcagtggctgccggggtgtcagcytgnagagtcgccgc

SEQ ID NO: 1543 - DNA, 99 bp, Zea mays
  misc_feature: Ceres CLONE 242806-F
  misc_feature (70)..(70): n is a, c, t, g, unknown, or other
aacaacagcgaacacatctgcttcgcattthttcccatcccccttcgcaacccaaaccccaactcgctcncatcgatggcgcccaaggccgagaagaag

SEQ ID NO: 1544 - DNA, 318 bp, Zea mays
  misc_feature: Ceres CLONE 242865-F
  misc_feature: Encodes the peptide sequence at SEQ ID NO. 1545
acaagtcatatgcacaaaatctcatttgagcgtgcaagctccttcgcctcgaaccctctcgcgcttggcttgctttcactctccagggccccactcccacctcgccgccgcagccatggcgatcacagcgccaactcccgacatcctcggcgagcgccagtycggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatactttaagatgt

SEQ ID NO: 1545 - protein, 65 aa, Zea mays
  misc_feature: Ceres CLONE 242865-F
  misc_feature (16)..(16): Xaa is any aa, unknown, or other
MAITAPTPDILGERQXGQDVRTQNVMACGAVANIVKSSLGPVGLDKMLVDDIGDVTITNDGATIL

SEQ ID NO: 1546 - DNA, 287 bp, Zea mays
  misc_feature: Ceres CLONE 242882-F
  misc_feature: Encodes the peptide sequence at SEQ ID NO. 1547
  misc_feature (70)..(70): n is a, c, t, g, unknown, or other
ctactccaccacgcgatcaccgaccgacgcctctccgacgagcaactcaaccccccaccgcgcacbattnkccggatccccacgatggcgacgatccagcaccaggcgaaaccggcggtggcggcggcgcsagcacgactactggcggtgggcagcgcgcgatggacctctacgagaagctggagaaggtcggagaggggacctacggggaaggtgtacagggcgcgggagaaggcgacggggcggatcgtggcgctgaagaagacgcggctccccgaggacgacga

SEQ ID NO: 1547 - protein, 67 aa, Zea mays
  misc_feature: Ceres CLONE 242882-F
  misc_feature (16)..(16): Xaa is any aa, unknown, or other
MATIQHQAKPAVAAAXARLLAVGSARWTSTRSWRRSERGPTGKVYRAREKATGRIVALKKTRLPEDD

SEQ ID NO: 1548 - DNA, 420 bp, Zea mays
  misc_feature: Ceres CLONE 242886-F
  misc_feature: Encodes the peptide sequence at SEQ ID NO. 1549
  misc_feature (88)..(88): n is a, c, t, g, unknown, or other
gagaaagtcagatccgtgttccgtgtccgcgtccagtgtgtccgctactccgctccccctcagtcctcagttcctcacctagcggtankgcgcgcggagacgtagatggcggcttcggagccggcagcgcgcgcaacaccggtgacgcgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatgaggggagggcgacgtc

SEQ ID NO: 1549 - protein, 139 aa, Zea mays
  misc_feature: Ceres CLONE 242886-F
  misc_feature (54)..(139): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (29)..(29): Xaa is any aa, unknown, or other
ESQIRVPCPRPVCPLLRSPSVLSSSPSGXARGDVDGGFGAGSARNTGDATEGTVIAIHSLEEWSIQIEEANSAKKLVVIDFTATWCPPCRAMAPIFADMAKKSPNVVFLKVDVDEMKTIAEQFSVEAMPTFLFMRGGRR

SEQ ID NO: 1550 - DNA, 156 bp, Zea mays
  misc_feature: Ceres CLONE 242898-F
  misc_feature (30)..(30): n is a, c, t, g, unknown, or other
  misc_feature (74)..(74): n is a, c, t, g, unknown, or other
  misc_feature (75)..(75): n is a, c, t, g, unknown, or other
aacaacagcgaacacatctcctcgcatttnttcccatccgatccccccttcgcaaccaaaaccccaactcgccnncatcgatggcgcccaaggccgagaagaaacccgcggcgaagaagccggcggaggaggagcccgckgccgagaaggcgcccg

SEQ ID NO: 1551 - DNA, 196 bp, Zea mays
  misc_feature: Ceres CLONE 242943-F
  misc_feature (24)..(24): n is a, c, t, g, unknown, or other
  misc_feature (99)..(99): n is a, c, t, g, unknown, or other
tcaacctcgccggcggccgcagcnattagaccggaagagaaaggaagcagagatcggaggcaggcgaagatggggcgcggcaaggtgcagctgaagcgnatagagaacaagataaaccggcagtgagccttctccaggcgccggaacggctgctgaagaaggcgcacgagatctccgtcctctgcgacgccgaggt

SEQ ID NO: 1552 - DNA, 402 bp, Zea mays
  misc_feature: Ceres CLONE 242949-F
  misc_feature: Encodes the peptide sequence at SEQ ID NO. 1553
atactcatagacaaaggaaaaaaccaacacactctcgcttgckgcaagaattttccggcccgaaaccgaaagcacccgcaccawdctctgcgtctcttcgtcttcggctgckcggcggcggcacagcggaggaggttgaggagatgctgtccggcgacatccccccgagccagaccatctacctcaacaacctcaacgagaaggtcaagaaagaagagttgaagagatcactttatgccttgtgttcacagtatggaaggatactggatgtggtggccctgaaaacacaaaaactgagagggcaagcatgggtggcgtttacgaaattacagctgctaccaatgctttccgtggtttgcaagatttcgatttctacagcaaaaaaatgcgagtacaatatgc

SEQ ID NO: 1553 - protein, 86 aa, Zea mays
  misc_feature: Ceres CLONE 242949-F
MLSGDIPPSQTIYLNNLNEKVKKEELKRSLYALCSQYGRILDVVALKTQKLRGQAWVAFTKLQLLPMLSVVCKISISTAKKCEYNM

SEQ ID NO: 1554 - DNA, 190 bp, Zea mays
  misc_feature: Ceres CLONE 243051-F
accaaagtccaagcaccttcccaaaaaatcccccattttcttcgaggcgaggagagcgtgaaagacagggcacgcagcgacgatgtcggggcgcggcaagggcggcaaaggtctgggcaagggcggasaaagcgccaccggaaggtcttccgtgacaacatccagggcatcaccaagcccgccatccgga

SEQ ID NO: 1555 - DNA, 123 bp, Zea mays
  misc_feature: Ceres CLONE 243056-F
  misc_feature (43)..(43): n is a, c, t, g, unknown, or other
  misc_feature (44)..(44): n is a, c, t, g, unknown, or other
gacacacgccgctgctccaagaaaccaccgccgagcccaaccnnacaagcgcgcgaggcaggagagagagagagaggcggggagcaaaacaatggaggggaaagaggaggacgtgcgcctggg

SEQ ID NO: 1556 - DNA, 250 bp, Zea mays
  misc_feature: Ceres CLONE 243086-F
  misc_feature: Encodes the peptide sequence at SEQ ID NO. 1557
  misc_feature (19)..(19): n is a, c, t, g, unknown, or other
aaccacacacagagcggyntttcgaataacacaggtgagcgcgacgatgggatccctcgttaataacatcatggtcgtgggcgccgtccttgcggstcgwmgsggamgggtcgtgcgggcccccgaagtgccacccggccccaacatcaccaccaactacaacggcaagtggctcaccgctaggccacctggtacggtcagcccaacggtgccggcgctcctgacaacggcggtgcgttgccgggatcaa

SEQ ID NO: 1557 - protein, 68 aa, Zea mays
  misc_feature: Ceres CLONE 243086-F
  misc_feature (17)..(17): Xaa is any aa, unknown, or other
  misc_feature (19)..(19): Xaa is any aa, unknown, or other
MGSLVNNIMVVGAVLAXRXGRVVRAPEVPPGPNITTNYNGKWLTARPPGTVSPTVPALLTTAVRCRDQ

SEQ ID NO: 1558 - DNA, 450 bp, Zea mays
  misc_feature: Ceres CLONE 243089-F
  misc_feature: Encodes the peptide sequence at SEQ ID NO. 1559
  misc_feature (69)..(69): n is a, c, t, g, unknown, or other
  misc_feature (437)..(437): n is a, c, t, g, unknown, or other
cactttcgatcgacacagaaaattccccaccaaaatctcctccccctgaagtcccgaagctcgcggaancgagatgtaccatcccacgagaggcggcgtccgcggcggcagagatcaattcaaatgggacgatgtgaaggttgacaagcatcgggagaattaccttggtcatagtgttaaggctcytkgttkgtagatggcagaaaggaaaggatctttactggtatactcgggataagaaatccgacacgggagatgctcttaaggaagaaatcaggagagttaaggaagaggaggaacaggctatgcgtgaggctcttggcttagctcctaagcgcmsaatcgaactcagggtaatcgcttggataagcatgaatatsctgagctgattaagagaggatcaactgcggaggacttgggagcaggacacgctgaancagcacaagtgca

SEQ ID NO: 1559 - protein, 37 aa, Zea mays
  misc_feature: Ceres CLONE 243089-F
MYHPTRGGVRGGRDQFKWDDVKVDKHRENYLGHSVKA

SEQ ID NO: 1560 - DNA, 416 bp, Zea mays
  misc_feature: Ceres CLONE 243138-F
  misc_feature: Encodes the peptide sequence at SEQ ID NO. 1561
  misc_feature (389)..(389): n is a, c, t, g, unknown, or other
agatccagcggcctcaccaagttcaccatcaccacccgcaccayacacgagcacacgcgacgactgacaaggcgaggggagcaatcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcktcatccttgggagggacatgatgaccactctcatggtcatggacacgggcatgaggcatcatcatcgtcatcttcacattaagttccttactggctgcggacgaatgtttggcatgttccaacaactaaagtttnagttaataaattctatcaccctgcatg

SEQ ID NO: 1561 - protein, 80 aa, Zea mays
  misc_feature: Ceres CLONE 243138-F
  misc_feature (54)..(54): Xaa is any aa, unknown, or other
MGGGGAHGGTTYKGYTIPHNKRWHTVAGKGLCAVMWFWVFYRAKQDGATLLGLXHPWEGHDDHSHGHGHGHEASSSSSSH

SEQ ID NO: 1562 - DNA, 277 bp, Zea mays
  misc_feature: Ceres CLONE 243150-F
  misc_feature: Pfam Name: Ribosomal_L31e Pfam Description: Ribosomal protein L31e
  misc_feature (64)..(64): n is a, c, t, g, unknown, or other
atctcacgccgcaacctccctcgagcccgagcaaacaagggcggacgcggascggcggcgagsnaatggcggagaagaagcgaggagccggcactcgcaaggatgaagtggtgacacgcggagtacaccatcaacctccacaaacgcctccacggatgcaccttcaagaagaaggcaccaaatgccatcaaggagatcaggaagttcgctcagaaggccatgggtactactgatgtccggattgacgtgaagctcaacaagcacatcttggagcagt

SEQ ID NO: 1563 - DNA, 474 bp, Zea mays
  misc_feature: Ceres CLONE 243174-F
  misc_feature: Encodes the peptide sequence at SEQ ID NO. 1564
ccctcttccatagcatagcagagcaggcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactgggatgatatggagaaaatctggc

SEQ ID NO: 1564 - protein, 88 aa, Zea mays
  misc_feature: Ceres CLONE 243174-F
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVNNWDDMEKIW

SEQ ID NO: 1565 - DNA, 110 bp, Zea mays
  misc_feature: Ceres CLONE 243182-F
acacgcacaccgcgacccagtccagagccagtacgtgcgamgcacgcacgctgctggtccgcgtacbagaygacggtcaggtcggccggtgcttttcagtttggaataat

SEQ ID NO: 1566 - DNA, 441 bp, Zea mays
  misc_feature: Ceres CLONE 243188-F
  misc_feature: Encodes the peptide sequence at SEQ ID NO. 1567
  misc_feature (403)..(403): n is a, c, t, g, unknown, or other
acaccctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasmcaatgttcacctggtcactgttcctgccgctaagacccttggcgagttgggctgggctttgcaagattnactctgagggcaaggcvaggaaggttgtaggctgctcc

SEQ ID NO: 1567 - protein, 86 aa, Zea mays
  misc_feature: Ceres CLONE 243188-F
  misc_feature (1)..(86): Pfam Name: Ribosomal_L7Ae Pfam Description: Ribosomal protein L7Ae/L30e/S12e/Gadd45 family
  misc_feature (50)..(50): Xaa is any aa, unknown, or other
  misc_feature (51)..(51): Xaa is any aa, unknown, or other
  misc_feature (74)..(74): Xaa is any aa, unknown, or other
MKKSSAHDGLVKGLREAAKAIEKHAAQLCVLAEDCDQPDYVKLVKALCAXXMFTWSLFLPLRPLASWAGLCKIXSEGKARKVVGCS

SEQ ID NO: 1568 - DNA, 482 bp, Zea mays
  misc_feature: Ceres CLONE 243246-F
  misc_feature: Encodes the peptide sequence at SEQ ID NO. 1569
aaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaccatcacttgtatccttttgagaattgggcaattgatgtgtcgtt

SEQ ID NO: 1569 - protein, 60 aa, Zea mays
  misc_feature: Ceres CLONE 243246-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKKSGEAESEE

SEQ ID NO: 1570 - DNA, 384 bp, Zea mays
  misc_feature: Ceres CLONE 243253-F
  misc_feature: Translation starting site: 88
ctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctt

SEQ ID NO: 1571 - DNA, 179 bp, Zea mays
  misc_feature: Ceres CLONE 243274-F
cctccacccgtgccgtcgcctcgcctatccgatctgccacctcctcccgtctcgcacgttccttcccaactccgcagcgtmsctctccgcggctgsgatcctabatccaggtttttcagcatgggcctggtgaaggaaggcatcgacatggaggagggaaccttgagatcggcatggag

SEQ ID NO: 1572 - DNA, 312 bp, Zea mays
  misc_feature: Ceres CLONE 243275-F
  misc_feature (62)..(62): n is a, c, t, g, unknown, or other
  misc_feature (67)..(67): n is a, c, t, g, unknown, or other
awtctctctcctctcctcgcctcgccttggtgtccgtgttcacgccgtcgctagcgcctgcngcggncgaacgttctgccctccccggcgccgggctcgggtcgtcgtcggccaggaagcctattcgagacaaggtcgatctttgctgccttggcgagcttcagccgaatcaaggtcgagcatggcgcaggccattaaaatagagcaacacaaaacccttcaaatcaatggagacctctgcagcaaccccgacccggccgccacaccaggcgcaacttccccatcgccatcgccctcgtcgtcgctgaggct

SEQ ID NO: 1573 - DNA, 827 bp, Zea mays
  misc_feature: Ceres CLONE 243298-R
gggaggcttccgtacctacatgtatggtcacgtgtacactagacaccgtacttgccacatgaaaaaggataaacaagttccaaactttagaatcgtttggcaggttaaggttatggcaactggaggagctagcccccgagccagagcgcaggccgcgtctcagcatgaggccgagccgctcgctggcgacgtcgcacttgacaggcgcgagcccgacgcggccgcgctccaggtcgtactcgacccacaggttcatctgggggtggagcacctagctcacttgccgcagttgcaggggtcgcactggcagttgccgccgcacttgcacccgccgttctcagctccggcggccgcctcgaacccgccctcggcgtgccccttggatggtgcgacacccatgatgagagcctgggtggctggtggaggtcacctagctcggccatgctccggtggctctcctgtggcatgccgtattccagatcttgcgcctatgtactcgatcctcactctcatagtgccgtttggttgccagatcgtcccatgatagctcccgtgaacgacaatgcctccaatgcatgagctgcaagtgcaacccactttgcaactctccaattcatcttcataaacctggacagggtgtcaaagtaaccagctgtgtccactgggataaactacttcccagctatgggttcaagaaaatgaagcctcctgctgcaggcttccaccagtgtggaacaaattgtgacctatgagtaatttgacaagcagcttccttctgctgggtccaggacaaccaaagatcaatttcgacaaaaattctagccccg

SEQ ID NO: 1574 - DNA, 834 bp, Zea mays
  misc_feature: Ceres CLONE 243298-R2
gaattgggtaccgggccccccctcgaggtcgacggtatcgataagcttttttttttttttttttacaataaagaagccttccgtacactacacttaagtgttccggttacactattacaccgtacatgccacatgaaaaaggataaacaagttcctaacttcttaatcctttggcacgctaaggttgatggcaactggacgagctagcccccgagccagagcgcaggccgcgatctcagcatgcacgccgaacccctcgctggcgacgtcacccttgacacgcgcgagccccactcggccactctccatgtcttactcgacccagcatgttcatctagagggtgtggagcaccatagctcacattgcctcagttgcatgggtcgcacatggcagttgccgcctgcacttgcacccggatttcatcatctccagcggccgccttcgaaccctccctcggcgtgccccttggatggtgcatacacccatgatgagagcctggacgccctgttggatctcacctgctccaccagcttgcgggacacaccaacggctgccttattccacaccttgcgcctatgtacccgacccccccctcatagtccgcctggttgccagaccgtcctatgatagctaccgtgaacaacaatgcctcaaatgcatcaactccaagtgcaaaccactttgccactctccaattcactttcaaaaagctggacagcatgtccaagctaccagctgcgtcaactgggatacactacttccagatatggctgcagaaaatgaaacctcctgcagcaagctccaccagtgtgaacataatagcgcggtatgag

SEQ ID NO: 1575 - DNA, 382 bp, Zea mays
  misc_feature: Ceres CLONE 243311-F
  misc_feature: Encodes the peptide sequence at SEQ ID NO. 1576
  misc_feature (149)..(149): n is a, c, t, g, unknown, or other
  misc_feature (176)..(176): n is a, c, t, g, unknown, or other
  misc_feature (235)..(235): n is a, c, t, g, unknown, or other
aaaaaatttcgaaacgagaggtgtctgcctgtyacttgcgaagaaatcgcgaggggaagcgtgacacctgacgagctgagcaggcaggcggttagtggccgagcgaaacatcctcgatctcgtatcgtagctgccgccgctcagagcantggagagggcggtgcagttcggaagtngcacaccaacacggccgaccttctctcctggtcggccaacgggccctgacgcatctgcntcgccggccgcgtcctcccgccccagcctcaakccggccgcggggattacgccggcgattttcggcgcgccggtmaccgagcaggaggccgaggatctgagcaagagtgaaaggaaattttsctctggctcaaagttgaaaragatg

SEQ ID NO: 1576 - protein, 74 aa, Zea mays
  misc_feature: Ceres CLONE 243311-F
  misc_feature (50)..(50): Xaa is any aa, unknown, or other
  misc_feature (59)..(59): Xaa is any aa, unknown, or other
KKFRNERCLPVTCEEIARGSVTPDELSRQAVSGRAKHPRSRIVAAAAQSXGEGGAVRKXHTNTADLLSWSANGP

SEQ ID NO: 1577 - DNA, 136 bp, Zea mays
  misc_feature: Ceres CLONE 243341-F
  misc_feature (56)..(56): n is a, c, t, g, unknown, or other
  misc_feature (97)..(97): n is a, c, t, g, unknown, or other
aactaaaccctagatctctctctctagaatgccgacgccttcggtctcagcaagcncggcggcgacggcggggacggcatcctggccgccctctccngttcgcaggtggcggcgcacgggcgagaggcggcggccg

SEQ ID NO: 1578 - DNA, 237 bp, Zea mays
  misc_feature: Ceres CLONE 243347-F
  misc_feature: Encodes the peptide sequence at SEQ ID NO. 1579
  misc_feature (175)..(175): n is a, c, t, g, unknown, or other
accaccgcatcccacaccccccgagctcagcttagctccactccagctccaatcacagtcgtgaccagagcgcgagastagctagagggccgtgaaaatgccgatcaataggatcgcmctggggagccaccasgaggtgtaccacccgggcgccctcaaggcgtmtttccgctgnagttcatctccaccctcatcttcgtcttcgccggcyagggctccggcattggccttcagcaa

SEQ ID NO: 1579 - protein, 46 aa, Zea mays
  misc_feature: Ceres CLONE 243347-F
  misc_feature (12)..(12): Xaa is any aa, unknown, or other
  misc_feature (23)..(23): Xaa is any aa, unknown, or other
  misc_feature (26)..(26): Xaa is any aa, unknown, or other
MPINRIALGSHXEVYHPGALKAXFRXSSSPPSSSSSPARAPALAFS

SEQ ID NO: 1580 - DNA, 340 bp, Zea mays
  misc_feature: Ceres CLONE 243353-F
  misc_feature: Encodes the peptide sequence at SEQ ID NO. 1581
  misc_feature (300)..(300): n is a, c, t, g, unknown, or other
  misc_feature (316)..(316): n is a, c, t, g, unknown, or other
aaaatcaagaaaacacttgthtccagtttccatgcagagcagaaaagatcagctagcgagagaagcaatggcgtcggctcctgcgttctgcgtcgcgctgctgctggmttccgtcgctgccgtccaagckgtgccgccccaggccggcacgtcgtccacctgcagcactgacctcctccgcctcctcccctgcctgchcttcatcgagggcaccgccaccgtgccggcggacacctgctgcgccaaccttggcagcatggtgcacgrcgagccgcagtgcctctgccaggccctcagcanccccagcacggccccngtcgccgtcaacatgacgcgcgtg

SEQ ID NO: 1581 - protein, 103 aa, Zea mays
  misc_feature: Ceres CLONE 243353-F
  misc_feature (26)..(26): Xaa is any aa, unknown, or other
  misc_feature (56)..(56): Xaa is any aa, unknown, or other
  misc_feature (79)..(79): Xaa is any aa, unknown, or other
  misc_feature (90)..(90): Xaa is any aa, unknown, or other
MQSRKDQLAREAMASAPAFCVALLLXSVAAVQAVPPQAGTSSTCSTDLLRLLPCLXFIEGTATVPADTCCANLGSMVHXEPQCLCQALSXPSTAPVAVNMTRV

SEQ ID NO: 1582 - DNA, 147 bp, Zea mays
  misc_feature: Ceres CLONE 243356-F
  misc_feature (67)..(67): n is a, c, t, g, unknown, or other
  misc_feature (124)..(124): n is a, c, t, g, unknown, or other
atttcccactacctgctcctgcttcttgcctgttcggtgtgcgctgcgcgaggtgaggagcggacanggaggtgaaggggatgaaggaggagatgatggtcggcctgtcggcgccggagccggntggggaggtggggcgccgcgccg

SEQ ID NO: 1583 - DNA, 193 bp, Zea mays
  misc_feature: Ceres CLONE 243404-F
  misc_feature (115)..(115): n is a, c, t, g, unknown, or other
aatctcaagccaccatcgacccttcaagtctcgctacgtagcagtgcaataaaaaaagcagccgcaatggcgagcagcaccatggccctctcctccacggccttcgccggcaagncgtgaacgtgccgtcgtcgtccgccttcggsagggcccgcgtgacgatgcgcaagacggcggcgaaggcaagccagcg

SEQ ID NO: 1584 - DNA, 196 bp, Zea mays
  misc_feature: Ceres CLONE 243433-F
  misc_feature (67)..(67): n is a, c, t, g, unknown, or other
  misc_feature (123)..(123): n is a, c, t, g, unknown, or other
  misc_feature (126)..(126): n is a, c, t, g, unknown, or other
atccgtgcatacatgctcattgctcaccaagggcaagggaggaggagaggacacacagcagtagcgncgaaatggcggcgatgatgatggatagtaccgcggagaaagacctcgccggcgacnttngccggtgagcgggcacgggcaggacttggagcggtcttgccatgaccaggagcccgccgctgcagatggt

SEQ ID NO: 1585 - DNA, 723 bp, Zea mays
  misc_feature: Ceres CLONE 243441-R
  misc_feature (426)..(426): n is a, c, t, g, unknown, or other
cgattgggtaccgggccccccctcgaggtcgacggtatcgataagcttttttttttttttttttggatcaaaaagtagtacgtactttccaacaaaacaaggtaattacaggattcatccatgttggggatggctccaaaaagcaataccaaaaaacaatcatgtcgtcttgcaatctggtccttatatacgtcgctgcactgcacgcatacataaatactcagcttctcatggtccatacagagaatgactcttttgcatgtactgaagaatgaagaaatccaagattcagcagcattattattaagagcagagcagagcagagcagatgtttcgtccgtagggaacactgcactgcacgtcgcggtcgcgtcaccaccatcgccagcagcagcagagcaccttcctccgcttccggcaccgccnccagcctggggcgcctgacgagtgagctaacactccttaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcgggcgttcggctgcggcgagcggtatcagctcactcaaaggcggtaatacggttatccacagaatcaggggataacgcaggaaagaacatgtgagcaaaaggccagcaaaaggccagg

SEQ ID NO: 1586 - DNA, 105 bp, Zea mays
  misc_feature: Ceres CLONE 243449-F
aacaacaacaacaacccgcacaacggcacgattctyctcctccgtccgcgtvtctcggtttcggcgaatgtcggggcgcggcaagggcggcaaggggctgggcaa

SEQ ID NO: 1587 - DNA, 681 bp, Zea mays
  misc_feature: Ceres CLONE 243478
  misc_feature: Encodes the peptide sequence at SEQ ID NO. 1588
aggtgtgtctagtctctagtctagctaggcactactctagctcccaagtggccaagtatactcgccagagtacgtagagtgtagttgagcgtcgtcgaaggatggcgtggacytcccgccgcatggtcgcgtccgcgctcgtcttcctgctgatgctgctcgccgcctcagagatggggacgacgaggktggcggaggcgaggcactgcacgtcgcagagccaccggttcgtcggcgcctgcatgagcaagagcaactgcgagaacgtctgcaggacggagggcttcccgtggggcgagtgcaggtggcacggcatagagcgcaagtgccactgcaagcggatctgctagtaattaactagccggctggccagcgcatgcatgcacgacgaccgacctacctgctgctggtccgtttgcgtttgtttcttgtcctttgggccttgctgtggcgcgcagtcttgcgtacgtgcgtgtgcgtgtgtcttttcagttactctcaattagtcatagcagacgtgcgtgggtgcgagcgtgtgtctcgttgcattgatgaaccggcttcacgtgctgtggttttacagtttctgatgtgttttagctaatctcgaataataaataataaggccccgtcttcacgcagttgcgtactgggtgcttacgtacaaaaaaaaaaaaaaaa

SEQ ID NO: 1588 - protein, 82 aa, Zea mays
  misc_feature: Ceres CLONE 243478
  misc_feature (34)..(82): Pfam Name: Gamma-thionin Pfam Description: Gamma-thionin family
  misc_feature (4)..(4): Xaa is any aa, unknown, or other
  misc_feature (30)..(30): Xaa is any aa, unknown, or other
MAWXSRRMVASALVFLLMLLAASEMGTTRXAEARHCTSQSHRFVGACMSKSNCENVCRTEGFPWGECRWHGIERKCHCKRIC

SEQ ID NO: 1589 - DNA, 298 bp, Zea mays
  misc_feature: Ceres CLONE 243502-F
  misc_feature: Encodes the peptide sequence at SEQ ID NO. 1590
  misc_feature (243)..(243): n is a, c, t, g, unknown, or other
gatccgcagagcaaagcagaasagcaagaagcaaagcaatggagaacmctgcgagtgtgctagttctaccagcgcagttcaccaaactcaccttcggaaacctgtacatccgccgggccgggccgggcagcagggagataaccgaggagggcaggtgcgacctggacaagagatactgagtgacttcaccacgtctacgasgccgcggccccgacgccagcmttgtggcmcgcgtgcaggggntcaccagcgaaatcgggaacgcgcaccaactgtwcgtcgttggttttcgacaccg

SEQ ID NO: 1590 - protein, 46 aa, Zea mays
  misc_feature: Ceres CLONE 243502-F
  misc_feature (4)..(4): Xaa is any aa, unknown, or other
MENXASVLVLPAQFTKLTFGNLYIRRAGPGSREITEEGRCDLDKRY

SEQ ID NO: 1591 - DNA, 328 bp, Zea mays
  misc_feature: Ceres CLONE 243506-F
  misc_feature: Encodes the peptide sequence at SEQ ID NO. 1592
gaaaagccgcacaagaaaatcacagcagtacagcaccagaaacagaaaggtagtagatcaaggaacgccagtdcggcgacaatgaccggcagtggaagcacgggacgccaatggcaagagccagagctccagggccaaggcaatgctgctcgccttgggcaagagctttcctgaccaagttctgcctcaggagaaggttgtggagagctacctccaagaaagcagctgcracgatchcgccaccagggccaagcttcagcgcctttgcacgactacaacagtggaagacaaggtacactgttatgtccaaggagctattggataagca

SEQ ID NO: 1592 - protein, 60 aa, Zea mays
  misc_feature: Ceres CLONE 243506-F
  misc_feature (30)..(30): Xaa is any aa, unknown, or other
  misc_feature (32)..(32): Xaa is any aa, unknown, or other
MLLALGKSFPDQVLPQEKVVESYLQESSCXDXATRAKLQRLCTTTTVEDKVHCYVQGAIG

SEQ ID NO: 1593 - DNA, 284 bp, Zea mays
  misc_feature: Ceres CLONE 243515-F
attcgtgatcgaaccagactcgagagggagaggaggagggagtccgaggggagagacccaattaactgcagggattggtcgggttcggctccgcttcggagagtcccaagagatgggtggcgcggcggcggtaccaagtggatccaccacatccagcgcctcagcsgccaaggtgtcggcggaggcggtggagcggggccagagccgcgtcatcgacsctccctcaccctaattcgcgagcdcgcaaactcaaggcagagttgctgcgtgctctgggtggcgtg

SEQ ID NO: 1594 - DNA, 369 bp, Zea mays
  misc_feature: Ceres CLONE 243534-F
  misc_feature: Encodes the peptide sequence at SEQ ID NO. 1595
  misc_feature (98)..(98): n is a, c, t, g, unknown, or other
  misc_feature (99)..(99): n is a, c, t, g, unknown, or other
ctctttcttgttgcacgcctgcctgggcgaaccgtcgccgctatacaccaggcgcyyagggcttcgcggcgccgagtagccaccagctgccgctcaannttcacctctgccaagggcatggaccacatgacgatgctcggcgccggagccccccaccagctctccagggctgaaccaatgcctgaccgtabhaggggttctggcagacggatgtgcagcctgtgcctcggatagacatcatctgtcctctgccttgtcgcccttcccgctcactgctcctcaataggcccagcccaagccttaatggggcactcccatttttaatggagcaaaccctacttatgatatcgttgatctcatccttagcaa

SEQ ID NO: 1595 - protein, 38 aa, Zea mays
  misc_feature: Ceres CLONE 243534-F
  misc_feature (25)..(25): Xaa is any aa, unknown, or other
MDHMTMLGAGAPHQLSRAEPMPDRXRGSGRRMCSLCLG

SEQ ID NO: 1596 - DNA, 138 bp, Zea mays
  misc_feature: Ceres CLONE 243545-F
  misc_feature: Encodes the peptide sequence at SEQ ID NO. 1597
aaaaaagatcttgcggaaggtggcagacgcatagatgagggtgagagcatttggcgrtasgcttgacgagcgacgagtaaaccctaatgctttgatcgcggcggcatcgtttgadaaactcccgaatcgatccgccta

SEQ ID NO: 1597 - protein, 34 aa, Zea mays
  misc_feature: Ceres CLONE 243545-F
  misc_feature (8)..(8): Xaa is any aa, unknown, or other
  misc_feature (9)..(9): Xaa is any aa, unknown, or other
  misc_feature (27)..(27): Xaa is any aa, unknown, or other
MRVRAFGXXLDERRVNPNALIAAASFXKLPNRSA

SEQ ID NO: 1598 - DNA, 427 bp, Zea mays
  misc_feature: Ceres CLONE 243565-F
  misc_feature: Pfam Name: PfkB Pfam Description: pfkB family carbohydrate kinase
  misc_feature: SWISSPROT Homolog: EC 2.7.1.20 Adenosine kinase
  misc_feature (103)..(103): n is a, c, t, g, unknown, or other
  misc_feature (235)..(235): n is a, c, t, g, unknown, or other
  misc_feature (356)..(356): n is a, c, t, g, unknown, or other
awcgcactcgagctcgagccctcgcccgctcagtcacaaagcctcagatctcagtcacctgcgccgccgcttcgttcgwgtggaggggagaagacaggaaatngcggcgactgagggcgtgctcttggggatgggcaaccccctcctcgacatctccgccgtcgtcgatgacgccttcctgacaaagtattacatcaagctgaacaatgccattctcgctgatgagaagcacttncctatgtatgacgagtttkgctagcaagagcaatgttgaatatattgccggagagccacccagaactctatcagggttgcccaatsgatgcttcaaactcctggtgcaacaaattacattnggatgcattggaaatgacaagtttggtgaggaaatyaagaaaaacgctcaagctgcaggagttactgctca

SEQ ID NO: 1599 - DNA, 375 bp, Zea mays
  misc_feature: Ceres CLONE 243572-F
  misc_feature: Translation starting site: 95
  misc_feature (290)..(290): n is a, c, t, g, unknown, or other
  misc_feature (334)..(334): n is a, c, t, g, unknown, or other
gcaccccccattcgaacgccggagctcgacgaggacgaccgacgacgcacgcagagatccggcgtactgcaaattttgaaaactgaactgtaagatggcatcagcagagctttcccgtgaggaaaatgtgtacatggcgastcgccgagcaggskagaggtacgaggagatggttgarttcatggagaaggtagccaagactgttgactcggaggagctcactgtggaggagcgaaacctcctgtctgttgcatacaagaacgtcattggagcccgccgcgcctcatggnaktcatctcctccatcgagcagaaggaggagggccgaggcaatnaggaccgagtaacactcatcaagggttatcgtggcaagatt

SEQ ID NO: 1600 - DNA, 224 bp, Zea mays
  misc_feature: Ceres CLONE 243577-F
  misc_feature: Encodes the peptide sequence at SEQ ID NO. 1601
  misc_feature (126)..(126): n is a, c, t, g, unknown, or other
tacgcctgcctgcycacccacctccccttttccttcctcttcgccccagcgacgcgtccgcccggagaccgagcgaggcaggcaactaaccaccgagaggcagggacaggaacaggaagccggavnagatgtcgtcggtgttcagcggcgatgagacggcccccttcttcggcttcctcggcgccgccgccgccctcgtcttctcatgcatgggcgccgcgtac

SEQ ID NO: 1601 - protein, 32 aa, Zea mays
  misc_feature: Ceres CLONE 243577-F
  misc_feature: SWISSPROT Homolog: EC 3.6.3.14 H(+)-transporting two-sector ATPase
MSSVFSGDETAPFFGFLGAAAALVFSCMGAAY

SEQ ID NO: 1602 - DNA, 336 bp, Zea mays
  misc_feature: Ceres CLONE 243578-F
  misc_feature: Translation starting site: 190
  misc_feature: Pfam Name: PALP Pfam Description: Pyridoxal-phosphate dependent enzyme
  misc_feature: SWISSPROT Homolog: EC 2.5.1.47 Cysteine synthase
  misc_feature (310)..(310): n is a, c, t, g, unknown, or other
atcatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcacctagttgatcgggaacacgccgctggtgtacctcaacaaggtgaccgatgggtgcgtcggcgcgtcgccgccaagctcgagtccatggagccctgctcaggcgtcaaaggataggattgmsctacaggatgatcacggacgcagaggagaaakggctgattactccangcgtgartrttctgattgaaccaacg

SEQ ID NO: 1603 - DNA, 388 bp, Zea mays
  misc_feature: Ceres CLONE 243583-F
  misc_feature: Translation starting site: 135
  misc_feature: Pfam Name: zf-RanBP Pfam Description: Zn-finger in Ran binding protein and others
attttcgctagctccatagcacttgttccagctagctaggagagagagctttgtttaggcggcggcaagatgaacaggaagccaggagactgggactgcagggcgtgccaagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgcggctaccgg

SEQ ID NO: 1604 - DNA, 344 bp, Zea mays
  misc_feature: Ceres CLONE 243585-F
  misc_feature: SWISSPROT Homolog: EC 2.7.11.1 Non-specific serine/threonine protein kinase
  misc_feature (29)..(29): n is a, c, t, g, unknown, or other
  misc_feature (89)..(89): n is a, c, t, g, unknown, or other
  misc_feature (126)..(126): n is a, c, t, g, unknown, or other
  misc_feature (267)..(267): n is a, c, t, g, unknown, or other
gcagccgcaaccaggcaagcaagcggganygccaactcgtgcctctcggcagcggcgtctgaactctgaaccgaccgaccgaccgaccnttccgttccgttcaccccaccatggaggcgcykccgngaccggggcccatggagctggacgccccacctcccgccgcmgccgccgcgatttcmtcccgccggcagcdacaagcacaaggacggggaagggggagacgctgtgacgggccatatcatctccaccaccatcggcgggaanaacggcgakcccaagcggaccatcagttacatggcagaacgtgtcgtgggcacaggctcatttgggatcgtcttcca

SEQ ID NO: 1605 - DNA, 329 bp, Zea mays
  misc_feature: Ceres CLONE 243587-F
  misc_feature: SWISSPROT Homolog: EC 3.4.25.1 Proteasome endopeptidase complex
  misc_feature (40)..(40): n is a, c, t, g, unknown, or other
  misc_feature (77)..(77): n is a, c, t, g, unknown, or other
  misc_feature (188)..(188): n is a, c, t, g, unknown, or other
  misc_feature (312)..(312): n is a, c, t, g, unknown, or other
aaaacaagcaaaaggcacgaccaccaccgccggccgggwngcaagctcaaaccctaatcgccgtccgcyggsaacknagcacgatggcccgctacgaccgcdccatcaccgttttctcccccgacggccacctcttccaggtggagtacgctctcgaggccgtccgcaagrcaacgcgccgtgggstnccgcggcacggacaccgtcgtcctcggcgtcgagaagaagtccacacccaagctccaggactccaggtccgtgcgcaagatcgcgtgcctagacactcacatagctctggcgtgcgcggggctnaaggcggacgcgcgcgt

SEQ ID NO: 1606 - DNA, 462 bp, Zea mays
  misc_feature: Ceres CLONE 243597-F
  misc_feature: Translation starting site: 37
  misc_feature (119)..(119): n is a, c, t, g, unknown, or other
  misc_feature (439)..(439): n is a, c, t, g, unknown, or other
atcccaaaccatccattaccatattcctaagctatcatggtgcaccggacttccatagccgatgtgcatgtgatgtgcatggatctaagcccaaagawacccaacaaggccagcgccanttcggcggastactacgactggtcccccgccgatctgcccatgctcggcgttgctccattggtgccgccaagctctgcctcaccgccggagtcttgccctacccagctactccgactctgccaagatcgcctacgtcctccaaggcaaaggtatcttmggcgtggttctcccggagcgaccaaggagaaggtcatctccgtcaaggaaggcgacgcgatggcgctccccttcggcgtcgtcacctggtggcacaacaacgccgacgccgctatctccgacctcgtggtgctcttcctmrggcgacacctccacgggccanaagccgggccagtttacaaactt

SEQ ID NO: 1607 - DNA, 279 bp, Zea mays
  misc_feature: Ceres CLONE 243615-F
  misc_feature (181)..(181): n is a, c, t, g, unknown, or other
aaatcgaaacaaagaaagataaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgatgagcgcgcggtcggcrnaagcccaacgccaagaactcccaggacgggctcaccccggagcagcgccgcgagagggacaagaaagctctggaggagaaggcggccaagaaggcgca

SEQ ID NO: 1608 - DNA, 212 bp, Zea mays
  misc_feature: Ceres CLONE 243625-F
  misc_feature: Encodes the peptide sequence at SEQ ID NO. 1609
  misc_feature (27)..(27): n is a, c, t, g, unknown, or other
  misc_feature (28)..(28): n is a, c, t, g, unknown, or other
atcagtcatcacccaccgcctccgccnncgwyaacagcgtagtgtagtgtagttccggagaggttggggagagtagtagtgatccgcaatgtcgacggaggaggctgttgtggctgaggtcccggtgaccgaggtgccagcggaggtcccrgcggcccaggtggacgaggcgcccaaggvaagaaggcgcccaaggagaagaaggcgcctaa

SEQ ID NO: 1609 - protein, 41 aa, Zea mays
  misc_feature: Ceres CLONE 243625-F
  misc_feature (31)..(31): Xaa is any aa, unknown, or other
MSTEEAVVAEVPVTEVPAEVPAAQVDEAPKXRRRPRRRRRL

SEQ ID NO: 1610 - DNA, 165 bp, Zea mays
  misc_feature: Ceres CLONE 243666-F
  misc_feature (94)..(94): n is a, c, t, g, unknown, or other
  misc_feature (111)..(111): n is a, c, t, g, unknown, or other
akatctcccccatttctcctccacgccgccccctccgcatttcccgtgctcctcttgttccggcatggcggasagacgcagccacaaggggaangcggcgctacccaagcncgagtccctgatggagaagctcgccgacaagctccacgtcggcggcggcaaggc

SEQ ID NO: 1611 - DNA, 185 bp, Zea mays
  misc_feature: Ceres CLONE 243694-F
  misc_feature: Encodes the peptide sequence at SEQ ID NO. 1612
  misc_feature (21)..(21): n is a, c, t, g, unknown, or other
aaaagcgcagagsattcagcnagagcaggacagccatggcgacggcggcggcgcagtcccattcgccatcaatggacgcgcgccggtgggacgagtcatcgtaccgccgcggcatcctccgtgcccgcgacctctcgtcccgcaccctcttccgtgccgtcttctttgaccacagcgacgacccg

SEQ ID NO: 1612 - protein, 50 aa, Zea mays
  misc_feature: Ceres CLONE 243694-F
MATAAAQSHSPSMDARRWDESSYRRGILRARDLSSRTLFRAVFFDHSDDP

SEQ ID NO: 1613 - DNA, 476 bp, Zea mays
  misc_feature: Ceres CLONE 243710-F
  misc_feature: Encodes the peptide sequence at SEQ ID NO. 1614
atcctgttctataaagcgagcctaggggaagagccggaaccctagcccagcaccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgt

SEQ ID NO: 1614 - protein, 105 aa, Zea mays
  misc_feature: Ceres CLONE 243710-F
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFAR

SEQ ID NO: 1615 - DNA, 218 bp, Zea mays
  misc_feature: Ceres CLONE 243740-F
  misc_feature (38)..(38): n is a, c, t, g, unknown, or other
  misc_feature (39)..(39): n is a, c, t, g, unknown, or other
  misc_feature (64)..(64): n is a, c, t, g, unknown, or other
  misc_feature (68)..(68): n is a, c, t, g, unknown, or other
  misc_feature (142)..(142): n is a, c, t, g, unknown, or other
attsggggcatttgctacaccaccacacccacaccccnncccagcacacaacaagcagcctggnttanrgtagctgctagcaaaacaatggagaaccctgctccgagcatcgtagtggccatcgccgcacccgtggcggsgnagttcgtgaactcaccttccgtrccctgtatatgcgccgggctggtcctggcatcagggagatgactgtgccggga

SEQ ID NO: 1616 - DNA, 332 bp, Zea mays
  misc_feature: Ceres CLONE 243753-F
  misc_feature (221)..(221): n is a, c, t, g, unknown, or other
  misc_feature (314)..(314): n is a, c, t, g, unknown, or other
aattagaatccacctcgcaccccgcgggckggtgactcccctagggtttcgtcgctccgccgccgccgaaacagcacatcgctctctcgatctcagccatggcgaggtggagcagccccaggacgcggtgaagctcttcaaccgctggaccttcgacgatgtccaggtgaacgatatctcgctgaacgactacctggctgtgactgckgcgamsacgsgancattcctgccgcactccgcggggcgctactccaagaagcggttccgcaagcgcagtgcsattcgtcgagcgcctcaccaactcgctcatgatncacgggcgcaacaacggc

SEQ ID NO: 1617 - DNA, 328 bp, Zea mays
  misc_feature: Ceres CLONE 243786-F
  misc_feature: Encodes the peptide sequence at SEQ ID NO. 1618
  misc_feature (125)..(125): n is a, c, t, g, unknown, or other
  misc_feature (231)..(231): n is a, c, t, g, unknown, or other
  misc_feature (320)..(320): n is a, c, t, g, unknown, or other
gcaagaagaatcccaaccccgaccgacctaccctaatcggcgatggcgacggtggcgatggacatctcgaagcccactccagtgcgtccggcgacgaggccgcggcggcgcaaagggggaaggancggcggagggggcgaggggctgcggcagtactacctgcagcacatccacgacctgcagctccagatccggcagaagacccacaacctcaaccgtctmgaggcccancgcaaatgacctcaactcccgagttagaatgctcagggaagagttgcagttgcttcaagagcctgggctcatatgttggycaggtggtnaaggtcat

SEQ ID NO: 1618 - protein, 65 aa, Zea mays
  misc_feature: Ceres CLONE 243786-F
  misc_feature (28)..(28): Xaa is any aa, unknown, or other
  misc_feature (63)..(63): Xaa is any aa, unknown, or other
MATVAMDISKPTPVRPATRPRRRKGGRXGGGGEGLRQYYLQHIHDLQLQIRQKTHNLNRLEAXRK

SEQ ID NO: 1619 - DNA, 155 bp, Zea mays
  misc_feature: Ceres CLONE 243797-F
  misc_feature (53)..(53): n is a, c, t, g, unknown, or other
cccaattcgcaacacaatcgtcctccgccaccctccattaaccctagcggcanagcgctcgtttgatccccgcggcggtccggcgtccgggtagggagcgaggatgacggatccctggtgcggaacaagccggggatggccagcatcaaggagat

SEQ ID NO: 1620 - DNA, 400 bp, Zea mays
  misc_feature: Ceres CLONE 243824-F
  misc_feature: SWISSPROT Homolog: EC 2.7.11.22 Cyclin-dependent kinase
  misc_feature (39)..(39): n is a, c, t, g, unknown, or other
tagaagcgagcgagcgagcagcagtaggcagcggcgcgngcgaggagcagaccagcacccagcagccctcgtcggggggcggcastgcagcttcaccagccgccgcctttccccgtctcctctgcctctgcctctccccctaacccccttccatttctccaccccaccccgctcccgcttccgcttcctcgccacttagttcgttccgcacccgcagccgcgctgttcgcattsggggcacgcaatggagcagtacgagaaggtgggagaagatcggggagggcacgtacggggtggtgtacaaggcgctggacarggccaccaacgagacgwtcgcgctcaargaagatcccgcctcgagcaggaggacgatgggcktcccgtccaccgccatccgcga

SEQ ID NO: 1621 - DNA, 117 bp, Zea mays
  misc_feature: Ceres CLONE 243840-F
  misc_feature (100)..(100): n is a, c, t, g, unknown, or other
aaagtaaacgcggcagaaccgagccgttcctccaacgactcacctcccacccactcacccaccccatggcgaccaacccctccaacggcgccggcgcsancgtcmctgcagccccgg

SEQ ID NO: 1622 - DNA, 171 bp, Zea mays
  misc_feature: Ceres CLONE 243850-F
ttggcccccggtaacagcagtttatcatccccatctcccgccgtcccgcgtgctcatacttgcttgcattgcctcccgtttgcyccgatccaacgacgacgttcgctggccgtagccaagaaggtatctcgcccaaacaaaggccgtcaagccaccatatggccgtgtccg

SEQ ID NO: 1623 - DNA, 280 bp, Zea mays
  misc_feature: Ceres CLONE 243909-F
  misc_feature: Encodes the peptide sequence at SEQ ID NO. 1624
  misc_feature (279)..(279): n is a, c, t, g, unknown, or other
acatcaccagcgcacagctctyctcatcggcgcacccgagctcgcyctctccttcctcatcgaggcccgagttyctgctctgatggcgaccgacgtggctgagactyccgcgccgttggtggatgcrgcccctgaggcgcccgcggacaccccggcggcgctgctgttgacgcgamcggccaaggccaagaaggccacagcgccgaagaagcgcgctyacycggacccatccgccgtacgccgagatggtctcggagggcgatcgcgtcgctcaaggana

SEQ ID NO: 1624 - protein, 65 aa, Zea mays
  misc_feature: Ceres CLONE 243909-F
  misc_feature (9)..(9): Xaa is any aa, unknown, or other
  misc_feature (32)..(32): Xaa is any aa, unknown, or other
  misc_feature (46)..(46): Xaa is any aa, unknown, or other
  misc_feature (47)..(47): Xaa is any aa, unknown, or other
MATDVAETXAPLVDAAPEAPADTPAALLLTRXAKAKKATAPKKRAXXDPSAVRRDGLGGRSRRSR

SEQ ID NO: 1625 - DNA, 769 bp, Zea mays
  misc_feature: Ceres CLONE 243943-R
  misc_feature (21)..(21): n is a, c, t, g, unknown, or other
  misc_feature (47)..(47): n is a, c, t, g, unknown, or other
aaaaagaataattgggggtgngggcaatcggtcgcaccacccacaanaccaaacgaatgggtacgggccccccctcgaggtcgacggtatcgataagcttttttttttttttttttccaaggatcgtttcacacgctctttccagttttaagattaaccaaaaatttccatgccagcaacgttggacaacagggtcagctagaaagccccaaaacagaagtgctcaaagcaaagcaaagcatagctatagcagatgccaaaagattctggacatctagacttcacaaaaaatactgaacttaagctgcagaagactagacttcacaaaaaatactgaacttaagctgcataagactggtctcatagtagactatgcctactcccagccttgggctgtcggcggggctgcttggtcccaaccagtaggagcaaccactgggaggtacagtgccgttccgcaggtacaggggcccccggtttgaatcccatgctttcaccggtaggaaatgggagccgggaacagcttcccccaaaataggacctagtagggaagaaaacagggtgggggcaacccaccattagaaggtaccactgggtgcgcaaaccccccctggaaacaggtctccttggggaaaataaaggggaaattgccgggaagaacttcaggggggccccggggaaaattttcctccctcccgggggacccctttagcattatcctcctggggggctctcttgtaacgaaaacaaactgttttgcaacccttgt

SEQ ID NO: 1626 - DNA, 442 bp, Zea mays
  misc_feature: Ceres CLONE 243953-F
  misc_feature: Encodes the peptide sequence at SEQ ID NO. 1627
gaggtatcgagtctcgaccaacccatacgcacctaccctccgccacykttccccccctctgcatctcgcccgccgttctcgtccttgtagatctcctcgcacctcgcccattcgcttcaccaagggtttaagaccggcggcgatggcggcgamstggcgcastgcgcacacaggtaacgcgtgcggcggagttcgcctcgaaccacggctgctcctactacaaggaggtaatggagaagaacaagcagtacgtcgttcagccccccaccgtcgagaagtgccaggagctctccaagcagcctcttttacacccgcctcgcaagcctaccaggtcgctatgagtcattctggaaggagcttgattgtgtcaagcaggtatggaagaacagggaaggacctcacggttgaggaccttggcattgccagtttgtttggagttgag

SEQ ID NO: 1627 - protein, 36 aa, Zea mays
  misc_feature: Ceres CLONE 243953-F
MEKNKQYVVQPPTVEKCQELSKQPLLHPPRKPTRSL

SEQ ID NO: 1628 - DNA, 186 bp, Zea mays
  misc_feature: Ceres CLONE 243954-F
atacacggtggcatcgcagggtcagcagcatcattagawaacgacgtctcgccgttcttcgtcttcagatctagggttctctcgtgctctgttctcakcttctgctcgctggtgtcccctccctctcacccatggcttcggcggcggcggcaactcaggtsgggacttacttcctgcggaactact

SEQ ID NO: 1629 - DNA, 430 bp, Zea mays
  misc_feature: Ceres CLONE 243977-F
  misc_feature (268)..(268): n is a, c, t, g, unknown, or other
aacgttcggyggcggcgaggcgacacgccaccaccagtyagccgccccgccacagccatgcgcctccacgccggcgcacgctcgsgctcctgctcgcccgccgctccctctcctcctccccccgtatcccgcgggtgcacacagggatacggagcgaggcgccctcccggagctctcccttctatccgccgagcagcgcccgcagtccttccacgggaccaggccggtggcggcaagggactactacgatgtgctcggcgtcacaagnakcgccaccaggcgtagatcaaaaaggcctattatggggcttkcaaagaagctccatccagacacaaataaaggtgatgcggatcagaacgcagtttcaagaggttcaacgagcttatgagactctaaaggatgaacaaaaaaggtcattatatgatcaggt

SEQ ID NO: 1630 - DNA, 448 bp, Zea mays
  misc_feature: Ceres CLONE 244004-F
  misc_feature: Encodes the peptide sequence at SEQ ID NO. 1631
  misc_feature (398)..(398): n is a, c, t, g, unknown, or other
gcttcgaagtgttcgtgcgaaggcgaccctccctccttcgctccttccccgccgcctcccggccgtcgccgccatggtgaagtactcgcaggagccgggcaaccctaccaagtcggctaaggccatgggcagggatctgagggtccacttcaagaacacaagggaracagcctttgcgctwcgcaagttgtctttgaccaaggctaagcgataccttgaggatgttattgctcacaagcaggcaattcccttccggagatactgtgggggtgttggtcgcaccgcgcaagctaagtctcgccactccaatgggcagggccgctggcggtttaaatcagccgggttcatcctggatttgctgaagaatgctgagagtaacgctgatgtgaaagggcttngatgtggacaacctctatatttcacacatccaggtgaaccaaggcccaga

SEQ ID NO: 1631 - protein, 125 aa, Zea mays
  misc_feature: Ceres CLONE 244004-F
  misc_feature (17)..(121): Pfam Name: Ribosomal_L22 Pfam Description: Ribosomal protein L22p/L17e
  misc_feature (109)..(109): Xaa is any aa, unknown, or other
MVKYSQEPGNPTKSAKAMGRDLRVHFKNTRETAFALRKLSLTKAKRYLEDVIAHKQAIPFRRYCGGVGRTAQAKSRHSNGQGRWRFKSAGFILDLLKNAESNADVKGLXCGQPLYFTHPGEPRPR

SEQ ID NO: 1632 - DNA, 141 bp, Zea mays
  misc_feature: Ceres CLONE 244011-F
amtctctctccccatccgcgccagtccaaccaagtcagcacccgcgcgcgcaaggagttcacgcccatggcagcaccaacatggcgtcggccacctcgcggttcatgctggccgcgggcgtgcccactgccagtagcggca

SEQ ID NO: 1633 - DNA, 92 bp, Zea mays
  misc_feature: Ceres CLONE 244034-F
  misc_feature (33)..(33): n is a, c, t, g, unknown, or other
awagtttcgtccaccatttcgctctcgcaagtngccaagccaccgatttgtttacaggcgccggagctcccgacgacgactgagccatgtgc

SEQ ID NO: 1634 - DNA, 383 bp, Zea mays
  misc_feature: Ceres CLONE 244054-F
  misc_feature: Encodes the peptide sequence at SEQ ID NO. 1635
aaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggagaggaccgtgagggcgcatggcctcagtgctgacgatcatcggctttgggattcctaaccttcaactcattcatggctgtgtacaggtcaaatggagatgttggatctatctcctttgtggtcttctcttacctggtcctcgttcctgctgttctactggcctgcgccgatttcgaggacaacttccaccagag

SEQ ID NO: 1635 - protein, 40 aa, Zea mays
  misc_feature: Ceres CLONE 244054-F
MAVYRSNGDVGSISFVVFSYLVLVPAVLLACADFEDNFHQ

SEQ ID NO: 1636 - DNA, 398 bp, Zea mays
  misc_feature: Ceres CLONE 244070-F
  misc_feature: Encodes the peptide sequence at SEQ ID NO. 1637
  misc_feature (261)..(261): n is a, c, t, g, unknown, or other
  misc_feature (325)..(325): n is a, c, t, g, unknown, or other
adctgctgaacgcagagttcgatctagcacgcgtvcggccgctgcccacaatggcgtcccttttcaaggacccgagcaagctctcagcgtacagggaccgctgattcaagggcacacaggaggagtatgaggcaacgctgcatgcgtcgacaacgctgtacattgggaatatgtccttctacaccacggaggagcaggcctacgagctcttctcccgcgctggcgagatcaagaagatcatcatggggctcgacaagaacnctaagaccccatgcggtttctgcttcgtactgtactactccagggaggatgctgaagatgctgnaaatacatcagtggaacgatgcttgacgatcgtccaatccgtgttgatttcgattggggctttgaagaaggca

SEQ ID NO: 1637 - protein, 76 aa, Zea mays
  misc_feature: Ceres CLONE 244070-F
  misc_feature (31)..(31): Xaa is any aa, unknown, or other
  misc_feature (52)..(52): Xaa is any aa, unknown, or other
MSFYTTEEQAYELFSRAGEIKKIIMGLDKNXKTPCGFCFVLYYSREDAEDAXNTSVERCLTIVQSVLISIGALKKA

SEQ ID NO: 1638 - DNA, 290 bp, Zea mays
  misc_feature: Ceres CLONE 244081-F
  misc_feature: Encodes the peptide sequence at SEQ ID NO. 1639
ctactccaccacgcgatcaccgaccgacgcctctccgacgagcaactcaaccccccaccgcgcacbattakcyggatccccacgatggcgacgatccagcaccaggcgaaaccggcggtggcggcggcgcatgcacgactactggcggtgggcagcgcgcgatggacctctacgagaagctggagaaggtcggagaggggacctacgggaaggtgtacagggcgcgggagaaggcgacggggcggatcgtggcgctgaagaagacgcggctccccgaggacgacgagggc

SEQ ID NO: 1639 - protein, 43 aa, Zea mays
  misc_feature: Ceres CLONE 244081-F
  misc_feature: SWISSPROT Homolog: EC 2.7.11.22 Cyclin-dependent kinase
  misc_feature: Functional homolog of the protein sequence given in SEQ ID NO 96861
  misc_feature: Useful for making plants with modulated growth rate
MDLYEKLEKVGEGTYGKVYRAREKATGRIVALKKTRLPEDDEG

SEQ ID NO: 1640 - DNA, 128 bp, Zea mays
  misc_feature: Ceres CLONE 244104-F
atcttgctctgaacgcattcctcccatctcccaagayctcctcagacccgagatagcgcmbgcggccatggacgccaccggcactggagctggagggaaggcgaagaagggagcggccggtcgcaagg

SEQ ID NO: 1641 - DNA, 401 bp, Zea mays
  misc_feature: Ceres CLONE 244134-F
  misc_feature: Encodes the peptide sequence at SEQ ID NO. 1642
  misc_feature (85)..(85): n is a, c, t, g, unknown, or other
  misc_feature (86)..(86): n is a, c, t, g, unknown, or other
aaacccaatccatccaaacccatttccctcgctcccatcccgtcccgccccttgtctcttccgcttccgcccgaccccgcgcgcnnvaaccagcagccatgtcgtgctcccacctctccaccgcctggtcctcctcggcgctcgcagcagcgcttccaccacccgtcggcgctcccccccgcgctcgggtctcctggtgcggtgttccctccgtgagctccgcacccgcatcgactccgtcagaacacgcagaagatcacggaggccatgaagctggtggccgccgcaaggtccggcgcgcgcaggaggccgtcgtctcctctcgccctttctcggaggcgctggtggaggtgctctacaacatgaaccaggagatccagacggaggacatcgacctgccc

SEQ ID NO: 1642 - protein, 101 aa, Zea mays
  misc_feature: Ceres CLONE 244134-F
  misc_feature: SWISSPROT Homolog: EC 3.6.3.14 H(+)-transporting two-sector ATPase
MSCSHLSTAWSSSALAAALPPPVGAPPRARVSWCGVPSVSSAPASTPSEHAEDHGGHEAGGRRKVRRAQEAVVSSRPFSEALVEVLYNMNQEIQTEDIDLP

SEQ ID NO: 1643 - DNA, 408 bp, Zea mays
  misc_feature: Ceres CLONE 244139-F
  misc_feature: Encodes the peptide sequence at SEQ ID NO. 1644
  misc_feature (87)..(87): n is a, c, t, g, unknown, or other
  misc_feature (107)..(107): n is a, c, t, g, unknown, or other
  misc_feature (108)..(108): n is a, c, t, g, unknown, or other
  misc_feature (154)..(154): n is a, c, t, g, unknown, or other
  misc_feature (198)..(198): n is a, c, t, g, unknown, or other
acaactcacaattcacatcgaggtctcagcttcaggaaagggaaggaagcatgttcgggcaccaccaccaccacggccacggcgggnaccaccaggccccgccgccnnrcgagcagacgctgttcaggatcttctgccgcgccgacgaggstanctgcctcaccgtgcgccacgacgccgtstcctcgcgcccaccancccccgcgacgwdtaccagcactggtacaaggacatgaggcacagcacgaaggtgaaggacgcggagggccagccggcgttcgcgctcatcaacagggccaccggctmgccatcaagcactcgctcggccagtcccatcccgtgaagctggtgccctacaacgcggagtacctggacgagtcggtgctgtggacggagagccacgacgtg

SEQ ID NO: 1644 - protein, 136 aa, Zea mays
  misc_feature: Ceres CLONE 244139-F
  misc_feature (36)..(36): Xaa is any aa, unknown, or other
  misc_feature (37)..(37): Xaa is any aa, unknown, or other
  misc_feature (51)..(51): Xaa is any aa, unknown, or other
  misc_feature (52)..(52): Xaa is any aa, unknown, or other
  misc_feature (61)..(61): Xaa is any aa, unknown, or other
  misc_feature (66)..(66): Xaa is any aa, unknown, or other
  misc_feature (71)..(71): Xaa is any aa, unknown, or other
TTHNSHRGLSFRKGKEACSGTTTTTATAGTTRPRRXXSRRCSGSSAAPTRXXASPCATTPXPRAHXPPRRXPALVQGHEAQHEGEGRGGPAGVRAHQQGHRLAIKHSLGQSHPVKLVPYNAEYLDESVLWTESHDV

SEQ ID NO: 1645 - DNA, 197 bp, Zea mays
  misc_feature: Ceres CLONE 244147-F
  misc_feature: Encodes the peptide sequence at SEQ ID NO. 1646
acacagctcccacgctcaccgacgccacagcttgtgcgcacgcaatggcactcgtgtccgcctcctcgtcctccaccaccgccgtcgcgskyttccccaggaatgggcagcagcgggcgtcgtcgtcgttgttctcctcctcctcctcttcctccttcctcgtcggcaagacgctgctgaggcaggccgaggcagcc

SEQ ID NO: 1646 - protein, 51 aa, Zea mays
  misc_feature: Ceres CLONE 244147-F
  misc_feature (16)..(16): Xaa is any aa, unknown, or other
MALVSASSSSTTAVAXFPRNGQQRASSSLFSSSSSSSFLVGKTLLRQAEAA

SEQ ID NO: 1647 - DNA, 115 bp, Zea mays
  misc_feature: Ceres CLONE 244181-F
atcgcctccacgaacaaaccacacaccccacctaccccggccggaccgcagcagcacaacatggacctcgccctcctggagaaggccctgctgggcttttcgccgcggctgtggt

SEQ ID NO: 1648 - DNA, 149 bp, Zea mays
  misc_feature: Ceres CLONE 244234-F
  misc_feature (28)..(28): n is a, c, t, g, unknown, or other
  misc_feature (66)..(66): n is a, c, t, g, unknown, or other
  misc_feature (67)..(67): n is a, c, t, g, unknown, or other
aacagcgaacacatctgcttcgcatttnttcccatcccccttcgcaacccaaaccccaactcgctnngcatcgatggcgcccaaggccgagaagaagcccgcggcgaagaagccggcggaggaggagcccgcggctgagaaggcgcccg

SEQ ID NO: 1649 - DNA, 475 bp, Zea mays
  misc_feature: Ceres CLONE 244235-F
  misc_feature: Translation starting site: 291
  misc_feature (28)..(28): n is a, c, t, g, unknown, or other
aattttyatttaccacaccctgctctcnctcttgttgtgacggtcgattcgcttgtacaaggtagcaaccttgagatccagccaagatccagccatgagggagattctccacatccagggtggacagtgcggcaaccagatcggttccaagttctgggaggtcgtctgctgacgagcatggtatcgaccccaccggacgctatgtcggcacctccgacctccagctcgagcgcgtcaatgtctactacaacgaggcctcatgcggccgcttcgtgccgcgcgctgtgctcatggacctcgagcccggcaccatggacagcgtcgcaccgggccgtacggacagatcttccggcccgacaacttcgtcttcggccagtctggtgcagggaacaactgggccaagggcactacacagagggcgctgagctcatcgactctgtgcttgacgtcgtgaggaaagaggcggagaactgcg

SEQ ID NO: 1650 - DNA, 430 bp, Zea mays
  misc_feature: Ceres CLONE 244289-F2
  misc_feature: Pfam Name: UFD1 Pfam Description: Ubiquitin fusion degradation protein UFD1
  misc_feature (131)..(131): n is a, c, t, g, unknown, or other
  misc_feature (187)..(187): n is a, c, t, g, unknown, or other
  misc_feature (231)..(231): n is a, c, t, g, unknown, or other
cgcaacctcctccgggaagcgcgatcgccgtctcgaaggagctgaaatccaagattccaagctcttctgtyagttgagggaagttgaagcaaaagtytaagcaaaaatgttttacgggggatatgcttacnatggcaactcgtttgagcaaacataccgttgttatycagcatcgttttttgataanhtacacctggaagyggtgataaagtaataatgchaccttctgcncttgatcgthttgcttccttgcacatcgagtaccctatgctatttgagctgcacaatgatgcaayyagcggattgtyacactgtggtgttttggagtttgttgcagaagaaggcatgatcatcatgcykctattggatgatgcaaaacatgctgcttcaagagggtgacactgtcmatgtaaaawatgcgactcttccc

SEQ ID NO: 1651 - DNA, 430 bp, Zea mays; identical to SEQ ID NO: 1650
  misc_feature: Ceres CLONE 244289-F
  misc_feature: Encodes the peptide sequence at SEQ ID NO. 1652
  misc_feature (131)..(131): n is a, c, t, g, unknown, or other
  misc_feature (187)..(187): n is a, c, t, g, unknown, or other
  misc_feature (231)..(231): n is a, c, t, g, unknown, or other

SEQ ID NO: 1652 - protein, 32 aa, Zea mays
  misc_feature: Ceres CLONE 244289-F
  misc_feature (24)..(24): Xaa is any aa, unknown, or other
ATSSGKRDRRLEGAEIQDSKLFCXLREVEAKV

SEQ ID NO: 1653 - DNA, 141 bp, Zea mays
  misc_feature: Ceres CLONE 244305-F
  misc_feature: SWISSPROT Homolog: EC 4.1.2.13 Fructose-bisphosphate aldolase
  misc_feature (36)..(36): n is a, c, t, g, unknown, or other
  misc_feature (66)..(66): n is a, c, t, g, unknown, or other
gccttaaccattcctcccaacaccacctcgcctgcnatcttcgtagcctccgtcgcgtcgagcatnatcatgtcggcctactgcggaaagtacaaggatgagctcatcaagaatgctgcctacattggcacccctggcaag

SEQ ID NO: 1654 - DNA, 424 bp, Zea mays
  misc_feature: Ceres CLONE 244348-F
  misc_feature: Pfam Name: TFIIS Pfam Description: Transcription elongation factor S-II protein N terminal
  misc_feature (99)..(99): n is a, c, t, g, unknown, or other
  misc_feature (241)..(241): n is a, c, t, g, unknown, or other
  misc_feature (269)..(269): n is a, c, t, g, unknown, or other
gtacttgtagcctcttgctgtgcacctcggcggcggcggcaggaagcgtctttgctggtggtacgtgcgggttcttgttgtgtacctcagcagcagcgngaagcatcttcttctcgtcgacggcagcgcgcgggassgatcttattagcacagagactgtcgagcttcttcttcaccgctacagcagtggtgcgggaggcttcgatggccaccctccacccgcgcacgacgtcgcgccgangctccggatccggaacgacccgtggttnccgagggcgccgacggtccttgccaggtctgtggacgctagcaggtcgtgcgggasggcgcgaccagcagcgtcttgagggattcgaccatgacgtcgtcgaacgcggcacagagctgctcgggccacgctgtcatccgtgggcgccgcggaaag

SEQ ID NO: 1655 - DNA, 404 bp, Zea mays
  misc_feature: Ceres CLONE 244384-F
  misc_feature (162)..(162): n is a, c, t, g, unknown, or other
ctgaagtccggcggcggcggcasggcgaggcgaggcctctgcgacttccagatctccccgacgaggaggaagtctctacagcggaggggagggagatgtcgtacatgcggggtgacctgctgacgaggatgcggaastggtgaagggcctcgccaggccgangccccggtggctcaaggccttggaacgggctccgcagtgacatttcctcgcccagaggggaagatcaagactctggtgcttcctgaggatgtgtatgtcacgaattcaacagaatacatccagattcgctttaccatgatgcaatcaagataagtggatttggatccaccgccagctcgagtgtttgcttggcgtgtcctggagttgaaagagcaagggagtcgatgaagatgttgcaaatg

SEQ ID NO: 1656 - DNA, 378 bp, Zea mays
  misc_feature: Ceres CLONE 244392-F
  misc_feature: Translation starting site: 198
  misc_feature: Pfam Name: Oleosin Pfam Description: Oleosin
  misc_feature (34)..(34): n is a, c, t, g, unknown, or other
  misc_feature (162)..(162): n is a, c, t, g, unknown, or other
  misc_feature (336)..(336): n is a, c, t, g, unknown, or other
atcgcactcgtagtcgtagctcaagcatcagckncaggagctctgggcagcgtgcgcacgtggggtactagctcgctctgctagcctaccatggctgatcaccaccggggcgcgacgggaggtggcgggggctacggcgacctccagcgcgggggcggcatncacggcgaggcgcasagcagcagaagcagggcgccatgatgacggcgctcaaggccgcgacggcscgaaccttcggcgggtcgatgctggtgctgtccgggctgatcctggccggcaccgtgtatcgcgctcacggtggccacccccgtgctggtgatcttcagcccggtgctngtgccggccgccatcgcgctggcgctcatggcggccggtttc

SEQ ID NO: 1657 - DNA, 428 bp, Zea mays
  misc_feature: Ceres CLONE 244429-F
  misc_feature: Encodes the peptide sequence at SEQ ID NO. 1658
aaaagcaccccctctccccccgtcgccatggsagcgataaccgcgcgtcgtcctccccttcgccgccgccgtccttgtggtgctcctcgctggcggcscgcggcggacgatgcctccagcgacgacgacgctgggacttcacggacacccggctgctccaacaagttccagctgggtcaaggtgaagaattbggtgaatgggactraaggtacaacttttgttggcctaagtgcaaaatttgagctcccttgccaagagatattcatgaagcaaaaaagtcattttgctgtcctctcaaatccaattgactgttgctccaacttgacatcaaagttaacaagttcagttgctatagcaacacgtggggaatgtgctttcacggaaaaagcaaatattgctcaggccagtggttcgacsggtttactag

SEQ ID NO: 1658 - protein, 106 aa, Zea mays
  misc_feature: Ceres CLONE 244429-F
  misc_feature (28)..(28): Xaa is any aa, unknown, or other
  misc_feature (33)..(33): Xaa is any aa, unknown, or other
MPPATTTLGLHGHPAAPTSSSWVKVKNXVNGTXGTTFVGLSAKFELPCQEIFMKQKSHFAVLSNPIDCCSNLTSKLTSSVAIATRGECAFTEKANIAQASGSTGLL

SEQ ID NO: 1659 - DNA, 180 bp, Zea mays
  misc_feature: Ceres CLONE 244447-F
  misc_feature (37)..(37): n is a, c, t, g, unknown, or other
  misc_feature (83)..(83): n is a, c, t, g, unknown, or other
  misc_feature (144)..(144): n is a, c, t, g, unknown, or other
  misc_feature (165)..(165): n is a, c, t, g, unknown, or other
aagacacacacgcgcgcgaacacgaacagggacacgnkacagcggcggccatggcgagaggcggcggcgatcggagtcgggdngatgaccccttctccgacggcggcaccaccggaaccgactcggacgagtcctctccgcgtngggtgggggcccgcggcgggnattccacctccaacc

SEQ ID NO: 1660 - DNA, 163 bp, Zea mays
  misc_feature: Ceres CLONE 244491-F
  misc_feature: Encodes the peptide sequence at SEQ ID NO. 1661
atccaattcacaggctcaccacaccaaccaacaagcaaaaattccccaatcctctcgtctccgcggcgaagatgtcggggcgcggcaagggcggcaagggcctgggcaagggcggcgcgarstcaccggaaggtcttgcgcgacaacatccaggggatcacga

SEQ ID NO: 1661 - protein, 30 aa, Zea mays
  misc_feature: Ceres CLONE 244491-F
  misc_feature (17)..(17): Xaa is any aa, unknown, or other
MSGRGKGGKGLGKGGAXSPEGLARQHPGDH

SEQ ID NO: 1662 - DNA, 182 bp, Zea mays
  misc_feature: Ceres CLONE 244514-F
  misc_feature (59)..(59): n is a, c, t, g, unknown, or other
  misc_feature (60)..(60): n is a, c, t, g, unknown, or other
attctcagaacacgcgctcactcccgagtcccgatcgcaaccgccccccacattccccnnagttagcccgatcagatcgtttttccctcgaggtgagagtaagatgagggagatcctgcatatccagagggcagtgcgggaaccagatcggctccaagttctgggaggtggtgtgcgatgag

SEQ ID NO: 1663 - DNA, 417 bp, Zea mays
  misc_feature: Ceres CLONE 244523-F
  misc_feature: Translation starting site: 64
  misc_feature (49)..(49): n is a, c, t, g, unknown, or other
  misc_feature (50)..(50): n is a, c, t, g, unknown, or other
agttctgatctgcttctccagtctccacacaacacaacagagcagaagnnagcacgggcgctgatgtcgatgggggaggcgctgcgggckgctgcgctgacgcgtggtgacattcctgtgggtgctgtgcgtctccacgctgggggcctcgacgacggcggtgacgtcctacctgaggctgcagggcgtccacttcgcgctcctggtcaccgtctccctcctctccgtcctcctcttcgtcttcaatatcctttgcgacgcactcggcggcstacttcaaccccaccggcgtcgcsccttctacgccgccggagtcaccagcccctctctctttcctccatcgcgctccgattaccggcacaggctgccggcgctgtgggcggtgctcttgccatctcggagctgattgccggcgca

SEQ ID NO: 1664 - DNA, 434 bp, Zea mays
  misc_feature: Ceres CLONE 244556-F
  misc_feature: Encodes the peptide sequence at SEQ ID NO. 1665
  misc_feature (396)..(396): n is a, c, t, g, unknown, or other
gcttcgaagtgttcgtgcgaaggcgammctccctccttcactccttccccgccgcctcccggccgtcgcsccatggtgaagtactcgcaggagccgggcaaccctaccaagtcggctaaggccatgggcagggatctgagggtccacttcaagaacacaagggagacagcctttgctcttcgcaagttgtctttgaccaagsctaagcgataccttgaggatgttattgctcacaagcaggcaattcccttccggagatactgtggcggtgttggtcgcaccggcaastaagtctcgccactccaatgggcagggccgctgcgctgcttaahtcagccgggttcatcctggattttgctgaagaatgctgagagtaacgctgatgtgaaaggcttngatgtggacaacctctatgtttcacacatccaggtgaa

SEQ ID NO: 1665 - protein, 71 aa, Zea mays
  misc_feature: Ceres CLONE 244556-F
  misc_feature (17)..(73): Pfam Name: Ribosomal_L22 Pfam Description: Ribosomal protein L22p/L17e
  misc_feature (44)..(44): Xaa is any aa, unknown, or other
MVKYSQEPGNPTKSAKAMGRDLRVHFKNTRETAFALRKLSLTKXKRYLEDVIAHKQAIPFRRYCGGVGRTG

SEQ ID NO: 1666 - DNA, 176 bp, Zea mays
  misc_feature: Ceres CLONE 244566-F
  misc_feature: Encodes the peptide sequence at SEQ ID NO. 1667
aatccaattcacaggctcaccacaccaaccaacaagcaaaaattccccaatcctctcgtctccgcggcgaagatgtcggggcgcggcaagggcggcaagggcctgggcaagggcggcgcgamstcaccggaaggtcttgcgcgacaacatccaggggatcacgaagccggcgatcc

SEQ ID NO: 1667 - protein, 34 aa, Zea mays
  misc_feature: Ceres CLONE 244566-F
  misc_feature (17)..(17): Xaa is any aa, unknown, or other
MSGRGKGGKGLGKGGAXSPEGLARQHPGDHEAGD

SEQ ID NO: 1668 - DNA, 455 bp, Zea mays
  misc_feature: Ceres CLONE 244579-F
  misc_feature: Translation starting site: 93
aacaacagccctacaacttactgcttgctctagctagctagctgctcccggcccatatccactacacaagtaggctagcagcagcagcagcaatggcctcggtgacgagttcccggccgtggcctcgtcctgctgctcgccgccagcgccttcctggccagcgaggtggcggcgtgcggcggctgccgaaaccaactcctcctcctccatcgccaccaccgccgtcgcccaccagcacgccgtscctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgccgagcctggaggccgccgtctgcctctgcaccgcgctcaaggccaacgtgctcggcatcaactcgacgt

SEQ ID NO: 1669 - DNA, 329 bp, Zea mays
  misc_feature: Ceres CLONE 244596-F
  misc_feature: Encodes the peptide sequence at SEQ ID NO. 1670
aggttccgccgcatcgtgtcgtttcttccctttcccgtttcccccgttcagttcagcttcggttggctcgccgtactcgggtttgttcctcgcctcgcttccttcctccgcagtcctcgtctcgaattcgctcgcggtgggagaaatcggggcgcgaggatgaccgtgatcgacatcctcacccgggtggacgcgatctgccagaagtacgacaggtacgacgtcgacaagctcaacggcgcgaacgtcgccggcgasacccgttcgcccgcctctacgcgtccgtcgacsgaacatcaaccaatgcgtcgataaagcggaaacggcga

SEQ ID NO: 1670 - protein, 51 aa, Zea mays
  misc_feature: Ceres CLONE 244596-F
  misc_feature (33)..(33): Xaa is any aa, unknown, or other
MTVIDILTRVDAICQKYDRYDVDKLNGANVAGXTRSPASTRPSTEHQPMRR

SEQ ID NO: 1671 - DNA, 415 bp, Zea mays
  misc_feature: Ceres CLONE 244617-F
  misc_feature: Translation starting site: 112
  misc_feature: Pfam Name: UCR_TM Pfam Description: Ubiquinol cytochrome reductase transmembrane region
  misc_feature: SWISSPROT Homolog: EC 1.10.2.2 Ubiquinol--cytochrome-c reductase
atcctgaggctccgaatcgatctcccttccccaccaaaccggagcacttcggaggccggacacggagaagcgaccgaccgcagccagctcacgtcgccctcttcatccaccatgctgagggtcgcgggcaggcgcctctcgtccgctctcgcctggcgcmcccgcgccgccgcctcaggcacccggggccctctcgccggtacactacccggccgcgacgacgacgacacacgcgaccgcaggcacttttcgccatcgaatctcccttcttcgccgctgccagagggttttcagcagagactcttgctccaagaaaccaggatgtgggcttatctgagctcccagcaactgtggcagctgtgaagaatccaagtggaaaaatcgtgtatgatgagtataaccatgagcgctaccc

SEQ ID NO: 1672 - DNA, 194 bp, Zea mays
  misc_feature: Ceres CLONE 244670-F
  misc_feature (116)..(116): n is a, c, t, g, unknown, or other
aagcgtggtagttgccactgccgtcccctccagaagtgcgatacagttcggattcagatcgcggccggtgcgaacccacgaaggcacgaacggtagaacccgaccgagcgcggcanaaaacctccgatccctgctgcgagcaagggatggcggcggcatgggcagtkctggcggcggtcctcgtcgcggcgcag

SEQ ID NO: 1673 - DNA, 125 bp, Zea mays
  misc_feature: Ceres CLONE 244719-F
attctcgtcatctcgtggctttgaaataccccgcggccgsccccgcccaaatccaaccgccctaccaacgaccatctgctctgctctcgccgctcctacccttcccaaatcccctcctcgcaaca

SEQ ID NO: 1674 - DNA, 315 bp, Zea mays
  misc_feature: Ceres CLONE 244740-F
  misc_feature: Encodes the peptide sequence at SEQ ID NO. 1675
  misc_feature (92)..(92): n is a, c, t, g, unknown, or other
  misc_feature (139)..(139): n is a, c, t, g, unknown, or other
  misc_feature (140)..(140): n is a, c, t, g, unknown, or other
  misc_feature (142)..(142): n is a, c, t, g, unknown, or other
attactgtgcctttatcttcaacccaaaccatccattaccatattcctaagctatcatggtgcaccggacttccatagccgatgtgcatgtnatgtgcatggatctaagcccaaagawasccaacaaggccagcgccanncnggcggastactacgactggtcccccgccgatctgcccatgctcggcgytgctccattggtgccgccaagctctggcctcaccgccggagtcttgccctacccagctactccgactctgccaagatcgcctacggtcctccaaggcaaaggtatattcggcgtggttctcccgg

SEQ ID NO: 1675 - protein, 86 aa, Zea mays
  misc_feature: Ceres CLONE 244740-F
  misc_feature (21)..(21): Xaa is any aa, unknown, or other
  misc_feature (22)..(22): Xaa is any aa, unknown, or other
  misc_feature (28)..(28): Xaa is any aa, unknown, or other
  misc_feature (29)..(29): Xaa is any aa, unknown, or other
  misc_feature (31)..(31): Xaa is any aa, unknown, or other
  misc_feature (45)..(45): Xaa is any aa, unknown, or other
MVHRTSIADVHVMCMDLSPKXXNKASAXXAXYYDWSPADLPMLGXAPLVPPSSGLTAGVLPYPATPTLPRSPTVLQGKGIFGVVLP

SEQ ID NO: 1676 - DNA, 175 bp, Zea mays
  misc_feature: Ceres CLONE 244755-F
acacacgaacctagatcgacctgctcgctctgcacacctggaacaacgtgttcctcgtcccgagaagagtcgaggaaaaatctcgcattcgcaaaccaagcaaatggaggcatgagctccgccgcctccccgtctctcgccgatctcccccaaaccctagcctcgacctgaccgc

SEQ ID NO: 1677 - DNA, 133 bp, Zea mays
  misc_feature: Ceres CLONE 244809-F
  misc_feature (69)..(69): n is a, c, t, g, unknown, or other
acacgcacaccgcgacccagtccagagccagtacgtgcgamggccacgcacgctgctggtccgcgtacnagacgacggtcaggtcggccggtgcttttcagtttggaataatgacggcgacgacgacgacagc

SEQ ID NO: 1678 - DNA, 485 bp, Zea mays
  misc_feature: Ceres CLONE 244815-F
  misc_feature: Encodes the peptide sequence at SEQ ID NO. 1679
aatcccctccccacatcgggaaccgccgccgacgccgcagaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagtbgaacgtcttgcctgcacttcagtaggccacttttcatggttctagttgtatttgaatccagcgtttgccactaagataaatcagacagtcgttttgtgaacctattatgatggagctttatttgctgataatatctagctacctatttgagctgagtgatccctgcacttcattatggttggcaactatgtttcttaaccatatcaatatc

SEQ ID NO: 1679 - protein, 105 aa, Zea mays
  misc_feature: Ceres CLONE 244815-F
IPSPHREPPPTPQRRRIEVSTRRSDHEGQVEEEAHEEAQEEAQKDEAEIQVGRSRWIVDLMTCVGTYISSDALVCLWRDVNLPWCHGPPSVERLACTSVGHFSWF

SEQ ID NO: 1680 - DNA, 130 bp, Zea mays
  misc_feature: Ceres CLONE 244816-F
  misc_feature (66)..(66): n is a, c, t, g, unknown, or other
acgcacaccgcgacccagtccagagccagtacgtgcgamggcacgcacgctgctggtccgcgtacnagacgacggtcaggtcggccggtgcttttyagtttggaataatgacggcgacgacgacgacagc

SEQ ID NO: 1681 - DNA, 495 bp, Zea mays
  misc_feature: Ceres CLONE 244829-F
  misc_feature: Encodes the peptide sequence at SEQ ID NO. 1682
  misc_feature (94)..(94): n is a, c, t, g, unknown, or other
  misc_feature (110)..(110): n is a, c, t, g, unknown, or other
  misc_feature (438)..(438): n is a, c, t, g, unknown, or other
ctttttttcctcgagtttcctattttcctctcctcccccacagcagcccggcgaaaaccctagtaagcaaaccaccggagcagcggcgcttgcngagcggascatggcgnacgacgattacaacgaaattgacatggggtatgaggatgagcccccagaaccggagattgaggaaggagctgaagaagagcctgagaacaatgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggagaaactgaccctcttgagattgcaatgaagtgagctgagagcgcgcaagttacccttcacgntcagacgttacttacctgtwtggaagctatgaagactggggagtagacgagctcatt

SEQ ID NO: 1682 - protein, 101 aa, Zea mays
  misc_feature: Ceres CLONE 244829-F
  misc_feature (61)..(102): Pfam Name: RNA_pol_Rpb6 Pfam Description: RNA polymerase Rpb6
  misc_feature: SWISSPROT Homolog: EC 2.7.7.6 DNA-directed RNA polymerase
  misc_feature (3)..(3): Xaa is any aa, unknown, or other
MAXDDYNEIDMGYEDEPPEPEIEEGAEEEPENNEDAPDDVIGGEGEDKEQEKTKRERKTTKYMTKYERARILGTRALQISMNAPVMVELEGETDPLEIAMK

SEQ ID NO: 1683 - DNA, 440 bp, Zea mays
  misc_feature: Ceres CLONE 244877-F
  misc_feature: Translation starting site: 140
  misc_feature: Pfam Name: Ribonuc_red_sm Pfam Description: Ribonucleotide reductase, small chain
  misc_feature: SWISSPROT Homolog: EC 1.17.4.1 Ribonucleoside-diphosphate reductase
  misc_feature (46)..(46): n is a, c, t, g, unknown, or other
  misc_feature (234)..(234): n is a, c, t, g, unknown, or other
  misc_feature (295)..(295): n is a, c, t, g, unknown, or other
  misc_feature (378)..(378): n is a, c, t, g, unknown, or other
  misc_feature (399)..(399): n is a, c, t, g, unknown, or other
acacaatttcaccgaaatcctccaataccccaccctacgaatcttncaacccctccgacgatgccttccgcgccggcgctcgtycccgcgtgckacatgcaggagccgttgctggcggagtcgtccgaccgcttcttccatgttcccgatccggtacccgcagattttgkagttctacaagawggcggtggcgtccttytggactgcygaggaggtggacctctccgcggackncgctcactkgkacgcggccctctcccccgacgagcgccacttcatctcccacgtgctcgcnttcttcgccgcctcckacggcatcgtgctcgataacctcgcctcccgcttcatgtccgatgtccaggccgccgaggcgcgcgnttttacggcttccaaatcgcnatcgagaacatccactcggagatgtactcgctgctgctcga

SEQ ID NO: 1684 - DNA, 197 bp, Zea mays
  misc_feature: Ceres CLONE 244928-F
atcgaaaacccaccgcaccctttcatcagcctgcctgtccactgttggcttggtgacttcctccgctccgtccgctcccctccgctcccgaacggtcgatctttgcatggcagcagcagctggctccaaggggcgggcgatcgctsgaasttcgtcagacgcgtcctcgccggaaaggcgcctcgccgaggagggcc

SEQ ID NO: 1685 - DNA, 193 bp, Zea mays
  misc_feature: Ceres CLONE 244949-F
  misc_feature: Encodes the peptide sequence at SEQ ID NO. 1686
  misc_feature (90)..(90): n is a, c, t, g, unknown, or other
acccacctccgccagcyactccaaacacttgcgccgccgctgcctcacaggtaaggccgccatggtctccggttcgggcgtgtgcgcgantcgttgggtcgacgcgcgccaccacatgctgggccgtctctcctcgatcatagccaaggagctgctcaatgggcagaagktggtcgtcgtccgctgcgaggag

SEQ ID NO: 1686 - protein, 44 aa, Zea mays
  misc_feature: Ceres CLONE 244949-F
  misc_feature (10)..(10): Xaa is any aa, unknown, or other
  misc_feature (37)..(37): Xaa is any aa, unknown, or other
MVSGSGVCAXRWVDARHHMLGRLSSIIAKELLNGQKXVVVRCEE

SEQ ID NO: 1687 - DNA, 260 bp, Zea mays
  misc_feature: Ceres CLONE 244959-F
  misc_feature: Encodes the peptide sequence at SEQ ID NO. 1688
  misc_feature (92)..(92): n is a, c, t, g, unknown, or other
  misc_feature (161)..(161): n is a, c, t, g, unknown, or other
  misc_feature (163)..(163): n is a, c, t, g, unknown, or other
agatcagaaccaaactcggctcgagagagatcgcatacgcctgcctgcccacccacctccccttttccttcctcttcgccccagcgacgcgnccgcccggagaccgagcgaggcaggcaactaaccaccgagaggcagggacaggaacaggaagccggavnangatgtcgtcggtgttcagcggcgatgagacggcccccttcttcggcttcctcggcgccgcgccgccctcgttcttctcatgcatgggcgccgcgtac

SEQ ID NO: 1688 - protein, 32 aa, Zea mays
  misc_feature: Ceres CLONE 244959-F
  misc_feature: SWISSPROT Homolog: EC 3.6.3.14 H(+)-transporting two-sector ATPase
MSSVFSGDETAPFFGFLGAAPPSFFSCMGAAY

SEQ ID NO: 1689 - DNA, 350 bp, Zea mays
  misc_feature: Ceres CLONE 244976-F
  misc_feature: Translation starting site: 82
  misc_feature (76)..(76): n is a, c, t, g, unknown, or other
  misc_feature (191)..(191): n is a, c, t, g, unknown, or other
aacacacaacaacaaccatctccaacgcagcaagcagacagaaggacaggcaggcagcgagtgcaaccgsgagganattcgatgggctccttcttctcgaccttagtgacgccccctccggccgccgacgacccgaactgggccgtggtggccgcgcactccaaggccacctacgacgagcagtgggcggnccacaagagcagcagcaagctgatggtgatcgacttctcggcgtcctggtgcgggccctgcgcttcatcgagccggccttcaaggagctggcctccgcttcaccgatgccatcttcgtcaaggttgacgtcgacgagctcgcggaggtcgcaaggacat

SEQ ID NO: 1690 - DNA, 215 bp, Zea mays
  misc_feature: Ceres CLONE 244996-F
  misc_feature: Encodes the peptide sequence at SEQ ID NO. 1691
  misc_feature (140)..(140): n is a, c, t, g, unknown, or other
actcatacatttcgactctcaactcccaaggtccctttttttttttctcgatctggaagcgccgcagtagcagccatggacgtgagcggasaggcggtaaggcgaagaagggcgcggcggggcgcaaggccggcgggcrncgaagaagtcggtgtcgcggtccatccagggccgggctgmagttccccgtcagccgcgtcgggcggtacctcaaa

SEQ ID NO: 1691 - protein, 71 aa, Zea mays
  misc_feature: Ceres CLONE 244996-F
  misc_feature (30)..(30): Xaa is any aa, unknown, or other
  misc_feature (46)..(46): Xaa is any aa, unknown, or other
  misc_feature (60)..(60): Xaa is any aa, unknown, or other
SYISTLNSQGPFFFFSIWKRRSSSHGRERXGGKAKKGAAGRKAGGXRRSRCRGPSRAGLXFPVSRVGRYLK

SEQ ID NO: 1692 - DNA, 475 bp, Zea mays
  misc_feature: Ceres CLONE 245029-F
  misc_feature: Translation starting site: 62
  misc_feature (374)..(374): n is a, c, t, g, unknown, or other
acaaacctctcctggcacgagatcacgcttctcgtcggatcgaacagctagggtttccaagatgttcgggcgcgcgcgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttngaggtggtggcagcagtaggggcagaaggcagcgaaggggagasgatgtggttcatcctctgaaggtttctctggaggatttgtacaatggcacatcgaag

SEQ ID NO: 1693 - DNA, 433 bp, Zea mays
  misc_feature: Ceres CLONE 245100-F
  misc_feature: Encodes the peptide sequence at SEQ ID NO. 1694
aactcaggcagacactcgccgccgccacgacgtcactagtagagccgtagagggcaagaggcgacggaatgacggagcggcaggtggcggactgggtcccgggacgcgtgctgcggctggaaccactgtggccgccgcctcgccgctggsccgtcgatggctccgtctccgtctatgactcccagccgccaccctcgttcaagtggcaggcccatgagcaagccattgtgaahgtcgtctggcttcctccagagtatggggatgctatagcttgtgtttgtgctgattgggacactgtctttgtgggaggaggttgctgctgatgatcaacttccaacctggagaaattgtaaaatcttcgaggatggcaactctcatattactaaatgtacatttttgggattacatctggggaattctgaaaatggttact

SEQ ID NO: 1694 - protein, 84 aa, Zea mays
  misc_feature: Ceres CLONE 245100-F
  misc_feature (28)..(28): Xaa is any aa, unknown, or other
  misc_feature (55)..(55): Xaa is any aa, unknown, or other
MTERQVADWVPGRVLRLEPLWPPPRRWXVDGSVSVYDSQPPPSFKWQAHEQAIVXVVWLPPEYGDAIACVCADWDTVFVGGGCC

SEQ ID NO: 1695 - DNA, 266 bp, Zea mays
  misc_feature: Ceres CLONE 245104-F
  misc_feature: Encodes the peptide sequence at SEQ ID NO. 1696
  misc_feature (167)..(167): n is a, c, t, g, unknown, or other
gattttyagatcagaaccaaactcggctcgagagagatcgcatacgcctgcctgcccacccacctccccttttccttcctcttcgccccagcgacgcgccgcccggagaccgagcgaggcaggcaactaaccaccgagaggcagggacaggaacaggaagccggavnaggatgtcgtcggtgttcagcggcgatgagacggcccccttcttcggcttcctcggcgccgccgccgccctcgtcttctcatgcatgggcgccgcgtac

SEQ ID NO: 1696 - protein, 32 aa, Zea mays; identical to SEQ ID NO: 1601
  misc_feature: Ceres CLONE 245104-F
  misc_feature: SWISSPROT Homolog: EC 3.6.3.14 H(+)-transporting two-sector ATPase

SEQ ID NO: 1697 - DNA, 353 bp, Zea mays
  misc_feature: Ceres CLONE 245116-F
catttctggacactctcatttcatttaccacaccctgctctcghtcttgttgtgacggtcgattcgcttgtacaagctagcaaccttgagatccagccaagatccagccatgamgggagattctccacatccagggtggacagtgcggcaaccagatcggttccaagttctgggaggtcgtctgcgacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtcgcaccgggccgtacg

SEQ ID NO: 1698 - DNA, 198 bp, Zea mays
  misc_feature: Ceres CLONE 245149-F
  misc_feature: Encodes the peptide sequence at SEQ ID NO. 1699
  misc_feature (139)..(139): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcgcaaggccggcgggcgancgaagaagtcggtgtcgcggtcctccagggccgggctgcagttccccgtcagccgcgtc

SEQ ID NO: 1699 - protein, 66 aa, Zea mays
  misc_feature: Ceres CLONE 245149-F
  misc_feature (47)..(47): Xaa is any aa, unknown, or other
THTFRLSTPKVPFFFSIWKRRSSSHGRERTGGKAKKGAAGRKAGGRXKKSVSRSSRAGLQFPVSRV

SEQ ID NO: 1700 - DNA, 221 bp, Zea mays
  misc_feature: Ceres CLONE 245160-F
  misc_feature: Encodes the peptide sequence at SEQ ID NO. 1701
  misc_feature (68)..(68): n is a, c, t, g, unknown, or other
acccgagaatactcgcgctcgscactcgacattcctcgccccccacgccggttcaccctgcgcgcacnttcaggcatctcgcaatcccccgggcggaggcgtatktcctgcgccgtggcgatgccgatcgacttgctccacgctccagctccgtgggaggaggaggtgaaggcggttgaggaggacgaggaggaggtggagggagtaggatgcggcggagg

SEQ ID NO: 1701 - protein, 33 aa, Zea mays
  misc_feature: Ceres CLONE 245160-F
MPIDLLHAPAPWEEEVKAVEEDEEEVEGVGCGG

SEQ ID NO: 1702 - DNA, 562 bp, Zea mays
  misc_feature: Ceres CLONE 245180-R
  misc_feature: Pfam Name: EMP24_GP25L Pfam Description: emp24/gp25L/p24 family/GOLD
  misc_feature (95)..(95): n is a, c, t, g, unknown, or other
tcgaggtcgagatcatcaaaagcttttttttttttttttgtactacaagtttcttagaatttcaactggacaggctgaagcatattttctcaagnatgtccccccgtttgttacatgggattccaagctccgtaacagatcggcagttcacccaaaaataggttacacctgcgctgaggtctaccgtgaaccatgggccaactacagtctacaacaacttcttcctttcaaagaaggtcttcaggtgccacagctgcaaacctgccactgataagcagacgccgagggagaggaaccctagccaagccatccttgagttcgttcgcctgttcacgtcctgcttttcctcttccctttcacgcagataaagcatctcttcatgtatattttttatagtttcctctagcttcttcagctccaattccatcatatcgaccttgcccttcttggcgacgctgggatagtccttggcggagacgccgctcctccagtcgaactcgaacccgatggtgaccggcggcttgtggtcgggagcccagaagcaggccaggtagtcgccggc

SEQ ID NO: 1703 - DNA, 401 bp, Zea mays
  misc_feature: Ceres CLONE 245200-F
  misc_feature: Encodes the peptide sequence at SEQ ID NO. 1704
  misc_feature (173)..(173): n is a, c, t, g, unknown, or other
  misc_feature (301)..(301): n is a, c, t, g, unknown, or other
atccactgcggcacgtcccgcctctggtttgcttgcctcccagatcttgccaactaattggaggcagccgagctgatctcccatcccgcaacgsccgtctcgacgggatcgttttcttctgcttctactgcgtgatctttgggcaagaagataagacacgtccaagcgtcgcnacagtcaagggcggcttggttgcagtcaagatggggaaggacagagaatctgccaagctgaaggaggagaaggggtccaaggatgagatccatatgaaggtcaagagcaagggcgagccgtccggcrnggtaagacggcaaggaggaggtcgaggtagagattgaggccaagtttgttgagaaggaagaggtcacaggctcgggtgacggttgcgggaggaaagggta

SEQ ID NO: 1704 - protein, 44 aa, Zea mays
  misc_feature: Ceres CLONE 245200-F
  misc_feature (33)..(33): Xaa is any aa, unknown, or other
MGKDRESAKLKEEKGSKDEIHMKVKSKGEPSGXVRRQGGGRGRD

SEQ ID NO: 1705 - DNA, 212 bp, Zea mays
  misc_feature: Ceres CLONE 245252-F
  misc_feature: Pfam Name: DUF791 Pfam Description: Protein of unknown function (DUF791)
aaaatcccaccacccttttccccttccaaccctcgggatctctccggcccgccatggaagtgttctactacctcgtgttcggcgcgctcgcsccatcagtggsgccttggagctcgccaagtccggcaaggmcgcgtcgccacctccccggccttcawytcatttaagaacaactacatcctcgtttactccctcatgatgtctggggactg

SEQ ID NO: 1706 - DNA, 204 bp, Zea mays
  misc_feature: Ceres CLONE 245258-F
  misc_feature (69)..(69): n is a, c, t, g, unknown, or other
aragataggagagacgarcaagaaaagacgagatcatatataccgtacgttatagagtaggaaaatwgnaatacgaatkatgatcacgggacggcagcgaaaccctgcaagctgcaggtgtcgtcgtccttcctgctttgchcttgttttcgcatcatcggtgctcgtcggcatcgtggcmggcggagcttctacgaggagtgc

SEQ ID NO: 1707 - DNA, 287 bp, Zea mays
  misc_feature: Ceres CLONE 245259-F
  misc_feature: Translation starting site: 116
  misc_feature: Pfam Name: F-box Pfam Description: F-box domain
  misc_feature (208)..(208): n is a, c, t, g, unknown, or other
atgttcgcctttccaaaggaaaaacagagatagaatcctacctctctagcatggcgaccggcgacgaggcggagacgcggtgcgggcgtctgaggagttgcgggactggtccgacatgacgccagtgtgtcttgccgaagcgttctcgcgctggcgctggaggacctgtggcgcggcgccatgccgtgctgtcgctcctggcgggacngcgcgctcgsccgggactcttcgcggtgcttgacctcgagcccgggtttgctgagtccacacctggcgccgaggcggca

SEQ ID NO: 1708 - DNA, 840 bp, Zea mays
  misc_feature: Ceres CLONE 245333
  misc_feature: Encodes the peptide sequence at SEQ ID NO. 1709
aaagcaaacgcaccgggtcgagccaatccaccacccagccatgcctcccaagcgcaagtccccggcgacgattgcccctgcggcggggtccccgaggaagacgcggatcatggctgctgctgctgctgcagggaagcgggcaacggagcctgctccggcgaaggcagtgccggccaagaaggaagacgaggcggcggttgccgagttgaaagggaggaagagggtcaagaaggaagccgagccgaaagggaggaagaggggcaagaaggaagccgaggcggtggcaccagcggcagaggaggaggatggggttgatgtggcggctgtagggaagcgtgtcatcgtcgaggcctgcactcagtgcagacagtttaagatccgagctcagaaggtgaaggaggacctggaaagttatgtttcgggggtgtctgtgataatcaaccctcagaagccacgccgtggttgccttgagatacgtgaagaaggcggtgaagtgttcatatcactgctgaacatgccacgccccttcacaccaatgaagaagctcgacatggacaaggttatcaaggacatcgccaagaagatctcctaaaccatgttggctggctatggctcggcggcaccattttgtgattgaaatattcaatctaagatcgtaatcttcaaagggtacggtgtaccttaggtgtaggttccaatcagtggcgtttcctattgcattggccatgtgcccatgtctcgtactcgtacctatgcttgtcctgcattgctggggcatatcgttttctgttatatgatatatgccctgaaaattccttgaccaaaaaaaaaaaaaaaaaa

SEQ ID NO: 1709 - protein, 183 aa, Zea mays
  misc_feature: Ceres CLONE 245333
MPPKRKSPATIAPAAGSPRKTRIMAAAAAAGKRATEPAPAKAVPAKKEDEAAVAELKGRKRVKKEAEPKGRKRGKKEAEAVAPAAEEEDGVDVAAVGKRVIVEACTQCRQFKIRAQKVKEDLESYVSGVSVIINPQKPRRGCLEIREEGGEVFISLLNMPRPFTPMKKLDMDKVIKDIAKKIS

SEQ ID NO: 1710 - DNA, 276 bp, Zea mays
  misc_feature: Ceres CLONE 245351-F
  misc_feature: Encodes the peptide sequence at SEQ ID NO. 1711
  misc_feature (45)..(45): n is a, c, t, g, unknown, or other
actcgggtccatagttcaaaacgaaaccaagcaagctttcggtcnbggccccgccggcaaatagcccgggagaggtcgacagcggmggccgcccgcatgtcatgttcatcccaagcgctggcatgggccacctcatcccattcttccgcttcatcgcggctctcgatgggcagagcgtcgacatctctgtggtgactgtccttcctaccgtttctgccgccgaggaggactacttcaccagcctcttcgctgccctcccccgtgtccgcmgcgtcg

SEQ ID NO: 1711 - protein, 58 aa, Zea mays
  misc_feature: Ceres CLONE 245351-F
  misc_feature (57)..(57): Xaa is any aa, unknown, or other
MFIPSAGMGHLIPFFRFIAALDGQSVDISVVTVLPTVSAAEEDYFTSLFAALPRVRXV

SEQ ID NO: 1712 - DNA, 351 bp, Zea mays
  misc_feature: Ceres CLONE 245432-F
  misc_feature: Encodes the peptide sequence at SEQ ID NO. 1713
  misc_feature (24)..(24): n is a, c, t, g, unknown, or other
  misc_feature (57)..(57): n is a, c, t, g, unknown, or other
  misc_feature (58)..(58): n is a, c, t, g, unknown, or other
aatttacaatttacagctgtgcgnaggcgggasagggggcagcgagcacctagcagnncgcggccggcgactccaccgagacacctcagccggccgcgcggtcgstttgcytccggctggctcctcgcctcgatggtggggatgtaccagcaccaactccgcgacgaccccttcgacaccctaagcggcggccactgcggtgagcagccacgcgttgccggcgsggcgcctcctcctcctcaccctcggctgttcatgacccgctgtctgcagaggtacatggcggcggacagcgggcasgttcgaggcgcttgcvgagcggaaagaagcatgttgcgcggcgggggaagc

SEQ ID NO: 1713 - protein, 73 aa, Zea mays
  misc_feature: Ceres CLONE 245432-F
  misc_feature (31)..(31): Xaa is any aa, unknown, or other
  misc_feature (56)..(56): Xaa is any aa, unknown, or other
  misc_feature (62)..(62): Xaa is any aa, unknown, or other
MVGMYQHQLRDDPFDTLSGGHCGEQPRVAGXAPPPPHPRLFMTRCLQRYMAADSGXVRGACXAERSMLRGGGS

SEQ ID NO: 1714 - DNA, 384 bp, Zea mays
  misc_feature: Ceres CLONE 245449-F
  misc_feature: Encodes the peptide sequence at SEQ ID NO. 1715
  misc_feature (164)..(164): n is a, c, t, g, unknown, or other
  misc_feature (309)..(309): n is a, c, t, g, unknown, or other
acccctcacgcggaasawgtactggaaatcgggagggagaccggagacgagaccgccggagatggagccgagatctgcaatctacagatccggcgccttccttctcctcgccgccatccttgcggaggtcgtcatccctgcatccgccatcggagacaagtgcnccgcctgcaascgwatgctgcggastagagattggaatttcgagtgagaagccgagaaatcacttggacttgcgcaaccgcttaaattctaaaggccagagggaagggaaggtcattgattatagggtcagtgagcttcgggttntggaacttctggatggcctatgcgataagatgcaagattataccttaaagaagttggaatcaggcgaaaagggat

SEQ ID NO: 1715 - protein, 127 aa, Zea mays
  misc_feature: Ceres CLONE 245449-F
  misc_feature (5)..(5): Xaa is any aa, unknown, or other
  misc_feature (6)..(6): Xaa is any aa, unknown, or other
  misc_feature (58)..(58): Xaa is any aa, unknown, or other
  misc_feature (59)..(59): Xaa is any aa, unknown, or other
  misc_feature (63)..(63): Xaa is any aa, unknown, or other
  misc_feature (103)..(103): Xaa is any aa, unknown, or other
PSRGXXTGNREGDRRRDRRRWSRDLQSTDPAPSFSSPPSLRRSSSLHPPSETSAPPAXXCCGXEIGISSEKPRNHLDLRNRLNSKGQREGKVIDYRVSELRVXELLDGLCDKMQDYTLKKLESGEKG

SEQ ID NO: 1716 - DNA, 376 bp, Zea mays
  misc_feature: Ceres CLONE 245450-F
  misc_feature: Translation starting site: 73
  misc_feature: Pfam Name: ADH_N Pfam Description: Alcohol dehydrogenase GroES-like domain
  misc_feature: SWISSPROT Homolog: EC 1.1.1.1 Alcohol dehydrogenase
  misc_feature (137)..(137): n is a, c, t, g, unknown, or other
gtagtcctaggcactttcatctgtggcctctgcgttcgagatcgatctgagctggcaccgtcccacttcgccatggcggaggaccggagccccaagcccatccactgcaaagcggcggtgtgcagagccgccggcrngccactcaccatcgaggagatcgtacgtcgacccgccgaaagcgtacgagatccgcatccgggtcgtctgcacctcactctgccacaccgatatcaccttctggaaagctaaggtggcaccggtgtttccaagaatactagggcatgaggcgtacggggtagtggagagcgtgggggagcacgtggagggcttcgcggcgggggacacgtggtgccgacgttcctggggcagtgcgagc

SEQ ID NO: 1717 - DNA, 258 bp, Zea mays
  misc_feature: Ceres CLONE 245459-F
  misc_feature: Encodes the peptide sequence at SEQ ID NO. 1718
  misc_feature (97)..(97): n is a, c, t, g, unknown, or other
  misc_feature (151)..(151): n is a, c, t, g, unknown, or other
atcccaacccactcacagtctcacgctactatcgctatctagagctccggccgtcacagacacgagctagagctagagctgcagggaagaagaaganrgaggargaggagaagatgagggcgtccgcgctggtctgcttcgtggcggtgtnggcgtgcatagcraagcatcsgcatggvrgcaacttctaccaggacacggagatgacctgggggcaggggcgcggcaaggtggtggacggcgggcgcgggctggacc

SEQ ID NO: 1718 - protein, 48 aa, Zea mays
  misc_feature: Ceres CLONE 245459-F
  misc_feature (13)..(13): Xaa is any aa, unknown, or other
  misc_feature (20)..(20): Xaa is any aa, unknown, or other
  misc_feature (23)..(23): Xaa is any aa, unknown, or other
MRASALVCFVAVXACIAKHXHGXNFYQDTEMTWGQGRGKVVDGGRGLD

SEQ ID NO: 1719 - DNA, 277 bp, Zea mays
  misc_feature: Ceres CLONE 245474-F
  misc_feature (133)..(133): n is a, c, t, g, unknown, or other
  misc_feature (225)..(225): n is a, c, t, g, unknown, or other
atacatttcgactctcaactcccaaggtcccttttttttctcgatctggaagcgccgcagtagcagccatggacgtgagcggasaggcgggaaggcgaagaagggcgcggcckggckcwakgycggcgggcrncgaagaagtcggtgtcgcggtcctccagggccgggctrcagttccccgtcagccgcgtcgggcggtacctcaaaaagggccggtacgcgcangtaggcacgggtgcccccgtytacctcgccgccgtcctggagtacctcgcgg

SEQ ID NO: 1720 - DNA, 457 bp, Zea mays
  misc_feature: Ceres CLONE 245487-F
  misc_feature: Translation starting site: 93
  misc_feature (168)..(168): n is a, c, t, g, unknown, or other
  misc_feature (335)..(335): n is a, c, t, g, unknown, or other
  misc_feature (338)..(338): n is a, c, t, g, unknown, or other
atttcatttaccacaccctgctctcgctcttgttgtgacggtcgattcgcttgtacaagctagcacctttgagatccagccaagatccagccatgagggagattctccacatccagggtggacagtgcggcaaccagatcggttccaagttctgggaggtcgtctgcnacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtcgcaccgggccgtacnagnattcttccgccccgacaacttcgtcttcggccagtctggcgcggggaacaactgggccaagggcacttacacagagggcgctgagctcatcgactctgtgcttgamcgtcgtgaggaaa

SEQ ID NO: 1721 - DNA, 477 bp, Zea mays
  misc_feature: Ceres CLONE 245553-F
  misc_feature: Encodes the peptide sequence at SEQ ID NO. 1722
ataaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcagstcaagtcttccacatttggctgctcaagcaaagtttgcagccatgaacatgcagaatgaagatgtcaagcctcgtcgaccagttcaagtcagacgaagtagatgggttcttggtgatgtaaccgaggtgttggatcataattcgtggaggcttgggaagattacagaagttctgaagaatgactattttgtcatcaggctagtgggttgcatccaaccaagagaattccacatatcttgcttgaggattccacatgattgcaagcagttgactgttggaggcaggatcattgaactgaataagccgatccgatttgctga

SEQ ID NO: 1722 - protein, 92 aa, Zea mays
  misc_feature: Ceres CLONE 245553-F
MNMQNEDVKPRRPVQVRRSRWVLGDVTEVLDHNSWRLGKITEVLKNDYFVIRLVGCIQPREFHISCLRIPHDCKQLTVGGRIIELNKPIRFA

SEQ ID NO: 1723 - DNA, 197 bp, Zea mays
  misc_feature: Ceres CLONE 245599-F
  misc_feature (138)..(138): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggccaaggycggcgggcgancgaagaagtcggtgtcgcggtcctccagggccgggctgcagttccccgtcagccgcgtc

SEQ ID NO: 1724 - DNA, 401 bp, Zea mays
  misc_feature: Ceres CLONE 245617-F
  misc_feature: Encodes the peptide sequence at SEQ ID NO. 1725
ataatcctgctcttctcgccaatcacaaaaaccctaagcgccgccggacaattcgttgctcgcgatcctcgcttcgggatccggaagagatggccaagtcgaagaaccacacggcgcacaaccagtcgtacaaggcgcacaagaacggcatcaagaagcccaagcgccaccggcagacctccaccaaggggatggaccccaagttcctgaggaacctgaggtattcaaggaagggcaacaagaagagtggtgaggctgaggagtaggaaggaaagcatggttgtgttttctatgttttagctcagttgtaaggtggaactaaatggtgttatctgatggcaaggaccttttgctccgaaatgtttttatgataatcatgttttgagagttacggtttactt

SEQ ID NO: 1725 - protein, 58 aa, Zea mays
  misc_feature: Ceres CLONE 245617-F
  misc_feature (3)..(42): Pfam Name: Ribosomal_L29e Pfam Description: Ribosomal L29e protein family
MAKSKNHTAHNQSYKAHKNGIKKPKRHRQTSTKGMDPKFLRNLRYSRKGNKKSGEAEE

SEQ ID NO: 1726 - DNA, 311 bp, Zea mays
  misc_feature: Ceres CLONE 245664-F
  misc_feature: Encodes the peptide sequence at SEQ ID NO. 1727
  misc_feature (219)..(219): n is a, c, t, g, unknown, or other
atcggattcacggaccaatcctcgtcttctcccaattctcattgcatcgaatcgggctcgatgctgcccctctccctcttcgtttccctcttggtgctccatctcccccacgcatccgccgacggcagcatctgcatcatcggcggtggcatctccggcgcctccaccgccttcttcctcaccagctacaccagcaccctcggtggagcgcmkgcgcgnttttgagcgccgtcagaaggtgggcggccgctgggcaccgtcactctcgcgggcgacasttcgaggccggggggctccatcatccacccccg

SEQ ID NO: 1727 - protein, 54 aa, Zea mays
  misc_feature: Ceres CLONE 245664-F
  misc_feature (51)..(51): Xaa is any aa, unknown, or other
MLPLSLFVSLLVLHLPHASADGSICIIGGGISGASTAFFLTSYTSTLGGAXARF

SEQ ID NO: 1728 - DNA, 405 bp, Zea mays
  misc_feature: Ceres CLONE 245704-F
  misc_feature (138)..(138): n is a, c, t, g, unknown, or other
  misc_feature (139)..(139): n is a, c, t, g, unknown, or other
  misc_feature (243)..(243): n is a, c, t, g, unknown, or other
  misc_feature (255)..(255): n is a, c, t, g, unknown, or other
  misc_feature (256)..(256): n is a, c, t, g, unknown, or other
  misc_feature (389)..(389): n is a, c, t, g, unknown, or other
acactctgcccagctaagctaagctccctccgtccatcggcatggcgactaccactactaccatcctcctcctcctcctcgtcgcagccacagccgtctcggkkccgacctctccgtgtaccacaacgtgcacccgcnnhccccgtccccgctcgagtccatcatcgcgctcgcccgcrccgacgacgcgcggctmctcttcctctcatccaaggcggcctcgtccggcggcgtcacctccgntcccgtcgcctnnggccagactccgccctcgtacgtcgtccgcgcggggctcggcacccccggtccagcagctgctcctcgcgctcgacaccagcgccgacgccacctggtcgcactgsgcgccgtgcgacacgtgccccgccggnagccgcttcatcccgg

SEQ ID NO: 1729 - DNA, 115 bp, Zea mays
  misc_feature: Ceres CLONE 245712-F
acacgcacaccgcgacccagtccagagccagtacgtgcgavcacgcacgctgctggtccgcgtacsagacgacggtcaggtcggccggtgcttttcagtttggaataatgacggc

SEQ ID NO: 1730 - DNA, 130 bp, Zea mays
  misc_feature: Ceres CLONE 245738-F
  misc_feature (98)..(98): n is a, c, t, g, unknown, or other
acgcacaccgcgacccagtccagagccagtacgtgcgamggtcacgcacgctgctggtccgcgtacsaggacgacggtcaggtcggccggtgcttttnagtttggaataatgacggcgacgacgacgaca

SEQ ID NO: 1731 - DNA, 92 bp, Zea mays
  misc_feature: Ceres CLONE 245749-F
  misc_feature (68)..(68): n is a, c, t, g, unknown, or other
atccccaaatcggcctacgcccacggttccacctcctcgtccacgagtgaggaaaccctagcgaccgnccatggcgttgctcccgcgcaccg

SEQ ID NO: 1732 - DNA, 218 bp, Zea mays
  misc_feature: Ceres CLONE 245754-F
  misc_feature: Encodes the peptide sequence at SEQ ID NO. 1733
aatcacaattcactccactcatcttttcgcgtttagaacctctaaaatttcccccactcgccagtcgcagcagcacctgtagccatggacgccagcggavcggtagcaaggggaagaagggtgcggccgggcgcaaggtcaggctggccccaggwagaagtcggtakwcgcggtccgtcaaagccgggctgcagttccccgtcggccggatcgggcgc

SEQ ID NO: 1733 - protein, 72 aa, Zea mays
  misc_feature: Ceres CLONE 245754-F
  misc_feature (33)..(33): Xaa is any aa, unknown, or other
  misc_feature (55)..(55): Xaa is any aa, unknown, or other
  misc_feature (56)..(56): Xaa is any aa, unknown, or other
SQFTPLIFSRLEPLKFPPLASRSSTCSHGRQRXGSKGKKGAAGRKVRLAPGRSRXXRSVKAGLQFPVGRIGR

SEQ ID NO: 1734 - DNA, 165 bp, Zea mays
  misc_feature: Ceres CLONE 245826-F
  misc_feature (89)..(89): n is a, c, t, g, unknown, or other
aacgcctccgctttcattcttctcttcccctcggcttcgaggggttgtttttatttctttctttcctttttccgttttttattttcttntwttcttttttcgttacttttctcgttccccccgttgggttttgagctccgacgaaccctaawaatcgccggggac

SEQ ID NO: 1735 - DNA, 321 bp, Zea mays
  misc_feature: Ceres CLONE 245831-F
  misc_feature: Translation starting site: 83
  misc_feature: Pfam Name: OST3_OST6 Pfam Description: OST3 / OST6 family
  misc_feature (260)..(260): n is a, c, t, g, unknown, or other
  misc_feature (269)..(269): n is a, c, t, g, unknown, or other
gtcttctcttccacctttgtccgttgtctctaggcaagtytacacccgccggtctcctcctctccagatctgcccatccgccatggcgcctccaccgcaccgccacctgctgctcctcctctttctcctccctctggtcctcctcgctggcacacccgccggcgccgatgaccttrtatcggagctccaatctctccgcgcgcgtccccgtccggcgtgatccacctcaccgacacctccgtcacccgtttcctctccgncccctcagnkhsccgccctactccgtgctcgtattcttcgacgccgcttcgctccactcaa

SEQ ID NO: 1736 - DNA, 333 bp, Zea mays
  misc_feature: Ceres CLONE 245835-F
  misc_feature (32)..(32): n is a, c, t, g, unknown, or other
attttcccattccatcctagggctcgcgagtngstcccccaaagtgaatacagaaacctccagccctaggccaattcctcgaccgcatcgccacccaccccatctccatggctacctccgccctcgctgctctgtccgccaccgcgtccgccgccggttaagcrcatcctcctgtcgagccccgcctcctcctcmtccctctccttcgcctcccgccgcctggccgccggggcaccctccggggtttccttggcgagccaatccgggccgtggcgtcgtcggcgtcgggcggcccccgcggcggcggccaagaccatcgcggtcggggaacgg

SEQ ID NO: 1737 - DNA, 175 bp, Zea mays
  misc_feature: Ceres CLONE 245873-F
  misc_feature (103)..(103): n is a, c, t, g, unknown, or other
  misc_feature (107)..(107): n is a, c, t, g, unknown, or other
acaacaccagaatccgcgaatcacagacgcgtctatctcagcttgctgcactgcactaccctgccctgccatcatatcgtacgtgagcccggccgagcgaganrggnagaggcatggctgctccgaagctcgcgacgctggcgctggccgtgctcctggcggcgaccggtggctc

SEQ ID NO: 1738 - DNA, 423 bp, Zea mays
  misc_feature: Ceres CLONE 245918-F
  misc_feature: Pfam Name: Ras Pfam Description: Ras family
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
awacggcccagacgcgcannanagawagggggagcgcaacattcgcggccgcggggagggagagagacaaggggggcggtcacacacacgcggaccgscgabctagcgagcsasccagatccccctctcgcgctgctggatccgatctgacctgaccttacctcgtcgccgccagcsgtgagagagagaagaggaagaggaggaggaggcggagatggcaccggtgtcggcgctcgccaagtacaagctcgtcttcctgggggaccagttccgtcggcaagaccagcatcatcacccgcttcatgtacgataagttcgacaacacttaccaggctacaattgggtatkgatttcctgtcaargacaatgtaccttgaagatagaactgtgagactccaactctgggatcatgtggctagctct

SEQ ID NO: 1739 - DNA, 419 bp, Zea mays
  misc_feature: Ceres CLONE 245941-F
  misc_feature: Encodes the peptide sequence at SEQ ID NO. 1740
  misc_feature (33)..(33): n is a, c, t, g, unknown, or other
  misc_feature (90)..(90): n is a, c, t, g, unknown, or other
  misc_feature (348)..(348): n is a, c, t, g, unknown, or other
acagcgagtaccgagtaggagcaaccgcttgcntcagacgcacactgacggagagtgatcactgatttctggtcatggcaaccgtaactnaggaattgctccggtmgtcaccgtctccgaggagccggcgccggaagckgcaaggaggtggtggagaagccggagaggggaagaagcccgacgaggagggtgacgagaggaagaaggccgaccccgccgccgagaaggagaagaaggcgaggaagccgcggasaggaagcccaagtccgccgggctgcaccacccgccctatttcgagatgatcaaggaggcgatcctgtcgcaggacggcgggaaggtcggggcgancccgtacgcgatcgccaagcacatgggggataagcaccgggacgtgctcccgcccaattaccgcaagtgct

SEQ ID NO: 1740 - protein, 40 aa, Zea mays
  misc_feature: Ceres CLONE 245941-F
  misc_feature (17)..(17): Xaa is any aa, unknown, or other
MIKEAILSQDGGKVGAXPYAIAKHMGDKHRDVLPPNYRKC

SEQ ID NO: 1741 - DNA, 482 bp, Zea mays
  misc_feature: Ceres CLONE 245948-F
  misc_feature: Encodes the peptide sequence at SEQ ID NO. 1742
  misc_feature (25)..(25): n is a, c, t, g, unknown, or other
  misc_feature (117)..(117): n is a, c, t, g, unknown, or other
  misc_feature (185)..(185): n is a, c, t, g, unknown, or other
  misc_feature (341)..(341): n is a, c, t, g, unknown, or other
acgcaacctcccaytgcattctcgnttccgattcccaatccagcaaaccctaccagccttttgcaaactcagagagggacccgatggcacccaaggcggagaagaagccggcggcanagaagcccgcagaggaggagcccgcggccccggcggagaaggctcccgctgggaagaagccgavgtangaagcggctcccggcggaaaatccgccgccaaggaaggcggtgttgacaagaaggggcggaataaggccaagaagagcgtggagacgtacaagatctacatcttcaaggtgctgaagcaggtgcacccggacatcggcatctcctccaaggccatntccatcatgaactccttcatcaacgacatcttcgagaagctcgccggcgaggsgcccaagctcgcccgttacaacaagaagcccaccatcacctcccgggagatccagacctccgtccgcctcgttctacccggcgagctc

SEQ ID NO: 1742 - protein, 133 aa, Zea mays
  misc_feature: Ceres CLONE 245948-F
  misc_feature (58)..(128): Pfam Name: Histone Pfam Description: Core histone H2A/H2B/H3/H4
  misc_feature (12)..(12): Xaa is any aa, unknown, or other
  misc_feature (33)..(33): Xaa is any aa, unknown, or other
  misc_feature (34)..(34): Xaa is any aa, unknown, or other
  misc_feature (86)..(86): Xaa is any aa, unknown, or other
  misc_feature (104)..(104): Xaa is any aa, unknown, or other
MAPKAEKKPAAXKPAEEEPAAPAEKAPAGKKPXXEAAPGGKSAAKEGGVDKKGRNKAKKSVETYKIYIFKVLKQVHPDIGISSKAXSIMNSFINDIFEKLAGEXPKLARYNKKPTITSREIQTSVRLVLPGEL

SEQ ID NO: 1743 - DNA, 462 bp, Zea mays
  misc_feature: Ceres CLONE 245976-F
  misc_feature: Encodes the peptide sequence at SEQ ID NO. 1744
acctccaccgacccaaaccctagcgcgcacccacctcccttcccctttcccggcgtgcggtccggcgttggagatgcgggggctgctcgcggacggcgggatggcgctggcgatggcgcggagttaacgagtcgtcgggcggtgctgcgttgtcgcagggtctgttatggtgggcgtcggagtgccacggggtgttgtacagccttgcggtgatgctgccgtcgctggccttcgtgggattcctagcatggcaggcgcggcggacttccgtagctcagctacggccgctctcacgtcgtcgtcgtcgcgtactacgscttcctctgggtcgtcgccgtactcaacctcctctggtgcttcctgcaggcatggcaatgtatgcctgacagggcattttcttggaatgtattgtcactgttcacaaaatcaggaatgttattcttggaagtcagtttgatagcc

SEQ ID NO: 1744 - protein, 28 aa, Zea mays
  misc_feature: Ceres CLONE 245976-F
MPDRAFSWNVLSLFTKSGMLFLEVSLIA

SEQ ID NO: 1745 - DNA, 672 bp, Zea mays
  misc_feature: Ceres CLONE 245993-R
  misc_feature: Encodes the peptide sequence at SEQ ID NO. 1746
cgattgggtccgggccccccctcgaggtcgacggtatcgataagctttttttcgtgtttgtttaatttctttcgattccttttcctttttcttccttttcttttttttttctcttttccttgtttcttgttttttgtttttctttcttctttccttcccttctatgtttggtctttgtctttctctgttttcttggtgttgtttgttcttggtgccgggacccggggcgcccctcctcgttcggcgccggcgattgccggctccgacgaccaccgcaacagccgccacaccgagagccgcggcgagctcctgggagaacccccacaaagggaggaggggaaaggaagaaaaaaggagaaaccgccaccccgaacgcaagggggcgcccccctctaggtgcggcggccaagacagcccccccccgcaactggggaggcacgaccaacaactgttctcaatggaggccccgcccaatcaggaaaaacaagacagatactacctgcggggggggggggaccctgtttttacaagaaaaaggaggcggaaggggacctcgagcgcgggggggggggccgccccccaccccacatggtaaaggccggggcccgcccgacgaaacatttgcaccccccgcaaagttctcttgctgctgcgaaaaggcactagacacac

SEQ ID NO: 1746 - protein, 131 aa, Zea mays
  misc_feature: Ceres CLONE 245993-R
RLGPGPPSRSTVSISFFSCLFNFFRFLFLFLPFLFFFSFPCFLFFVFLSSFLPFYVWSLSFSVFLVLFVLGAGTRGAPPRSAPAIAGSDDHRNSRHTESRGELLGEPPQREEGKGRKKEKPPPRTQGGAPL

SEQ ID NO: 1747 - DNA, 459 bp, Zea mays
  misc_feature: Ceres CLONE 246010-F
  misc_feature: Encodes the peptide sequence at SEQ ID NO. 1748
gcgcggacggacagattacattcacctcccatccatttctcaccagaagcgaaggcgaaggcggaggcggaggagcggaggtaggagatctcgagcaagccggasstagtagatgaagacgttcgacccgtggccggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagaaacgcatgtttggccagccagttctgttatgcttttgaatgaaaaatttagacccctctttctcgtttccttaatcgaaatgcttgaactctatgttccatttgtaatgtaataagaggcaaatgaattgaaccaacagcaatcaacttctgatt

SEQ ID NO: 1748 - protein, 57 aa, Zea mays; identical to SEQ ID NO: 544
  misc_feature: Ceres CLONE 246010-F

SEQ ID NO: 1749 - DNA, 130 bp, Zea mays
  misc_feature: Ceres CLONE 246013-F
  misc_feature (97)..(97): n is a, c, t, g, unknown, or other
aaaaaacctcgcaccgcatttccccgcatccgcagctcacatcgctcccccgaacccaaacccaawtcccaagcaaccayttcgtcgaccatggggnagggcactccgggagggatgggcaagcagggcg

SEQ ID NO: 1750 - DNA, 491 bp, Zea mays
  misc_feature: Ceres CLONE 246048-F
  misc_feature: Encodes the peptide sequence at SEQ ID NO. 1751
  misc_feature (458)..(458): n is a, c, t, g, unknown, or other
gttctgggctcctctgtttcctttcgtcaccgtcctcgccgttgtgttcccttctcagtctcggggttttcttctcgcgggcacctccggctgcttcctttgccaccgcagcaccagcgctgtccatggagcccccgccgctctcctcgttgcaggaggagggggaggaggggcctaccgtcgaggactcgtccgtcttctccgcagccgttgtgccgcctcgccccgccacgcacagccactcgctccacaagtacgcgccgctggactggtccgcctacttcgacgaggagcgccgcgktascatccccgacaccgacaacgttttcaatgcgtacacgaccggatcggaggggcccgtcgtgttctgcctcacggaggcggttattcggggctttcatttgctctagcagcaagtcaaattaaggacaagctcgtgttgttgccatggatctaanggggcattgaaatcaacaacggaatgatgatct

SEQ ID NO: 1751 - protein, 94 aa, Zea mays
  misc_feature: Ceres CLONE 246048-F
  misc_feature (59)..(59): Xaa is any aa, unknown, or other
  misc_feature (60)..(60): Xaa is any aa, unknown, or other
MEPPPLSSLQEEGEEGPTVEDSSVFSAAVVPPRPATHSHSLHKYAPLDWSAYFDEERRXXIPDTDNVFNAYTTGSEGPVVFCLTEAVIRGFHLL

SEQ ID NO: 1752 - DNA, 462 bp, Zea mays
  misc_feature: Ceres CLONE 246096-F
  misc_feature: Encodes the peptide sequence at SEQ ID NO. 1753
  misc_feature (455)..(455): n is a, c, t, g, unknown, or other
tttcattatccccccggcagctggtgcgcgagtcggagctggtgcagggtcaccttcccctcggcctcaagagctctgcgttgccgcggccaagggcgtccgtggagaagcgggacaggtggcggcgatggaagagcaaggcgccaggcggcgctcggatgggcggccagggacgactccggcgtctctccccctacagcttctccagaagggttcctaaagacgacgatgtcacgatcaaggtgctctactgcgggatcktgccacaccgacctgcacgtcatcaagaacgactggcgaaacgcatgtacccagtcgtcccggggcacgagatcgtgggcgtggtgaccggcgtcggcggcggcgtcacgcggttcaaggccggcgacacggtcggcgtgggctacttcgtggggtcctgccgctcctkcgacactgcggcaaggggggacganaactact

SEQ ID NO: 1753 - protein, 101 aa, Zea mays
  misc_feature: Ceres CLONE 246096-F
  misc_feature (22)..(97): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (35)..(35): Xaa is any aa, unknown, or other
  misc_feature (91)..(91): Xaa is any aa, unknown, or other
  misc_feature (99)..(99): Xaa is any aa, unknown, or other
MGGQGRLRRLSPYSFSRRVPKDDDVTIKVLYCGIXPHRPARHQERLAKRMYPVVPGHEIVGVVTGVGGGVTRFKAGDTVGVGYFVGSCRSXDTAARGDXNY

SEQ ID NO: 1754 - DNA, 96 bp, Zea mays
  misc_feature: Ceres CLONE 246098-F
  misc_feature (56)..(56): n is a, c, t, g, unknown, or other
gaaaatagcagaagaatccagaggcgactccaggtttgttggcgatgctgcgagcnggaggcaggcggctcctcgcccggggctccgtcggctcgg

SEQ ID NO: 1755 - DNA, 368 bp, Zea mays
  misc_feature: Ceres CLONE 246101-F
  misc_feature: Encodes the peptide sequence at SEQ ID NO. 1756
atcaatcaaatactcagacaaccatggggcacaggcgcmacggcacggacgacaccgaggagctgcttgcmsccaccggcagctgtggtgccatgccctgggctacgtcaagtccatggcgctcaagtgcgcctggacctgcgcatccccgacaccatcgaccgctgcggcggagcgccaccctgggcgagctgctcgcgccagcgagatcccggcgtccaaccacgactacctccgacgggtcatgcgcacgctgacagccatgcgcatcttcgcggtcagccacgacgaccccgccaaggccgacgacgcggccgccatctcttaccagctcaccccggcgtcccggctgctcgtcagcagcagca

SEQ ID NO: 1756 - protein, 122 aa, Zea mays
  misc_feature: Ceres CLONE 246101-F
  misc_feature (13)..(13): Xaa is any aa, unknown, or other
  misc_feature (24)..(24): Xaa is any aa, unknown, or other
SIKYSDNHGAQAXRHGRHRGAACXHRQLWCHALGYVKSMALKCAWTCASPTPSTAAAERHPGRAARASEIPASNHDYLRRVMRTLTAMRIFAVSHDDPAKADDAAAISYQLTPASRLLVSSS

SEQ ID NO: 1757 - DNA, 728 bp, Zea mays
  misc_feature: Ceres CLONE 246106-R
  misc_feature (629)..(629): n is a, c, t, g, unknown, or other
  misc_feature (684)..(684): n is a, c, t, g, unknown, or other
ccaattgggtaccgggccccccctcgaggtcgacggtatcgataagcttttttttttttttttttgcagtaacctgattgataaactcaccaaatccatttacaattcttcctgtcaacgctatggctacagtaggattttgcacgcagaacatatacataccaaatagctgacaggtttggataaccaggctcactcacaagtgcacttatagctcaatcggtgcttaactatgcttttacaaatcaatcaagcctgcctctatatatcatatatagtctataattgacaattttatagcatcataggaccgatgccctcatccctctgaatccttcgttttctcagggtaccctcagtgcagattagcctgcaggaggccatctcttatctgcgccgagacatccttgacagctccaggaccgtgggggatgaacaccgaagaggacttggaggaggccccaatctccctcatggtgtcaaagtactgggtgaccaggaccatgtccatgatgtccttggcagtggtgactggaacgttctctgagaaggcgagcacactgtccctcagcccatccacaatggcctggcgctgccttgcaatacccacgcccagccaggtacttggnatcccgcctcttccctccggcgttcttgattctgaagtatcttctcagcctcagncttctccatgggctgccacccctcttcctaggagctgccatggt

SEQ ID NO: 1758 - DNA, 491 bp, Zea mays
  misc_feature: Ceres CLONE 246109-F
  misc_feature: SWISSPROT Homolog: EC 1.8.1.9 Thioredoxin-disulfide reductase
  misc_feature: SWISSPROT Homolog: EC 3.5.1.52 Peptide-N(4)-(N-acetyl-beta-glucosaminyl)asparagine amidase
acaacacaacaacaacaaccatctccaacgcagcaagcagacagaaggacaggcaggcagcgagtgcaaccgcgagabatcagcrttgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaaggagctgccctcccgcttcaccgatgccatcttcgtcaaggttgacgtcgacgagctcgcggaggtcgcaaggacatggaaggtagaggcgatgccaacgttcgtgctggtcaaggatgggaaggaggtaggccgtgtgattggggctaagaaggacgagcttgagaggaagatcaggatgttcgtcacgtcatcttcctcgtcctaactt

SEQ ID NO: 1759 - DNA, 435 bp, Zea mays
  misc_feature: Ceres CLONE 246155-F
  misc_feature (127)..(127): n is a, c, t, g, unknown, or other
  misc_feature (237)..(237): n is a, c, t, g, unknown, or other
  misc_feature (292)..(292): n is a, c, t, g, unknown, or other
  misc_feature (306)..(306): n is a, c, t, g, unknown, or other
atccgtgcatacatgctcattgctcaccaagggcaagggaggaggagaggacacacagcagtagcgcgaaatggcggcgatgatgatggatagtaccgcggagaaagacctcgccggcgacgcttgncggtgagcgggcacgggcaggacttggagcggtcttgccatgaccaggagcccgccgctgcagatggtgcgagcagcagaggcctagccatcgggcgtttcgtacggganctgatggtggagggcgtggcgtcgttcctgctggwgtwctggtccgcggtggcgncgctgatccagganatgcacggcacgctgacgttccccatggtgtgcctcgtcgtcgcgytcaccgtcggtcttcgtgctctgctggctcggccccgcgcacttcaaccccgccgtcaccgtyaccttcaccgtattcggcta

SEQ ID NO: 1760 - DNA, 641 bp, Zea mays
  misc_feature: Ceres CLONE 246183-R
  misc_feature: Translation starting site: 234
  misc_feature: SWISSPROT Homolog: EC 2.5.1.55 3-deoxy-8-phosphooctulonate synthase
  misc_feature (409)..(409): n is a, c, t, g, unknown, or other
ccgattgggtaccgggccccccctcgaggtcgacggtatcgataagcttttttttttttttttttgttcggtgataagactgtctcgagtagatagggtaaaacagggaatgcgaaactgtagatgacaacactgtttgacactgtttgcagagtggagtttgaaaaaggaaataaaatacggaatgagataaaaaaatctgctagagatagcctaagtcatccactgcaggtatgctcccaacaatagcaagtactcaattcatattgaaatccaccctgtggaattccatggatggtggcattgtgctttctatcaaccaaagcagatcactcctggaacggagtgaggtcgatcttgaatggcttctttccccttgtaactcgagcaatttgcattaattcctccnacagctcttccaagattgcgcaaatgcccattgagtggggcatcgcatggtgcatcaaggggcatcatgtccctccctgaaaatactttcaaccccaaggaaaccaaatcctttgcaaggcccgggttttaatttctcggaaacccccccccttgtgaaaaccccccccccaaaaagttttttttcccccgggtgtgtttgaaaaaaaaatggttttccacccccccccccc

SEQ ID NO: 1761 - DNA, 481 bp, Zea mays
  misc_feature: Ceres CLONE 246206-F
  misc_feature: Encodes the peptide sequence at SEQ ID NO. 1762
aaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcagstcaagtcttccacatttggctgctcaagcaaagtttgcagccatgaacatgcagaatgaagatgtcaagcctcgtcgaccagttcaagtcagacgaagtagatgggttcttggtgatgtaaccgaggtgttggatcataattcgtggaggcttgggaagattacagaagttctgaagaatgactattttgtcatcaggctagtgggttgcatccaaccaagagaattccacatatcttgcttgaggattccacatgattgcaagcagttgactgttggaggcagggaccatcaagcctacgaagaggttgatcactatgctaagag

SEQ ID NO: 1762 - protein, 94 aa, Zea mays
  misc_feature: Ceres CLONE 246206-F
MNMQNEDVKPRRPVQVRRSRWVLGDVTEVLDHNSWRLGKITEVLKNDYFVIRLVGCIQPREFHISCLRIPHDCKQLTVGGRDHQAYEEVDHYAK

SEQ ID NO: 1763 - DNA, 170 bp, Zea mays
  misc_feature: Ceres CLONE 246259-F
aaaaggaaagcgagggccaccatcccccaaacccgtgagaaatcgaatcgagaagggaagagcacgcgccgtcgccagcaccgcgttccgccatdgccgcctcctccccccccgttgcaatcgctggggtccgccgcctcccgcttcctccacgcgcggggcttcgcgcg

SEQ ID NO: 1764 - DNA, 1517 bp, Zea mays
  misc_feature: Ceres CLONE 246262
  misc_feature: Encodes the peptide sequence at SEQ ID NO. 1765
acccttccttttccggttcgactttggacctttcgacgcgttccccaatccagctgaaatcaatccctgatccccaatccccgtccaccctcccaacaaaccctaactctacccctcaaccgagcgcaaccggcggcgatccaagatgccggcgacggcggggcgcgtccgcatgcccgcaaacaaccgcgtgcacagcagcgcggcgttgcagactcacggcatctggcagagcgccatcggatacgacccctacgcgcccgagaacgacaagcaacagccggggcggccttcgtcctccgtctccgccaacgccgccgccgcagctgccaacgacgccaacgcagccgccagcgccgccgcagcttccggatccggctcgggcgatggcaacgcctacaccagcttccagggccttctcgcgctcgcccgcatcacaggctccaactccgatgagacacgcggcgcctgcaagaagtgcggccgcgttggccacctcactttccagtgccgcaacttcctctccgtcaaggacctggacctggacgacgccgacgcccaggccgctgcacaggcggccgcgcaagccaagttcgacgagataaaaaagaaagctgctgccggtggggatgcagatgatgcttctgatgatgtggaagaggacgaggacagcgattcctctgattcagacatcgaccctgagctggagaagataattgctcagcgcgagcgcgccaggaatggagcaaggtggcccaggaaggaaaagaagtcgtccagccaccaccataggaacagcagcagcaagagaaaatcaaagcacacaaggagtaggagtgatgatagtgaggaggatgaaggcagaagaggccgggacaggaagaagatgtctggcagatcgaagaagcatgaaagatctgatgaggctagcagcgatgacactgattcagatagacagaggcacaggaagagcaggaaggacaggaagagcaggaaggacaggaagaggaggagccaccgcaggagtgacgacacgttggatgagaaggatgtatctggaggtgaagaaaggaggcatcaacgtcaccagcggagccatcactggagggatgcatctgactgtgacaatggtgacagtgattctgcacatgacaagaagcaatccagcaggcggaggaggcattgccagtcagaaaacagtgggctagatgaggatgagcgacatgaccaccggggagcaaagcgatcacggaagaatagggaccacaagaggagctaaagaggagcattgaattggtaattcatattcgatgatgttatcgagttcctgtagtcatcagctggtctgttgtcttctcataagttggaaacatttgaaatatgatgcttaatatgtgtaacaatataacatgttggtgtattactgtatgtctgaactatacgtcgagtctattatgtgttgatgattcaataattgatacattgacaaggattttttaagaaaaaaaaaaaaaaaa

SEQ ID NO: 1765 - protein, 377 aa, Zea mays
  misc_feature: Ceres CLONE 246262
MPATAGRVRMPANNRVHSSAALQTHGIWQSAIGYDPYAPENDKQQPGRPSSSVSANAAAAAANDANAAASAAAASGSGSGDGNAYTSFQGLLALARITGSNSDETRGACKKCGRVGHLTFQCRNFLSVKDLDLDDADAQAAAQAAAQAKFDEIKKKAAAGGDADDASDDVEEDEDSDSSDSDIDPELEKIIAQRERARNGARWPRKEKKSSSHHHRNSSSKRKSKHTRSRSDDSEEDEGRRGRDRKKMSGRSKKHERSDEASSDDTDSDRQRHRKSRKDRKSRKDRKRRSHRRSDDTLDEKDVSGGEERRHQRHQRSHHWRDASDCDNGDSDSAHDKKQSSRRRRHCQSENSGLDEDERHDHRGAKRSRKNRDHKRS

SEQ ID NO: 1766 - DNA, 94 bp, Zea mays
  misc_feature: Ceres CLONE 246263-F
  misc_feature (48)..(48): n is a, c, t, g, unknown, or other
aataagaaaaatactcccgtgttcttcgaccggcggcggtggtgcgangaggcggtaagggagacgagatgagggggacgaagcggccgctcgg

SEQ ID NO: 1767 - DNA, 390 bp, Zea mays
  misc_feature: Ceres CLONE 246279-F
  misc_feature: Encodes the peptide sequence at SEQ ID NO. 1768
  misc_feature (125)..(125): n is a, c, t, g, unknown, or other
  misc_feature (250)..(250): n is a, c, t, g, unknown, or other
  misc_feature (251)..(251): n is a, c, t, g, unknown, or other
actccccagtccccatagactccagcctgagctgcgacgtgagcgctcgccgctccgcatcgccgtcccagtcccacaccccgcctcbdagcctgccccagcgtaatggcgcatcgcaggccgtnctcgcggcgttgtcctcgccgcgctgttcccgctcgccctctctcgcgggctgggcttggtgcacgggcatgtgcggccgcacacgcacgggctggggctcggccaccaccactcccagccgcanncgcacggcgcgcaccgctcgcaggtggcgcgtggtcctctgctcacgccaccttctacggcggcggcgacsgttccggcaccatgggcggtgcgtgcgggtacggcaacctctacagccaggggtacggcaccaacacg

SEQ ID NO: 1768 - protein, 95 aa, Zea mays
  misc_feature: Ceres CLONE 246279-F
  misc_feature (7)..(7): Xaa is any aa, unknown, or other
  misc_feature (49)..(49): Xaa is any aa, unknown, or other
  misc_feature (73)..(73): Xaa is any aa, unknown, or other
MAHRRPXSRRCPRRAVPARPLSRAGLGARACAAAHARAGARPPPLPAAXARRAPLAGGAWSSAHATFYGGGDXSGTMGGACGYGNLYSQGYGTNT

SEQ ID NO: 1769 - DNA, 116 bp, Zea mays
  misc_feature: Ceres CLONE 246284-F
acacgcacaccgcgacccagtccagagccagtacgtgcgamgcacgcacgctgctggtccgcgtacsagacgacggtcaggtcggccggtgcttttcagtttggaataatgacggc

SEQ ID NO: 1770 - DNA, 365 bp, Zea mays
  misc_feature: Ceres CLONE 246326-F
  misc_feature: Translation starting site: 74
aytcatacatttcgactctcaactcccaaggtccctttttttttctcgatctggaagckccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcabgttaggcacgggtgcccccgtctacctcgccgccgtcctggagtacctcgcggccgaggtgctcgagctcgccggcaacgcscaagggacaacaagaagacgcgcatcatccgcggccacgtgctcctcgccatcc

SEQ ID NO: 1771 - DNA, 258 bp, Zea mays
  misc_feature: Ceres CLONE 246333-F
  misc_feature: Encodes the peptide sequence at SEQ ID NO. 1772
  misc_feature (108)..(108): n is a, c, t, g, unknown, or other
acaacaccagaatccgcgaatcacagacgcgtctatctcagcttgctgcactgcactaccctgccctgccatcatatcgtacgtkagcccggccgagcgagasmgggnagaggcatggctgctccgaagctcgcgacgctggcgctggccgtgctcctggcggcgaccgtggtggctcccccggccgcggtgcgcgcgggmattgtcgtgctccaccgtgtacagcacgctgatgccgtkcctgccgttcgtccagat

SEQ ID NO: 1772 - protein, 48 aa, Zea mays
  misc_feature: Ceres CLONE 246333-F
MAAPKLATLALAVLLAATVVAPPAAVRAGIVVLHRVQHADAVPAVRPD

SEQ ID NO: 1773 - DNA, 702 bp, Zea mays
  misc_feature: Ceres CLONE 246335-R
  misc_feature (450)..(450): n is a, c, t, g, unknown, or other
ccgattgggtaccgggccccccctcgaggtcgacggtatcgataagcttttttttttttttttttggtgttttgcttgctttttctcaatcctgtttgcgaggaatctccacaacttgggagcctctcgcccttacactttaagatcacaaagaaacacggagcaagggagggattagcaacgcactcaagaaatcacagcaacaccacgcacacaagtcacaacgagagctcacaatacaactcaatgagttcaccactcaactagagctccaattgctatcgcaaagaatcaaaggcgcggaatcgatatcttggtgcttaggaatgttgtaggaatgcttggtatgctcctccatgcgcctaggggtcccttttatagccccaaggaagctaggagccgttgagagcaatctaggaaggctgatcttgccttctgtcgactggcgcnaccggacagtccggtgcacaccggacatgtccggtgcccgatttctttccataaatggcacagtcgaccgttggcagccagagagccgttggcgcaccggacatgtccggtgcacaccggacagtccggtgcctccttctagccgttggctcggccacgtgtcccacgcagatcgcgcggccgaacgttggcccgaccgaccgttggctcaccggacagtcccgtgcacaccggacagtcccggtgaattaa

SEQ ID NO: 1774 - DNA, 133 bp, Zea mays
  misc_feature: Ceres CLONE 246355-F
  misc_feature (66)..(66): n is a, c, t, g, unknown, or other
atccatcacagctagctagcatacagacgaataatctcttcttcacctcactwacaccagctatgnaactctttctctcctgcaataatggccgctcgctcctcctcctcccagccgcagctgtcgcggcggc

SEQ ID NO: 1775 - DNA, 502 bp, Zea mays
  misc_feature: Ceres CLONE 246362-F
  misc_feature: Encodes the peptide sequence at SEQ ID NO. 1776
aacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcactcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttg

SEQ ID NO: 1776 - protein, 125 aa, Zea mays
  misc_feature: Ceres CLONE 246362-F
MRECISIHIGQAGIQVGNACWELYCLEHGTQADGQMPGDKTIGGGDDAFNTFFSETGAGKHVPRAVFVDLEPTVIDEVRTGTYRQLFHPEQLISGKEDAANNFARGHYTIGKEIVDLCLDRIRKL

SEQ ID NO: 1777 - DNA, 343 bp, Zea mays
  misc_feature: Ceres CLONE 246363-F
  misc_feature: Encodes the peptide sequence at SEQ ID NO. 1778
  misc_feature (250)..(250): n is a, c, t, g, unknown, or other
atccactaccgcagccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcggaggcaaacggcgcastcgggccggccgcgtcggcgatgcaagggcacctccgtacctacatgaacgcggggattcccaagcggttcaaagaggatnaggagaaagaacagcttgcaaaagatctcgcaaaagattggaatgctgtgtttgawaggagcatcaatacattgttttttgactgaaatggtc

SEQ ID NO: 1778 - protein, 48 aa, Zea mays
  misc_feature: Ceres CLONE 246363-F
  misc_feature (21)..(21): Xaa is any aa, unknown, or other
  misc_feature (39)..(39): Xaa is any aa, unknown, or other
MQGHLRTYMNAGIPKRFKEDXEKEQLAKDLAKDWNAVFXRSINTLFFD

SEQ ID NO: 1779 - DNA, 334 bp, Zea mays
  misc_feature: Ceres CLONE 246384-F
  misc_feature: Encodes the peptide sequence at SEQ ID NO. 1780
  misc_feature (255)..(255): n is a, c, t, g, unknown, or other
gtggagcaaggaaggagaggggagccgagcggcaaaggggagcgcggcrcagacatggcggasagcacaaggaggagtcgggcgtkacagtgctggacaagatctccgacaagctccacgggcgcgggggcggctcgtcttcgtcgtcggactcggacgacaagcgctcgtcggcgacggccgccgtgaaggccaagatctaccgcatcttcgggcgcgagaagcccgtgcactccgtcctcggcggcggcaagngcsattctgtttctatggaggaacaagaggatctctggtggggtgctcgcaggcgcaactgccttctgggctgctgttt

SEQ ID NO: 1780 - protein, 110 aa, Zea mays
  misc_feature: Ceres CLONE 246384-F
  misc_feature (16)..(16): Xaa is any aa, unknown, or other
  misc_feature (21)..(21): Xaa is any aa, unknown, or other
  misc_feature (85)..(85): Xaa is any aa, unknown, or other
  misc_feature (86)..(86): Xaa is any aa, unknown, or other
GARKERGAERQRGARXRHGGXHKEESGVTVLDKISDKLHGRGGGSSSSSDSDDKRSSATAAVKAKIYRIFGREKPVHSVLGGGKXXSVSMEEQEDLWWGARRRNCLLGCC

SEQ ID NO: 1781 - DNA, 150 bp, Zea mays
  misc_feature: Ceres CLONE 246387-F
agggtttcctcctcccgccgccacttgccgccccacgagcccattcccctcagcccttcaccatctccggcggccgcagttggcatcagcagctccggctcacgcgcagtgaaggaacgacaatatggcgaccatcgtaaacacgacgga

SEQ ID NO: 1782 - DNA, 203 bp, Zea mays
  misc_feature: Ceres CLONE 246408-F
gagagagggagagaaaaagtaatccgacggaaacgacaagggcgcggcgagggcggggacgggaaggccctgggcgcggaggcsaagcacatggcatcktcgagggtgataccgtcgtcctcgccgtcgcacacggcctcggatctcgcgcgcctasaggccgccagcaggcccggyggcgggggcatcgggccgggctccat

SEQ ID NO: 1783 - DNA, 492 bp, Zea mays
  misc_feature: Ceres CLONE 246448-F
  misc_feature: Encodes the peptide sequence at SEQ ID NO. 1784
  misc_feature (132)..(132): n is a, c, t, g, unknown, or other
  misc_feature (325)..(325): n is a, c, t, g, unknown, or other
  misc_feature (329)..(329): n is a, c, t, g, unknown, or other
  misc_feature (366)..(366): n is a, c, t, g, unknown, or other
  misc_feature (416)..(416): n is a, c, t, g, unknown, or other
  misc_feature (417)..(417): n is a, c, t, g, unknown, or other
acaagctcgaccaccaacccagctcgctcgtcccagctgatcaggtcgagcacctagtagcgacctgctcgatcatcagtgtagagtgtcggtaggtgtctgtctctcttggtggctggttgcaacggtcantggcgacgtcgtctctktygggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtccnggcnhgagtacctgttcggcaagatckacatgcagctgcgnctggtgccgggcaactccgccggcaccgtcaccgcctactacctgwmgcnncatggcggcgcgcacgacgagatcgacttcgagttcctgggcaacgtgtccggcgagccctacacgctgcacacc

SEQ ID NO: 1784 - protein, 46 aa, Zea mays
  misc_feature: Ceres CLONE 246448-F
  misc_feature: SWISSPROT Homolog: EC 2.4.1.207 Xyloglucan:xyloglucosyl transferase
  misc_feature (20)..(20): Xaa is any aa, unknown, or other
  misc_feature (21)..(21): Xaa is any aa, unknown, or other
MQLRLVPGNSAGTVTAYYLXXHGGAHDEIDFEFLGNVSGEPYTLHT

SEQ ID NO: 1785 - DNA, 559 bp, Zea mays
  misc_feature: Ceres CLONE 246462-R
  misc_feature: Pfam Name: 14-3-3 Pfam Description: 14-3-3 protein
  misc_feature (47)..(47): n is a, c, t, g, unknown, or other
tcgagggcgttttcaacaataagctgggttttttttttttttccaancgaaaaagaatgcgatgactttaaaagctcaataaaacgctagagcgatttttgacccgcttgccaaataaatccaggggaacaataccagtccacatggactagcggcaacacaaagcaatggggtactaattcgaccactaccagcctactaacaaggaaaaagaagtgaatggagacgaaatcagctacaataatggcacagcacagcttcgacagcatagagcatctaaaacattggggctcgaacaactttgcaccccctccaaagattactgtccctcgcctgcatctccgtgcggtcccccccccccctcatcagcaccatcctccgtgaggtcggatgtccaaagggtcaagatatccctcaggagttgcatgatcagagtgctatccttgtatgactcctcaccaaggctgtctaactcagagatagcttcatcaaacgcctgctttgccaggttgcaagctttgtctggggagttcagaatctcataatagaacactgaaaa

SEQ ID NO: 1786 - DNA, 457 bp, Zea mays
  misc_feature: Ceres CLONE 246464-F
  misc_feature: Encodes the peptide sequence at SEQ ID NO. 1787
ttccctctctcctctgctgatctttttcgtccaccagcatggaggagaagaggaagctgcagtggcggcgagggcgtgatggcatcgtgcagtaccctcacctgttcttcgcggccctggccctggccctcctagtcgcggacccgttcggcctcagtccgctggccgaggtcgactaccggccggtgaagcacgagctcgcgccgtacggggaggtcatgggcagctggcccagagacaatgccagccggctcaggcgcgggaggctggagttcgtcggcgaggtgttcgggccggagtccatcgagttcgatctccagggccgcgggcgtacgccggcctcgccgacggccgcgtcgtgcggtggatgggcgaggaggccgggtgggagacgttcgccgtcatgaatcctgactgaagaagtctgtgccaatggagtgaactcaacgacgaggaa

SEQ ID NO: 1787 - protein, 122 aa, Zea mays
  misc_feature: Ceres CLONE 246464-F
MEEKRKLQWRRGRDGIVQYPHLFFAALALALLVADPFGLSPLAEVDYRPVKHELAPYGEVMGSWPRDNASRLRRGRLEFVGEVFGPESIEFDLQGRGRTPASPTAASCGGWARRPGGRRSPS

SEQ ID NO: 1788 - DNA, 217 bp, Zea mays
  misc_feature: Ceres CLONE 246484-F
  misc_feature: Encodes the peptide sequence at SEQ ID NO. 1789
  misc_feature (62)..(62): n is a, c, t, g, unknown, or other
  misc_feature (67)..(67): n is a, c, t, g, unknown, or other
aatccagcacattcccatgacgggccacgcagcctgctgctgctgctgctgccggcgctcgncmgtnccttctctgctgccccctcgcgcaatgcgggcagcagaactacacctccatgttcagcttcggcgactcgctcaccgacaccggcaacctgctcgtgtccagcccgctctccaaccacatcgtcggccgctacccctacggcatcaccta

SEQ ID NO: 1789 - protein, 33 aa, Zea mays
  misc_feature: Ceres CLONE 246484-F
MFSFGDSLTDTGNLLVSSPLSNHIVGRYPYGIT

SEQ ID NO: 1790 - DNA, 493 bp, Zea mays
  misc_feature: Ceres CLONE 246511-F
  misc_feature: Encodes the peptide sequence at SEQ ID NO. 1791
  misc_feature (183)..(183): n is a, c, t, g, unknown, or other
  misc_feature (465)..(465): n is a, c, t, g, unknown, or other
atccaacccacacacaggctgaccccaccaacagcaagckaaaatctcccgatcccctctagtctccgcggcgaagatgtcggggcgcggcaagggcgggaagggcctgggcaagggcggacggacgcaccggaaggtctccgcgacaacatccaggggatcacgaagccggcgatccggcgnctggcgcgcaggggcggcgtgaacsatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctggggtggcgaaaatnctggttactgtaccactagatcaagcat

SEQ ID NO: 1791 - protein, 42 aa, Zea mays
  misc_feature: Ceres CLONE 246511-F
  misc_feature (36)..(36): Xaa is any aa, unknown, or other
MSGRGKGGKGLGKGGRTHRKVSATTSRGSRSRRSGXWRAGAA

SEQ ID NO: 1792 - DNA, 420 bp, Zea mays
  misc_feature: Ceres CLONE 246525-F
  misc_feature: Encodes the peptide sequence at SEQ ID NO. 1793
aattgctccacccaaaaaaatggcggcggcgcsaggagctgctctgcgcggcggcgaagtccggttgaagagggcgaagtcgctaaactccttgcttcaggagctgacgcgacccacttcgatgccgacgsttgacgccgctgatgcacgckgccgcgggggggcacgccgccgttgcgcgcctcctcctcgactgcggtgcgccctggaacgcgctctccccctcggcctctcggcaggggacatagcctccgaccccgacacctatygacctcctcctcgggccacgccctccgctccgagctcgtcctdggcaccgtcgcgcggcgcaagcggcccccgcgaacggtcccccggccgagakctacctcgaatccagggtctcgttcagcgaggagagggtgatggacgcggagagca

SEQ ID NO: 1793 - protein, 34 aa, Zea mays
  misc_feature: Ceres CLONE 246525-F
MHAAAGGHAAVARLLLDCGAPWNALSPSASRQGT

SEQ ID NO: 1794 - DNA, 334 bp, Zea mays
  misc_feature: Ceres CLONE 246533-F
  misc_feature: Encodes the peptide sequence at SEQ ID NO. 1795
actctctccttctccccctacttccctacgtaccaggaggctaccactcccccagagtgaaggaagagagagctctccgcctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcggsccgagcgcccgcagcaccgggaaggtgatsccggacgagtacgacgagcggtcctactgcctatacgacactgacgcctcctcggtgtacggcgtctccgctttctttcgtgctcc

SEQ ID NO: 1795 - protein, 69 aa, Zea mays
  misc_feature: Ceres CLONE 246533-F
  misc_feature (41)..(41): Xaa is any aa, unknown, or other
MGGFGTSRPASVALCAFLTFLNLFAVLLAVGPSARSTGKVXPDEYDERSYCLYDTDASSVYGVSAFFRA

SEQ ID NO: 1796 - DNA, 434 bp, Zea mays
  misc_feature: Ceres CLONE 246617-F
  misc_feature: Encodes the peptide sequence at SEQ ID NO. 1797
  misc_feature (41)..(41): n is a, c, t, g, unknown, or other
  misc_feature (295)..(295): n is a, c, t, g, unknown, or other
  misc_feature (296)..(296): n is a, c, t, g, unknown, or other
  misc_feature (300)..(300): n is a, c, t, g, unknown, or other
  misc_feature (362)..(362): n is a, c, t, g, unknown, or other
atcgcygccccccgtcccgacgaattggaatacggaaagcnaaagatgatggatctcgccgacccccagcagcagcagcggctcatcgccggcgcggcctgctgctggcaaccgcggccttcctcaggctcctcctgggctcccgctcccggggcggcaagcgctgccgccaccatcccgggggcgccggtgatcggsgcctcgtcaagttcatgcgcgggcccatccccatgatccgggagcagtacgcccgcctcggcagcgtcttcaccgtccccatcattayyygcagaknncgtntcctcgtcggccctgaggtgtctgcgcacttcttcaagggcaacgaggccgagatgagccancaggaggtgtacaggttcaacgtgcccacgttcggccccggggtcgtcttcgastcgactactccgtcagca

SEQ ID NO: 1797 - protein, 144 aa, Zea mays
  misc_feature: Ceres CLONE 246617-F
  misc_feature: SWISSPROT Homolog: EC 1.14.13.70 Sterol 14-demethylase
  misc_feature (2)..(2): Xaa is any aa, unknown, or other
  misc_feature (66)..(66): Xaa is any aa, unknown, or other
  misc_feature (95)..(95): Xaa is any aa, unknown, or other
  misc_feature (96)..(96): Xaa is any aa, unknown, or other
  misc_feature (98)..(98): Xaa is any aa, unknown, or other
  misc_feature (100)..(100): Xaa is any aa, unknown, or other
  misc_feature (120)..(120): Xaa is any aa, unknown, or other
  misc_feature (138)..(138): Xaa is any aa, unknown, or other
RXPPSRRIGIRKAKDDGSRRPPAAAAAHRRRGLLLATAAFLRLLLGSRSRGGKRCRHHPGGAGDRXLVKFMRGPIPMIREQYARLGSVFTVPIIXXRXRXLVGPEVSAHFFKGNEAEMSXQEVYRFNVPTFGPGVVFXSTTPSA

SEQ ID NO: 1798 - DNA, 753 bp, Zea mays
  misc_feature: Ceres CLONE 246655-R
cgaattgggtaccgggccccccctcgaggtcgacggtatcgataagcttttttttttttttttttgttgaaaagtaaagctacatttttcagtttgtaccaccagacacaggttgatctgcgaaggtacacaaggaattgaggtaaaagtttgggatatcgttggagccacagtactcgctgacattggggtgcttgcttttaatttttctgacacgctgcggcaccaaatggattgaatgataccagaggcaaggatgctccatgttctgtgtcttcctcgaatccctcaacctcttgtaatgcggtgagaacttcaacggaagacggtagctttggaccgtcatctattcatgcagatgtaagcatgtcgaacttatcgcccatatagagctaaatgaatcatctgatccctcccctttgtaactactcccggaagattcggattattgaacaacccttggcctcgggatcaatctccttttcccatttcctttagaccttttaaccgttggtttaaccaccttccccctttggcggggcctttatttgtcccccaggcctaagaaaacccaaaacttccacccccctaaacgctttaatcctttggggccccttaaaccccccaaaaaaaaatagttttccgagaaaaacctccccaaaaaacacctggaaatgaaaaaaaaaaacaaaccccccaaaaaagtggtaaaaacttcttcgcccccccctaatttttttaaacaaatttccc

SEQ ID NO: 1799 - DNA, 513 bp, Zea mays
  misc_feature: Ceres CLONE 246666-F
  misc_feature: Encodes the peptide sequence at SEQ ID NO. 1800
gcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaaatgtgggtcaaaccaacaaggtttcatttcatccttaagcacaaga

SEQ ID NO: 1800 - protein, 152 aa, Zea mays
  misc_feature: Ceres CLONE 246666-F
  misc_feature (24)..(152): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKMWVKPTRFHFILKHK

SEQ ID NO: 1801 - DNA, 153 bp, Zea mays
  misc_feature: Ceres CLONE 246668-F
  misc_feature (75)..(75): n is a, c, t, g, unknown, or other
agttcggattcagatcgcggccggtgcgaacccacgaaggcacgaacggtagaacccgaccgagcgcggcagvanatcctccgatccctgctgcgagcaaggatggcggcggcatgggcagtgctggcggcggtgctcgtcgcagcgcagggt

SEQ ID NO: 1802 - DNA, 485 bp, Zea mays
  misc_feature: Ceres CLONE 246690-F
  misc_feature: Encodes the peptide sequence at SEQ ID NO. 1803
  misc_feature (433)..(433): n is a, c, t, g, unknown, or other
aggaggggatagcatcgtcatcgcaaaatgcaggctctcctgctccccgcgcgggccgccgccgacgccggcattgcttcggcagcgtgcggttttctgcctccgcgtgtgcgtcgcaggtctgccgccccctattcggtgccgccaattgcatctcctgtggggtctacggaagcgttcggcgcacctcacagtggcggtggcggcggccccgcctcgccttcgtcctcaccttcgtcgggaccgctctacccgacgcctccacccaccgagcaggaggttggagagggtcaagctcgagcaggttatgaggagactagagaaaacagcaaggtatttcaagaatttgggtacctggggttctggtcccaattggtgtgcacaattatttctggctggaattttggcattctctacagttgtaacggggaangtgacatcaccctttacattctatgcaactgctgctggtattgctgctgctt

SEQ ID NO: 1803 - protein, 161 aa, Zea mays
  misc_feature: Ceres CLONE 246690-F
  misc_feature (144)..(144): Xaa is any aa, unknown, or other
GGDSIVIAKCRLSCSPRGPPPTPALLRQRAVFCLRVCVAGLPPPIRCRQLHLLWGLRKRSAHLTVAVAAAPPRLRPHLRRDRSTRRLHPPSRRLERVKLEQVMRRLEKTARYFKNLGTWGSGPNWCAQLFLAGILAFSTVVTGXVTSPFTFYATAAGIAAA

SEQ ID NO: 1804 - DNA, 430 bp, Zea mays
  misc_feature: Ceres CLONE 246696-F
atatcaacacggtcaccaagtcctctccggatggcaaggccttgtgaccttccgccggtgcgcaagcagcggctcttctcctggcatgcgcgcttgctctgctcgcggtgcagctgcggccgtgcagagcccagcagcagcagcagcctccgtcgccgggatactaccccagcggcatgttcaggccgctggccttctccgaggcctaccgcaccctgtgggcgcgcavaccagacgctgtcgccggacgcaagtcctgacgctctggatggacagcagctcgggcagcgggttcaagtctgcgcgggcgtaccggaacgctacttcggcgcgtccgtcaggtgcagccggggtacaccgccgggcgtcaacaccgccttctacctgtcgaacagcgaggagtacccggggcacacgacgagatcgacat

SEQ ID NO: 1805 - DNA, 104 bp, Zea mays
  misc_feature: Ceres CLONE 246725-F
aagaacacgaagacgacgggagtgcggggtggcgtcgcgcgggagcaccagttgtagccggcgstaggcctccgcgccgctctccgtggccaacgtgccgtcat

SEQ ID NO: 1806 - DNA, 361 bp, Zea mays
  misc_feature: Ceres CLONE 246782-F
  misc_feature: Pfam Name: Chalcone Pfam Description: Chalcone-flavanone isomerase
  misc_feature: SWISSPROT Homolog: EC 5.5.1.6 Chalcone isomerase
gtagcctgtagcttcatccgttgcgctgctcccggttccatcgcgcggtgcggaatttaacatggccgtgcggagtggtggtcgacggcgtstcttcccgccggtggcccgcccgcyggstccgccggctcgcacttcctcggcggcgcaggcgtgcgaggcctcgagatcggaggcaacttcatcaagttcacggccatcggcgtgtacctggaggacgcggccgtgccgccttggccaagaagtggggcggcaagacggccgacgagctcgcctccgacgccgccttcttccgcgacgtcgtcacgggcgacttcgagaagttcacgagggtgacgatgatcctcccgctgacggccga

SEQ ID NO: 1807 - DNA, 464 bp, Zea mays
  misc_feature: Ceres CLONE 246784-F
  misc_feature: Encodes the peptide sequence at SEQ ID NO. 1808
  misc_feature (221)..(221): n is a, c, t, g, unknown, or other
  misc_feature (323)..(323): n is a, c, t, g, unknown, or other
cccctctttgtgctgtttcttctcgccgccgccgccgccgtcgttgccgctagccggcgtmbtgataggaaacctgaccacctgagccttctgtagaccagcctcagcgcaactcccaaccacttctcttatggcgctcctccttcgccgaggcgtggccctcgccgcccgctccttccgcgccggccgcctcctccgcttccaccactgtgtaccgcctnccagccggggcgtcccttgcgggcgccggggaattggctccggcgcastcttcttcttcgagaaccgaagaggcttcgcgaaggggaataaatcgaaggatnatcgaggtgacactgtttcaagctgtttcctgacattgggccaactgtcaaatcagctgccaccgcacaaatggacgctgcagtgatcgcactgtcacgagagctgagcaaactacggactggaaagakctacacctggca

SEQ ID NO: 1808 - protein, 92 aa, Zea mays
  misc_feature: Ceres CLONE 246784-F
  misc_feature (31)..(31): Xaa is any aa, unknown, or other
  misc_feature (47)..(47): Xaa is any aa, unknown, or other
  misc_feature (65)..(65): Xaa is any aa, unknown, or other
MALLLRRGVALAARSFRAGRLLRFHHCVPPXSRGVPCGRRGIGSGAXFFFENRRGFAKGNKSKDXRGDTVSSCFLTLGQLSNQLPPHKWTLQ

SEQ ID NO: 1809 - DNA, 431 bp, Zea mays
  misc_feature: Ceres CLONE 246811-F
  misc_feature: Encodes the peptide sequence at SEQ ID NO. 1810
  misc_feature (233)..(233): n is a, c, t, g, unknown, or other
  misc_feature (323)..(323): n is a, c, t, g, unknown, or other
  misc_feature (324)..(324): n is a, c, t, g, unknown, or other
atccaagctccattttctctgaggaagcgaaccttccctttccccaggcacagatccggctctccgccgccgctatggsctcgccgcctcctccttctcctcgccgttgtcgccgcgtccctcctggctgccgacgcgcggccgtgccacgcttcctcgtcgccatcccgtccgatcccaaycccgaccccagcagaggcgacggcgccgtcaaccgccacctcggcgctcynaacgtcgccacggtcatcaccgtcttccgcgtccgccgcctcggtccacacgtcccccacggccaccgcaaccaccacyayctccattcnntccccgccaacgttcagatccatcgccccgatctcctgcaccccgccacggccgcggcgccgggcccaggagcgcgtcagggacatactcgtggtggtcgtggggct

SEQ ID NO: 1810 - protein, 119 aa, Zea mays
  misc_feature: Ceres CLONE 246811-F
  misc_feature (2)..(2): Xaa is any aa, unknown, or other
  misc_feature (53)..(53): Xaa is any aa, unknown, or other
  misc_feature (80)..(80): Xaa is any aa, unknown, or other
  misc_feature (84)..(84): Xaa is any aa, unknown, or other
MXSPPPPSPRRCRRVPPGCRRAAVPRFLVAIPSDPNPDPSRGDGAVNRHLGAXNVATVITVFRVRRLGPHVPHGHRNHHXLHSXPANVQIHRPDLLHPATAAAPGPGARQGHTRGGRGA

SEQ ID NO: 1811 - DNA, 322 bp, Zea mays
  misc_feature: Ceres CLONE 246821-F
  misc_feature (122)..(122): n is a, c, t, g, unknown, or other
aaggaaccctagcggaacactgtgcaggtgacggcggcgcgctaccggtgacggggatacggcggcatcgtcccctcctccatccccggcgcggcggcgagcagcggccctgcagggacgtnctccagtctccagaatccagattcagagcttgtccctgttttctggtgtgctctgttgtactgtagcctttagccagggcaaattaaagctacaatgcaggcttctwactatgcaaaggatcttttggttttgaagtccagttgaccgaagtttggaaaatacttctgatacttacagatttcacagaggtctggttaat

SEQ ID NO: 1812 - DNA, 373 bp, Zea mays
  misc_feature: Ceres CLONE 246830-F
  misc_feature: Encodes the peptide sequence at SEQ ID NO. 1813
  misc_feature (98)..(98): n is a, c, t, g, unknown, or other
  misc_feature (209)..(209): n is a, c, t, g, unknown, or other
  misc_feature (356)..(356): n is a, c, t, g, unknown, or other
aagaaccaacgtgctcgatctccatctcgaccgtcgctcaccgggaagctacgctacgacgaagcatggcgtccgtyaccgcccgykcyccggtcgcnccctgcgcccgtcggcgtctctcaagtcgtcgtcgtcgtcggcggcggccttccttggccactctagccgcctcggccgcactgctaccgcgtcgccgacgaggscastanaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggactggttnaacgggcggtgggcgat

SEQ ID NO: 1813 - protein, 102 aa, Zea mays
  misc_feature: Ceres CLONE 246830-F
  misc_feature (8)..(8): Xaa is any aa, unknown, or other
  misc_feature (47)..(47): Xaa is any aa, unknown, or other
  misc_feature (48)..(48): Xaa is any aa, unknown, or other
  misc_feature (97)..(97): Xaa is any aa, unknown, or other
MASVTARXPVAPCARRRLSSRRRRRRRPSLATLAASAALLPRRRRGXXKAEAKGEWLPGLPSPAYLDGSLPGDNGFDPLGLAEDPENLRWYVQADWXNGRWA

SEQ ID NO: 1814 - DNA, 160 bp, Zea mays
  misc_feature: Ceres CLONE 246890-F
  misc_feature (90)..(90): n is a, c, t, g, unknown, or other
  misc_feature (91)..(91): n is a, c, t, g, unknown, or other
  misc_feature (93)..(93): n is a, c, t, g, unknown, or other
atcacccaaaacacaagtagggttaggaaggcggcggccagcggcgagagcgcgagaggaggaggggtcggccatgacggggaaggcgannangaagcacacagcgaaggagatcgccgcgaagatcgacgcggcacgacgaaccggggcggcggcaagg

SEQ ID NO: 1815 - DNA, 315 bp, Zea mays
  misc_feature: Ceres CLONE 246899-F
  misc_feature: Translation starting site: 11
  misc_feature: Pfam Name: Glyco_hydro_19 Pfam Description: Chitinase class I
  misc_feature: SWISSPROT Homolog: EC 3.2.1.14 Chitinase
  misc_feature (85)..(85): n is a, c, t, g, unknown, or other
  misc_feature (145)..(145): n is a, c, t, g, unknown, or other
aaagcaagccatgtggaggagggctttasgatggtgctgttcatggctggcgccgcgctgctcgccggggccgccggsccggccncacagggcgttggagcatcatcacccggcccatgttccagagcatgctgagccaccgcgncgacasgggtgccagggcgccttctacacctacgatgccttcatcgaggccgccagcaagttccccggcttcggcaccaccggcgacgagcagacgcgcaggsgggactcgccgccttcttcggccagacgtcccacgaaaccaccggtggatgggcgactgctccggat

SEQ ID NO: 1816 - DNA, 417 bp, Zea mays
  misc_feature: Ceres CLONE 246921-F
  misc_feature: Encodes the peptide sequence at SEQ ID NO. 1817
  misc_feature (139)..(139): n is a, c, t, g, unknown, or other
  misc_feature (230)..(230): n is a, c, t, g, unknown, or other
  misc_feature (244)..(244): n is a, c, t, g, unknown, or other
  misc_feature (379)..(379): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcmngtawggcacgggtncccccgtctacctcgccgccgtcctggagtacctcgcggccgagttgctcgarctcgccggcaacgscaagggacaacaagaagacgcgcatcattccgcgccacgtgctcctcgccatccgcaackacgagganctcggcaacttctggccggcgtcaccatcgcccackac

SEQ ID NO: 1817 - protein, 138 aa, Zea mays
  misc_feature: Ceres CLONE 246921-F
  misc_feature (47)..(47): Xaa is any aa, unknown, or other
  misc_feature (77)..(77): Xaa is any aa, unknown, or other
  misc_feature (78)..(78): Xaa is any aa, unknown, or other
  misc_feature (82)..(82): Xaa is any aa, unknown, or other
  misc_feature (104)..(104): Xaa is any aa, unknown, or other
  misc_feature (124)..(124): Xaa is any aa, unknown, or other
  misc_feature (127)..(127): Xaa is any aa, unknown, or other
THTFRLSTPKVPFFFSIWKRRSSSHGRERTGGKAKKGAAGRKAGGRXKKSVSRSSRAGLQFPVSRVGRTSKRAGTRXXGTGXPVYLAAVLEYLAAELLELAGNXKGQQEDAHHSAPRAPRHPQXRGXRQLLAGVTIAH

SEQ ID NO: 1818 - DNA, 417 bp, Zea mays; identical to SEQ ID NO: 1816
  misc_feature: Ceres CLONE 246921-F2
  misc_feature (139)..(139): n is a, c, t, g, unknown, or other
  misc_feature (230)..(230): n is a, c, t, g, unknown, or other
  misc_feature (244)..(244): n is a, c, t, g, unknown, or other
  misc_feature (379)..(379): n is a, c, t, g, unknown, or other

SEQ ID NO: 1819 - DNA, 478 bp, Zea mays
  misc_feature: Ceres CLONE 246935-F
  misc_feature: Encodes the peptide sequence at SEQ ID NO. 1820
  misc_feature (97)..(97): n is a, c, t, g, unknown, or other
  misc_feature (357)..(357): n is a, c, t, g, unknown, or other
attccacccgcttcccccagccgcacgaaaccctaacgccgccgccgcttcacaggtaagccgccgtcatggtctccggttccggcgtatgcgcgancgttggtggacgcgcgccaccgcatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaagatcctgtggcgcaccatccgcgggatgattccgcacaagaccaanaggggggaggcggctctggcgaggctcaagacgtacgagggcgtcccgcgccgtacgacaagaccaagcgcctggtcatccctgacgctcttaaggtcctgaggctgcaacctggacacaa

SEQ ID NO: 1820 - protein, 112 aa, Zea mays
  misc_feature: Ceres CLONE 246935-F
  misc_feature (1)..(106): Pfam Name: Ribosomal_L13 Pfam Description: Ribosomal protein L13
  misc_feature (79)..(79): Xaa is any aa, unknown, or other
MLGRLSSIIAKELLNGQKVVVVRCEEICMSGGLVRQKMKYLRFLRKRMNTKPSHGPIHFRAPSKILWRTIRGMIPHKTXRGEAALARLKTYEGVPRRTTRPSAWSSLTLLRS

SEQ ID NO: 1821 - DNA, 496 bp, Zea mays
  misc_feature: Ceres CLONE 246941-F
  misc_feature: Encodes the peptide sequence at SEQ ID NO. 1822
ttttccagtggtgactggtgagtggtctctctctgtgctcgcgcttcgtccagcttccccggccggaagaggtagcacggcaagggcagaggatgagtgaccccaagtacgcctacccctaccctgcgcaaggttactaccaggggccgtaccagggcccgccggtgatggcgccgcacagtacgccgcgccgccgcccagaagggagccgagcttcctggaagctgcctggccgcgctgtgctgctgctgcttgatcgacgagtgctgctgcgacccgtccatcatcttcgtcagctagactagacgaggaagaacctattggtatatataatatgtatgtatccagttgtactcttagctttattcctgcaaccttcaagctcgagatgatctgtatctcggtcgagttggtgtgtatgtgtcatctgtatcaactatcatcctgtcattgtattgcttctaatttgctgctgaatcgagaacattattcgccg

SEQ ID NO: 1822 - protein, 70 aa, Zea mays
  misc_feature: Ceres CLONE 246941-F
MSDPKYAYPYPAQGYYQGPYQGPPVMAPHSTPRRRPEGSRASWKLPGRAVLLLLDRRVLLRPVHHLRQLD

SEQ ID NO: 1823 - DNA, 429 bp, Zea mays
  misc_feature: Ceres CLONE 246950-F
  misc_feature: Encodes the peptide sequence at SEQ ID NO. 1824
  misc_feature (110)..(110): n is a, c, t, g, unknown, or other
  misc_feature (113)..(113): n is a, c, t, g, unknown, or other
aatttcaacacacaactggacgacggtgcgttgcgttggtggccgccggcgacgatgtcgtctcccgcgggcgacaagaggaagaagacggcgtgcgtgaccggaggacnggntacatcggctccgcgctcatcaagatgctgctggaggacggatacgccgtcaagacgacggtcaggaacccagactacatggacaagaactcccacctcaagggcctgcagcagctcgggccgctgacggtcctccgcggcgacatggacgaggagggcagcttcgacgacgccgtsccggctgcgactacgtcttcctcgtcgccgcaccggtgaacctcgcagcacagggatccagagaaagagcagatcgagccgtccgtccgaggcacgctgaacgcgatgaggtcgtgcgcgaaggccgggacgttcggcg

SEQ ID NO: 1824 - protein, 108 aa, Zea mays
  misc_feature: Ceres CLONE 246950-F
  misc_feature: SWISSPROT Homolog: EC 1.3.1.77 Anthocyanidin reductase
FQHTTGRRCVALVAAGDDVVSRGRQEEEDGVRDRRTGYIGSALIKMLLEDGYAVKTTVRNPDYMDKNSHLKGLQQLGPLTVLRGDMDEEGSFDDAVPAATTSSSSPHR

SEQ ID NO: 1825 - DNA, 1683 bp, Zea mays
  misc_feature: Ceres CLONE 246957
  misc_feature: Encodes the peptide sequence at SEQ ID NO. 1826
ccctttattcctccttggcaaggccatgccaccgtcgagcccaggaggcggaagtcaacgtaaccaagcgaacccatccatggcctccgctgctgccgtcgtctccctcaacgtcggcggcgagatcttccagaccaccaccgccacactttcccgcgccggcgcctcctccccgcttgcctccctcggtccctcctccccgtctgctccgcacttcctcgacggcgacccgcgcctctttgcccaactcctatccttcctccgccatggccgcctccttgctccgtcctatccctcagccacgctcctcgctgaggcgcgccacttcgcgctcgatggcgccctcctcgcttctctctccccggcctccgcctttgccccgctctcgctgcgcccttccgcgctcctcccgctcaccggccgcgtcgcgccctccgccgtagcgctgtgcccctcgccgcctcacccggtctccctcgtcgccgcacacggtggggtcgtcacctgcttcgacgccgcgctcgcctcccgcaccagcgtcctcacgccgctgcccgccgttgactcgctcgccgcggtgtcccccgtcctcgccctcgccggcgcccgcgacttccacggggtccacctctgccggttctccgacgacgcctccgccggctgtactgatccgaatgtgctttcgtggccgggatcgccctccgccaccgtgctgtccatggccactacgaccgcgtcagaagcaccgtcgccaccctggctcttctccagcttcgagtcagcgcggcggaactcgagtgccgtggtggtgttcgacctcaattccttgtctcctgtggtggaaatcgggcggaaggaggtgttcggcgcggacatcgaggctgcgatcccagcgagcaagctcgcgtggcttggtgggcacagcctccttctcgccgctggctctcactctggcccggccggggtagtgggggacatacgtctctgggatgtccgggcgagcgccacggtgccagtgtgggaggtcagggagaaggaggattgctttgctgatgttgcggcgtctgacgcactgtcagcggtgttcaaggtgggtgcagcatccagtgaggtgttcatggctgacctgaggaggcttggtaacggtggtggcgttggattggagccatgggtgtgcattggcgatggacagaaggcggctgcagccgcatcatctggaaggaaagagaggaatggttgtagaattgagtgctactgcagttgggtgtttgtggcacggggcgcggacgtcgaggtgtggagtcaggtgggattggcaccagaagccggtggaaagaaggtgatgaggaggaattgggttggcagtgaactatccacaaagcccaagattgtgagctgggcatttggtggcagcaggatggcattggccagagctgatcagctgtctgtggagatatgggatagtgctacagcagcaattggcgcaaacccctgagtagagggaggatatcgcaaaagcaagccgacgcttgtcaatgttcaattgctgcttgttcctctatgcaatgtaaatttactttagcgtgttgtttgtgttgtatcccagatagttagaatcttgaatgcaatgcctggaaggtatggaatgattttactggggttgaacaaaaaaaaaaaaaaaaa

SEQ ID NO: 1826 - protein, 489 aa, Zea mays
  misc_feature: Ceres CLONE 246957
  misc_feature (26)..(111): Pfam Name: K_tetra Pfam Description: K+ channel tetramerisation domain
MPPSSPGGGSQRNQANPSMASAAAVVSLNVGGEIFQTTTATLSRAGASSPLASLGPSSPSAPHFLDGDPRLFAQLLSFLRHGRLLAPSYPSATLLAEARHFALDGALLASLSPASAFAPLSLRPSALLPLTGRVAPSAVALCPSPPHPVSLVAAHGGVVTCFDAALASRTSVLTPLPAVDSLAAVSPVLALAGARDFHGVHLCRFSDDASAGCTDPNVLSWPGSPSATVLSMATTTASEAPSPPWLFSSFESARRNSSAVVVFDLNSLSPVVEIGRKEVFGADIEAAIPASKLAWLGGHSLLLAAGSHSGPAGVVGDIRLWDVRASATVPVWEVREKEDCFADVAASDALSAVFKVGAASSEVFMADLRRLGNGGGVGLEPWVCIGDGQKAAAAASSGRKERNGCRIECYCSWVFVARGADVEVWSQVGLAPEAGGKKVMRRNWVGSELSTKPKIVSWAFGGSRMALARADQLSVEIWDSATAAIGANP

SEQ ID NO: 1827 - DNA, 228 bp, Zea mays
  misc_feature: Ceres CLONE 247052-F
  misc_feature: Encodes the peptide sequence at SEQ ID NO. 1828
  misc_feature (19)..(19): n is a, c, t, g, unknown, or other
  misc_feature (79)..(79): n is a, c, t, g, unknown, or other
gccgacgcakbcacaagcnatgaagcgcttcttccagccagtgcccaaggacggctccccgtcaagaagcggctascgngtgttgctgaaccgggcgacggcccacatcagccggtkccgccaccgcttggcggggatgtagaggggaggcccaccgaggagccgttcaagttcctgacgtggaacgccaacagcctgctcctccggatgaagagcgattggtctgct

SEQ ID NO: 1828 - protein, 76 aa, Zea mays
  misc_feature: Ceres CLONE 247052-F
  misc_feature (4)..(4): Xaa is any aa, unknown, or other
  misc_feature (7)..(7): Xaa is any aa, unknown, or other
  misc_feature (26)..(26): Xaa is any aa, unknown, or other
  misc_feature (27)..(27): Xaa is any aa, unknown, or other
ADAXTSXEALLPASAQGRLPVKKRLXXVAEPGDGPHQPVPPPLGGDVEGRPTEEPFKFLTWNANSLLLRMKSDWSA

SEQ ID NO: 1829 - DNA, 433 bp, Zea mays
  misc_feature: Ceres CLONE 247099-F
  misc_feature: Translation starting site: 105
accacttgcattcacacactcgattccgctgctctctccctcttcctctcccccgcggcggacataaaaccctaggcctcgccgtcgtcggaggcgccgccgcgatgtcgcactttggaaggacgggtccgccggacatccgcgacaccttctcgctgctcgtcctcaacatcagcttccgaaccacggccgacgaccttttcccgctcttcgasscttgcgcaaggtcgtcgacgtcttcatcccgagggaccgcagaccgggggactcgaggggttttgcgttcgtgcggtacaagtacgccgacgaggccagaaggctatagatcggctcgatggccgtaatgtggatgggaggaacatcatggtgcagtttgcaaagtacggccccaatgctgtgccaatccacaaaggaaggggtcaaagagggggtt

SEQ ID NO: 1830 - DNA, 343 bp, Zea mays
  misc_feature: Ceres CLONE 247154-F
  misc_feature: Encodes the peptide sequence at SEQ ID NO. 1831
  misc_feature (271)..(271): n is a, c, t, g, unknown, or other
  misc_feature (275)..(275): n is a, c, t, g, unknown, or other
agagagaatcaaaatcactttgcgtgcagcatcgattgggtcggaaatcgagggtttggtaagcgagatcgccgccggtgacagctgacagggacgagatggacgccggcggaggcggctcttggtcgccgttctctgcatgctgctggtcttcgccatcttccccctcctcctctggcgccgcgctccgatgccgccaccgccgataaccaccgcgtcccgccccakyyccctccaggaggatcaggtgctgcacggtcgcgcggcggcnaggnaatgcgtcggaggcctggggctgccggagcaggctcctctactgcgtcaactagccgcaatgctgtag

SEQ ID NO: 1831 - protein, 50 aa, Zea mays
  misc_feature: Ceres CLONE 247154-F
  misc_feature (13)..(13): Xaa is any aa, unknown, or other
  misc_feature (14)..(14): Xaa is any aa, unknown, or other
  misc_feature (29)..(29): Xaa is any aa, unknown, or other
MPPPPITTASRPXXLQEDQVLHGRAAARXCVGGLGLPEQAPLLRQLAAML

SEQ ID NO: 1832 - DNA, 129 bp, Zea mays
  misc_feature: Ceres CLONE 247164-F
aattctstttcttctttctcctcccaataaacacacccacccggtcgctccgctccaccgttccgccctcgaccgcgcggagctcctcaacccttcggacctccgcctcccaccgcttccgtagcctcg

SEQ ID NO: 1833 - DNA, 254 bp, Zea mays
  misc_feature: Ceres CLONE 247178-F
  misc_feature: Translation starting site: 33
  misc_feature (124)..(124): n is a, c, t, g, unknown, or other
aaaaccatccattaccatattcctaagctatcatggtgcaccggacttccatagccgatgtgcatgtkatgtgcatggatctaagcccaaagaaacccaacaaggccagcgccadtcggcggantatctacgactggtcccccgccgatctgcccatgctcggcgttgctccattggtgccgccaagctctgccttcaccgccggagtcttgccctacccagctactccgactctgccaagatcgcctacgtcc

SEQ ID NO: 1834 - DNA, 428 bp, Zea mays
  misc_feature: Ceres CLONE 247187-F
  misc_feature: Encodes the peptide sequence at SEQ ID NO. 1835
atctccctgtttaatcaatccttcaagcgcaakgcctcctcctcgtcgtccggtcgtgagaagggatggcgggccgtggcaaggctatcggcgctggcgccaagaaggcaacgtcgaggagctccaaggccggactccagttccccgtcggcaggattgctaggttcctcaaggcgggcaagtacgctgagcgcgtcggcscggcgcccccgtgtacctcgccgccgtcctcgagtacctcgcggctgaggttctcgaacttgccgggtaacgccgcgagggkacaacaagaagacccgcattttgccgcgccacatccagcttgctgtgcgcaacgacgaggagctaaccaaactgttgggtggtgccaccatcgcgagcggaggtgtttatgcctaacatccatcagcatctgctccccaagaagg

SEQ ID NO: 1835 - protein, 121 aa, Zea mays
  misc_feature: Ceres CLONE 247187-F
  misc_feature (46)..(46): Xaa is any aa, unknown, or other
  misc_feature (73)..(73): Xaa is any aa, unknown, or other
MAGRGKAIGAGAKKATSRSSKAGLQFPVGRIARFLKAGKYAERVGXAPPCTSPPSSSTSRLRFSNLPGNAARXQQEDPHFAAPHPACCAQRRGANQTVGWCHHRERRCLCLTSISICSPRR

SEQ ID NO: 1836 - DNA, 351 bp, Zea mays
  misc_feature: Ceres CLONE 247199-F
  misc_feature: Translation starting site: 61
  misc_feature: SWISSPROT Homolog: EC 3.4.25.1 Proteasome endopeptidase complex
  misc_feature (8)..(8): n is a, c, t, g, unknown, or other
  misc_feature (239)..(239): n is a, c, t, g, unknown, or other
  misc_feature (319)..(319): n is a, c, t, g, unknown, or other
aaacgcgngacacaaacacacaccagcccagctccgagagatcatccggcggccggcgagatgagccgcggcacgggcgcgggttatgaccgccacatcaccattttctcccctgagggacgcctgtaccaagtcgagtacgcgttcaaggcggtgaagtcggcgggtgtcacgtcgatcggcgtccgcggcgsattccgttctgcgtcgtcacccagaagaaattcccggacaakttnctggatcagacgagcgtgacacacttgttcccgatcaccaagttacgtcggattgcttgccactggcctcacagctgatncaaggtcattggtttcccaagcaaggaacgaa

SEQ ID NO: 1837 - DNA, 475 bp, Zea mays
  misc_feature: Ceres CLONE 247203-F
  misc_feature (317)..(317): n is a, c, t, g, unknown, or other
aktccaccaccacacaagaagaggcccccagccagccagtccacagctctccactcgagaaacctccagtccagctccacccttcgtccagaggcacaccacacacaccatggctcccagcaagcttgcgtggtcgtcgccttgatagcgtcgctcctcctgctcaccaccagcaacaccaagcttggcctgttcgtgctcggccaggctgctccgggcgcctacccaccacgggctcctccgccgcaccagatcgtcgaccccgccaaagactgcgggggcgcgtgcgacgtgcggtgcggcgcgcactcgsaagnaacatctgcacccgggcgtgcctcaagtgctgcggcgtctgstcgttgccggcgggcavtccggcaaccagcagacctgcgcaagtgctacaccgactggaccacgcacggcaacaagaccaagtgcccgttgactccttgtccttgatgagagcagc

SEQ ID NO: 1838 - DNA, 464 bp, Zea mays
  misc_feature: Ceres CLONE 247219-F
  misc_feature: Encodes the peptide sequence at SEQ ID NO. 1839
aggatttgcaacccatttctctcctcgactcccacaacacggtccgtacggtaaagagagagaaggtgggagtggaatcgacaggggaaaaccaagcctgcgtttcagagacaactcaggcggcgcgatggcgatggcggcgctgcgacsgaggggaggcgcctcctcctctcccccaccgtccccaacccgtcttcggcggccgcttccgctgcggtgacsgatcctccgccatgtcgcaaccggagatggctccacttggtgcacgttctatttcaactcaagttgtgaggaaccggatgaagagtatcaaaaacatccagaagatcacaaaggctatgaagatggttgcagcatcaaagcttcgggctgttcagacgaggactgaaaattcacgcggcttgtggcagccgttcaccgcccttcttgggacgctcctagtgttgatgtcaagaagaatgtga

SEQ ID NO: 1839 - protein, 76 aa, Zea mays
  misc_feature: Ceres CLONE 247219-F
  misc_feature: SWISSPROT Homolog: EC 3.6.3.14 H(+)-transporting two-sector ATPase
MSQPEMAPLGARSISTQVVRNRMKSIKNIQKITKAMKMVAASKLRAVQTRTENSRGLWQPFTALLGTLLVLMSRRM

SEQ ID NO: 1840 - DNA, 478 bp, Zea mays
  misc_feature: Ceres CLONE 247229-F
  misc_feature: Encodes the peptide sequence at SEQ ID NO. 1841
  misc_feature (357)..(357): n is a, c, t, g, unknown, or other
  misc_feature (402)..(402): n is a, c, t, g, unknown, or other
  misc_feature (412)..(412): n is a, c, t, g, unknown, or other
  misc_feature (419)..(419): n is a, c, t, g, unknown, or other
ccagcaccaagcggcgagagcgggacggggcagagcaagagctagggataaccctcgcccaccatggcgacgccggcgagcagcaggcaccggctgcgcggagtaggtcgtgtccgtcgagatgcctgcacccgacggtgtaccaagaagtttactccccagagagggggaagatccgagattgtttttgtttcgccaactggcsaggaaattaagaacaagaggcaactaagccaatacctaaaggcacaccctggaggccctgctgcttcagattttgattggggaactggtgataccccaaggcgttctgctcgcattagcgaraaagtcaaggtttttgatagcccagagsangaagatcccgaaacgcagcaggaactccagtggtaggaagggtangcagggaaanaaggaancccctgaaactgaagaagccaaagatgctgaaaccggccaggacgccccaagtgaagat

SEQ ID NO: 1841 - protein, 109 aa, Zea mays
  misc_feature: Ceres CLONE 247229-F
  misc_feature (1)..(82): Pfam Name: MBD Pfam Description: Methyl-CpG binding domain
  misc_feature (48)..(48): Xaa is any aa, unknown, or other
  misc_feature (98)..(98): Xaa is any aa, unknown, or other
MATPASSRHRLRGVGRVRRDACTRRCTKKFTPQRGGRSEIVFVSPTGXEIKNKRQLSQYLKAHPGGPAASDFDWGTGDTPRRSARISEKVKVFDSPEXEDPETQQELQW

SEQ ID NO: 1842 - DNA, 109 bp, Zea mays
  misc_feature: Ceres CLONE 247230-F
  misc_feature: Encodes the peptide sequence at SEQ ID NO. 1843
aaaggaagaaaataataagaaaaatactcccgtgttcttcgaccggcggcggtggtgcgamgagggcggttaagggagacgagatgagggggacgaagcggccgctcgg

SEQ ID NO: 1843 - protein, 35 aa, Zea mays
  misc_feature: Ceres CLONE 247230-F
  misc_feature (20)..(20): Xaa is any aa, unknown, or other
RKKIIRKILPCSSTGGGGAXRAVKGDEMRGTKRPL

SEQ ID NO: 1844 - DNA, 438 bp, Zea mays
  misc_feature: Ceres CLONE 247246-F
  misc_feature (135)..(135): n is a, c, t, g, unknown, or other
  misc_feature (375)..(375): n is a, c, t, g, unknown, or other
  misc_feature (387)..(387): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcrbtttaggcacgggtgccccgtctacctcgccgccgtcctggagtacctcgcggccgaggtgctcgagctcgccggcaacgcscaagggacaacaagaagacgcgcatcattccgcgccacgtgctcctcgccatccgcaacgacgagganctcggcaatctnctggccggcgtcaccatcgcccacggcgcgttcctccccaacatccacact

SEQ ID NO: 1845 - DNA, 231 bp, Zea mays
  misc_feature: Ceres CLONE 247288-F
  misc_feature (120)..(120): n is a, c, t, g, unknown, or other
  misc_feature (184)..(184): n is a, c, t, g, unknown, or other
  misc_feature (193)..(193): n is a, c, t, g, unknown, or other
atcgcagaaattctccgcaacttcacagcgtatcatcgttttccatcgctcctactcctatcatccagaaaatctgagcggtattgatggcgcccaaggcggtagaagaagccggcgsrnagaaggtggcggaggaggagccctcggagaaggcggctccggcggagaaggcccccgcggtaanaaggccaangcggagaagcggctacctgcgggcaagtccgccggcaa

SEQ ID NO: 1846 - DNA, 500 bp, Zea mays
  misc_feature: Ceres CLONE 247290-F
  misc_feature: Translation starting site: 90
  misc_feature (267)..(267): n is a, c, t, g, unknown, or other
aacagccctacaacttactgcttgctctagctagctagctgctcccggcccatatccactacacaagtaggctakcagcagcagcagcaatggcctcggtgacgrgttcccggccgtggcctcgtcctgctgctcgccgccagcgccttcctggccagcgaggtggcggcgtgcggcggctgccgaaaccaactcctcctcctccatcgccaccaccgccgtcgcccaccagcacgccgtscctccgccaccgtccagctccggcgncaagtgccccaagaacgcgctgaaactgggcgtgtgcgcaacgtgctgggcctcgtcaaggtgtccatcggcaaggtgcccaccgactcgtgctgcccgctgctggacggcctcgccgacctggaggccgccgtctgcctctgcaccgcgctcaaggccaacgtgctcggcatcaacctcgacgtccccgtcaagctcaccctgctcctcaactactgcggcaagagcgtccc

SEQ ID NO: 1847 - DNA, 461 bp, Zea mays
  misc_feature: Ceres CLONE 247301-F
  misc_feature: Encodes the peptide sequence at SEQ ID NO. 1848
  misc_feature (171)..(171): n is a, c, t, g, unknown, or other
  misc_feature (173)..(173): n is a, c, t, g, unknown, or other
  misc_feature (325)..(325): n is a, c, t, g, unknown, or other
  misc_feature (327)..(327): n is a, c, t, g, unknown, or other
  misc_feature (339)..(339): n is a, c, t, g, unknown, or other
  misc_feature (403)..(403): n is a, c, t, g, unknown, or other
agtttcgaaaaccaaatctctctgtctactaggcgggagagtgagacggccatggcggaggcgcaascttagtaccggcgcaaggtcccgacgaggcgcccctcgatgcgtccgccattcagagccgggtggagcagctctcattgaaaaggctggaggtggagccgassnanggtggcggaggatgaggtggcactaggtttggactccacgcacaaggcggctcaggatgcgatggatgaktgggactcggccactgctgcggtttcaattgatgatttggatgcatacctggaacaactgagaaaggatgtagccatggcanancaggggaatcanaaggtatctggtgagattagtgtcactgcagagacaacattcaatgatatgattcaattggatnttggtattaaaatctggagtctttgatttcgaaatcttggtccaaaggctttgaacca

SEQ ID NO: 1848 - protein, 64 aa, Zea mays
  misc_feature: Ceres CLONE 247301-F
  misc_feature (3)..(3): Xaa is any aa, unknown, or other
  misc_feature (31)..(31): Xaa is any aa, unknown, or other
  misc_feature (35)..(35): Xaa is any aa, unknown, or other
  misc_feature (57)..(57): Xaa is any aa, unknown, or other
MDXWDSATAAVSIDDLDAYLEQLRKDVAMAXQGNXKVSGEISVTAETTFNDMIQLDXGIKIWSL

SEQ ID NO: 1849 - DNA, 229 bp, Zea mays
  misc_feature: Ceres CLONE 247315-F
  misc_feature (137)..(137): n is a, c, t, g, unknown, or other
  misc_feature (204)..(204): n is a, c, t, g, unknown, or other
actcatacatttcgactctcaactcccaaggtcccttttttttctcgatctggaagcgccgcagtagcagccatggacgtgagcggasaggcggtaaggcgaagaagggcgcggcggggccaaggycggcgggcgancgaagaagtcggtgtcgcggtcctccagggccgggctgcagttccccgtcagccgcgtcgggcggtnacctcaaaaagggccggtacgcgca

SEQ ID NO: 1850 - DNA, 463 bp, Zea mays
  misc_feature: Ceres CLONE 247346-F
  misc_feature: Translation starting site: 303
acaaacctctcctggcacgagatcacgcttctcgtcggatcgaacagctagggtttccaagatgttcgggcgcgcgcgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaa

SEQ ID NO: 1851 - DNA, 479 bp, Zea mays
  misc_feature: Ceres CLONE 247386-F
  misc_feature: Encodes the peptide sequence at SEQ ID NO. 1852
gtattcgtcttgctccagccgccgtcggatcggatccgatcaaagcaagcagcagcagccggctccgctcccgcagcagccacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtccccctggcaatactgg

SEQ ID NO: 1852 - protein, 120 aa, Zea mays
  misc_feature: Ceres CLONE 247386-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPLAIL

SEQ ID NO: 1853 - DNA, 453 bp, Zea mays
  misc_feature: Ceres CLONE 247428-F
  misc_feature (180)..(180): n is a, c, t, g, unknown, or other
  misc_feature (229)..(229): n is a, c, t, g, unknown, or other
  misc_feature (422)..(422): n is a, c, t, g, unknown, or other
cagaagtccagaccaaagccccaaagtccaatccctcgctagccacttgccatctgatcaaccagccagccgatctcagcgatccgccatggccaccgcgtattacgagaggccccgtkgcggcgcgtcgaggaggcggacgacttcgatgagttcgaccccacgccgtacgsktgggtnacgacctcgccgtcaccttcggtcgcccgctgccaccgaccgaggaaanctgctacccgtgctcggcgccctcgacctcctacgacgcaccgcactacgccgcctccgagccgtccccctacggtcaccacgccaagccaaaggcccaactacgggttccgccccagcaggagcaacagccgtcttacggcagcggctacggatccaggcccgagccgctgcggaggagggcggtggctatngatctggcttcggatccgggtatgggaggaa

SEQ ID NO: 1854 - DNA, 167 bp, Zea mays
  misc_feature: Ceres CLONE 247472-F
  misc_feature (85)..(85): n is a, c, t, g, unknown, or other
aawkgtcccggcagaagaactttgcgggcgaaaggcgaaaccgacgtgctcccgggcgggcggcgacacggtcatggagcgaganscaggcagtggcgaggaacaggaaggtgttgctgcgcgggtacatcgaccgcgcgcccagggaggaagacatkgagctcgtc

SEQ ID NO: 1855 - DNA, 500 bp, Zea mays
  misc_feature: Ceres CLONE 247477-F
  misc_feature: Translation starting site: 113
  misc_feature: Pfam Name: Arginase Pfam Description: Arginase family
  misc_feature: SWISSPROT Homolog: EC 3.5.3.1 Arginase
  misc_feature (169)..(169): n is a, c, t, g, unknown, or other
  misc_feature (244)..(244): n is a, c, t, g, unknown, or other
  misc_feature (301)..(301): n is a, c, t, g, unknown, or other
  misc_feature (424)..(424): n is a, c, t, g, unknown, or other
  misc_feature (429)..(429): n is a, c, t, g, unknown, or other
attcgtgatcgaaccagactcgagagggagaggaggagggagtccgaggggagagacccaattaactgcagggattggtcgggttcggctccgcttcggagagtcccaagagatgggtggcgcggcggcgggtaccaagtggatccaccacatccagcgcctcagcsgnccaaggtgtcggcggaggcggtggagcggggccagagccgcgtcatcgacsctccctcaccctaattcgcgagcncgcaaagctcaaggcagagttgctgcgtgctctgggtggcgtgaaagcttcagcgtncgctcttaggggtccctcttggtcacaactcatcctttttacaaggccctgcatttgctcctccacgcatacgggaggccatttggtgtggaagcacaaactctagcacagaggaaggcaaanaattnaattatcctcgggtgctaactgatgttcgagatgtccccattcacgagatccgtgactctgggtgtcgaag

SEQ ID NO: 1856 - DNA, 169 bp, Zea mays
  misc_feature: Ceres CLONE 247491-F
agagtctctctctttctctcgagtytcgacacaccacagcggaakgcttcgactcgctgagtgacaagacgcgacgsacgccaagccaagaccaaattaccaaaccctaccccttcgccgcgaccgcgatcccccacatcgttggcgatgagctcctcctccaacagcg

SEQ ID NO: 1857 - DNA, 417 bp, Zea mays
  misc_feature: Ceres CLONE 247521-F
  misc_feature: Encodes the peptide sequence at SEQ ID NO. 1858
  misc_feature (169)..(169): n is a, c, t, g, unknown, or other
  misc_feature (206)..(206): n is a, c, t, g, unknown, or other
  misc_feature (227)..(227): n is a, c, t, g, unknown, or other
gataacccagagacctcgagaacggctggaagaaccgagagcgctccggaaatttcggcgggtgarctgcggttggagctggacgagctgcggcgctggagagctcgccaagcacccccgcgtccagatcctcctcgccaacgaaatccgcaacgtttaagcgaagttngcgaaggcaaccgaaccatcgcctgagccactggcgncggcttctgcgccacgcccgnkcccgctgcskkcctgttttaagctacgtcactcttgggtcgttcagctgggagcaggacaacgagaagattaggatatatgtttcccttgabggagttttagcaagagaaggtggagactactttcaagccaacatcagtggatataaagtttcatgatgtcaaaggcaagaattaccggtgtgctata

SEQ ID NO: 1858 - protein, 52 aa, Zea mays
  misc_feature: Ceres CLONE 247521-F
  misc_feature (22)..(22): Xaa is any aa, unknown, or other
ITQRPRERLEEPRALRKFRRVXCGWSWTSCGAGELAKHPRVQILLANEIRNV

SEQ ID NO: 1859 - DNA, 417 bp, Zea mays; identical to SEQ ID NO: 1857
  misc_feature: Ceres CLONE 247521-F2
  misc_feature: Pfam Name: CS Pfam Description: CS domain
  misc_feature (169)..(169): n is a, c, t, g, unknown, or other
  misc_feature (206)..(206): n is a, c, t, g, unknown, or other
  misc_feature (227)..(227): n is a, c, t, g, unknown, or other

SEQ ID NO: 1860 - DNA, 464 bp, Zea mays
  misc_feature: Ceres CLONE 247537-F
  misc_feature (136)..(136): n is a, c, t, g, unknown, or other
actcgccctcccacacagaaaaccctagccgccgccaccgaagcggcctcccaggtaagcaggagcgtccaccccgccgccgtcatgaagcgcaatccccgcgtcacgagctcccgccggaagtgccgcaayscanctttacggccccgtcctccgtccgccgcgttctcatgtccgccgggctgtcgacggagctccgccacaagtacaacgtgcgctccatcccgatccgcaagacgacgaggtgcagatcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaagcgctcctggaccgcaagcccggggcgcgcgccgacaa

SEQ ID NO: 1861 - DNA, 423 bp, Zea mays
  misc_feature: Ceres CLONE 247542-F
  misc_feature: Translation starting site: 135
  misc_feature: Pfam Name: Cyt-b5 Pfam Description: Cytochrome b5-like Heme/Steroid binding domain
  misc_feature (288)..(288): n is a, c, t, g, unknown, or other
  misc_feature (300)..(300): n is a, c, t, g, unknown, or other
  misc_feature (417)..(417): n is a, c, t, g, unknown, or other
attcactttccaagttgtccgaaaagaccagactaccctgttcccccgaagtcagakggggagaggaggctagggatakagcagcgtcatcgcaccgctcgccggcgacyagatcatcagtgaggaasgcagcgatggcggtggtggagctgtgggagacgcttaakcaggcgatcgttgcgtacacgggcctgtctccggcggccttcttcacggctgtgcggtggcggccgctctgtaccacgttgtgtcggggctcttcgcggcccgcccccgcygcygcygcgnycacgggatgancccgagacagagccgctccctcctcccgtgcakattggggacgtctccgaggaggacctccgccagtacgacggctccgaccctaagaagccgctcctcatkgccatcaagggccanatctac

SEQ ID NO: 1862 - DNA, 491 bp, Zea mays
  misc_feature: Ceres CLONE 247550-F
  misc_feature: Encodes the peptide sequence at SEQ ID NO. 1863
actttttccgaagcttctcgaccccccatcccctccctgacatggccgacaacgcgaaggccgcggcggcgcatgckaggccggagtcgtcgcaggaggaggaggaggactggaaggaggccgagggggacgtcgccgaagtcgaccgcgccgctaccaatggcgccggcgaggggggcgtgcccacagacaggccgatccgggtctacgccgacggcatctacgacctcttccacttcggccacgccaagtcgctggagcagcccaagaagtcgtttccaaacacatatcttcttgttggatgctgcaatgatgagttgacacataaattcaaaggaagaactgttatgactgaggatgagcgatatgagtcacttcgtcattgcaagtgggttgatgaagtcattccagatgctccatgggtggtgacagaagagttcttggataagcataacattgattttgttgctcatgattctctgccgtatgct

SEQ ID NO: 1863 - protein, 150 aa, Zea mays
  misc_feature: Ceres CLONE 247550-F
  misc_feature (56)..(150): Pfam Name: CTP_transf_2 Pfam Description: Cytidylyltransferase
  misc_feature: SWISSPROT Homolog: EC 2.7.7.15 Choline-phosphate cytidylyltransferase
MADNAKAAAAHARPESSQEEEEDWKEAEGDVAEVDRAATNGAGEGGVPTDRPIRVYADGIYDLFHFGHAKSLEQPKKSFPNTYLLVGCCNDELTHKFKGRTVMTEDERYESLRHCKWVDEVIPDAPWVVTEEFLDKHNIDFVAHDSLPYA

SEQ ID NO: 1864 - DNA, 435 bp, Zea mays
  misc_feature: Ceres CLONE 247561-F
  misc_feature: Translation starting site: 201
  misc_feature: SWISSPROT Homolog: EC 3.1.3.16 Phosphoprotein phosphatase
  misc_feature (273)..(273): n is a, c, t, g, unknown, or other
acaagctctttggaggagtagagacttccagccatcccttctacgctctccccgttcccgtgtcgtcctcccgacaaagagggagccgctaggtttagcggcttccgcttctgggcgagggcttacccgcgaggacggcgcgacgcggcggcacttgagctagggtttccctccgatcccgttcctttcccggcgaggcgatggacgaggcggcgattracgacttgatccggcggctcctcgaggcccgcggcgggcgcaccccgcgcaacnaggtgactgacgccgagatccggcgcctctgcgcaaccgccaaggacgttttcctctcccagcccaacctcctggagctcgaggcccccattaagatatgcgggggatttccatggccagtattcagacctccttcgattatttgagtatggtggctatcca

SEQ ID NO: 1865 - DNA, 127 bp, Zea mays
  misc_feature: Ceres CLONE 247563-F
acacgcacaccgcgacccagtccagagccagtacgtgcgamggcacgcacgctgctggtccgcgtacsaggacgacggtcaggtcggccggtgcttttcagtttggaataatgacggcgacgacgac

SEQ ID NO: 1866 - DNA, 198 bp, Zea mays
  misc_feature: Ceres CLONE 247564-F
  misc_feature: Encodes the peptide sequence at SEQ ID NO. 1867
acacacaaacacacaatggcaccagwwacgatgctcctcggcgtctgtgccgtgctgatggtggtcggcgtcacgtacgcggcggagggccagtkgcgtcggtcgtcgttggccttgcgagttgcgccgacagcacgaggaagaacatkaaggctgaggccgggtttcaagggtcttcaggtggmgatcaagtgcaag

SEQ ID NO: 1867 - protein, 61 aa, Zea mays
  misc_feature: Ceres CLONE 247564-F
  misc_feature (4)..(4): Xaa is any aa, unknown, or other
  misc_feature (27)..(27): Xaa is any aa, unknown, or other
  misc_feature (45)..(45): Xaa is any aa, unknown, or other
  misc_feature (57)..(57): Xaa is any aa, unknown, or other
MAPXTMLLGVCAVLMVVGVTYAAEGQXRRSSLALRVAPTARGRTXRLRPGFKGLQVXIKCK

SEQ ID NO: 1868 - DNA, 487 bp, Zea mays
  misc_feature: Ceres CLONE 247578-F
  misc_feature: Encodes the peptide sequence at SEQ ID NO. 1869
  misc_feature (211)..(211): n is a, c, t, g, unknown, or other
  misc_feature (215)..(215): n is a, c, t, g, unknown, or other
  misc_feature (298)..(298): n is a, c, t, g, unknown, or other
  misc_feature (305)..(305): n is a, c, t, g, unknown, or other
  misc_feature (367)..(367): n is a, c, t, g, unknown, or other
  misc_feature (376)..(376): n is a, c, t, g, unknown, or other
  misc_feature (443)..(443): n is a, c, t, g, unknown, or other
acggatccaccggagagatctggtctgccattcccacgctccttcctgtgaaccacaaacctaacgcggrsycgcggccggccgccgggcgaggtgcgcgtacctgccgtcgatcgtcgccggatccatccaccatgggcggtggcaacggccagaagtccaagatggcccgcgagcgcaacttggagaagaacaagggggccaagggganccanctcgagaccaacaagaaggccatgagcatccagtgcaaagtgtgcatgcaaacattcatgtgtaccacgactgaagtkaattnccgggancacgccgaggccaagcaccccaagacagacgtgtaccagtgcttcccccatctgaagaagtnaaaggcctnaacttagcaaccagtgctggtttggtcactacgatcgggccagggggcgttccttgtgttgagggtnttcattccgtgttatcttcccgtcagtcatgcgtcctgtcctat

SEQ ID NO: 1869 - protein, 82 aa, Zea mays
  misc_feature: Ceres CLONE 247578-F
  misc_feature (4)..(73): Pfam Name: DUF1909 Pfam Description: Domain of unknown function (DUF1909)
  misc_feature (26)..(26): Xaa is any aa, unknown, or other
  misc_feature (27)..(27): Xaa is any aa, unknown, or other
  misc_feature (55)..(55): Xaa is any aa, unknown, or other
  misc_feature (57)..(57): Xaa is any aa, unknown, or other
  misc_feature (78)..(78): Xaa is any aa, unknown, or other
  misc_feature (81)..(81): Xaa is any aa, unknown, or other
MGGGNGQKSKMARERNLEKNKGAKGXXLETNKKAMSIQCKVCMQTFMCTTTEVNXRXHAEAKHPKTDVYQCFPHLKKXKAXT

SEQ ID NO: 1870 - DNA, 264 bp, Zea mays
  misc_feature: Ceres CLONE 256829-F
  misc_feature: Encodes the peptide sequence at SEQ ID NO. 1871
  misc_feature (32)..(32): n is a, c, t, g, unknown, or other
atattcctcaccggtgaccttcctcacctgcntcagacagagaaagccgagattagcggcggcggcgatggcactcccggcgtcaagctccggcctcttccgcttcgtctccccccgcagtcgtccccagtccaccgacatcgtggccgctgcctcctggggagtcttcgccggcaccgcgcttctacctcgtccagccatttgactggatttaagaagactttcttcgataaacctgaaccagagggcatgaktctcmaggca

SEQ ID NO: 1871 - protein, 45 aa, Zea mays
  misc_feature: Ceres CLONE 256829-F
MALPASSSGLFRFVSPRSRPQSTDIVAAASWGVFAGTALLPRPAI

SEQ ID NO: 1872 - DNA, 173 bp, Zea mays
  misc_feature: Ceres CLONE 256875-F
ggcaatcctctctagctagctcagcatccgacgacgggacttgcacgatggatgctgctctgctcgtcgtctccctcgtcctctgcctgctggggctgccctgcggcgtccsggcsggccttcttcgtcttcggcgactccctcgtcgacaacggcaacaacaactacctgct

SEQ ID NO: 1873 - DNA, 477 bp, Zea mays
  misc_feature: Ceres CLONE 256887-F
  misc_feature: Encodes the peptide sequence at SEQ ID NO. 1874
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcabnntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcac

SEQ ID NO: 1874 - protein, 77 aa, Zea mays
  misc_feature: Ceres CLONE 256887-F
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRASSMLAPNPGKATILALGHAFPQXXVMQDYVVDGFMKNTNCDDPELKEKLTRLCKTTTVRLGTW

SEQ ID NO: 1875 - DNA, 550 bp, Zea mays
  misc_feature: Ceres CLONE 256892-F
  misc_feature: Translation starting site: 322
  misc_feature: Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (171)..(171): n is a, c, t, g, unknown, or other
  misc_feature (200)..(200): n is a, c, t, g, unknown, or other
  misc_feature (201)..(201): n is a, c, t, g, unknown, or other
  misc_feature (542)..(542): n is a, c, t, g, unknown, or other
acctctagctgattgatctctggtatttaccactctttccttccttccttccttcaattctaaataccacaaatcaaagttgctttgcgatggtgagcagcagcatggacacgacgagtgacaagcgtgcgtcatccatgctggcccctaaccctggcaaggccacgatcntcgcccttggccacgccttcccgcagcanntgtcatgcaggactacgtcgtcgacggcttcatgaagaacaccaactgtgacgacccggadctcaaggagaagctcaccagactctgcaagacgacgaccgtkagactcggtacgtggtgatgtcggatgagatcctcaagaactacccggagctggcccaggaggggctgccgacgatgaaccagcgtctggacatctcgaacgcggcggtgacsagattgcgacggaggcgtccctgtcgtgcgtccgctcgttgggcggcgcgctctcgtccattacccaccttgtgtacgttctcgtcgagcgaggcgcgcttcccgggcggsgacctgcacctggngcgcgcct

SEQ ID NO: 1876 - DNA, 452 bp, Zea mays
  misc_feature: Ceres CLONE 256916-F
  misc_feature: Encodes the peptide sequence at SEQ ID NO. 1877
  misc_feature (79)..(79): n is a, c, t, g, unknown, or other
  misc_feature (261)..(261): n is a, c, t, g, unknown, or other
  misc_feature (414)..(414): n is a, c, t, g, unknown, or other
  misc_feature (438)..(438): n is a, c, t, g, unknown, or other
aggtcacgtgaaaagcagtgcaggcgcaagggcaccgccgaggcagaaaagggcggataaactgcttgaactggaagcnaccctagtccaaaccaccgcaccgacaccgactccgagccccgccgcgccgcgctacctccgctcctctcttcgcccctgccggcgtcgaggccgaagcgaaggcgagcatgcatcacgaccccaaccccttcgacgagggcagcgcgaggacaaccccttctcaaatggaggagccggasncaagcagcagtacggcttccggccgactgagcccgtcgggttcggcggcgctacaggggcgacgcgtcgttgacgtcccgctcgagaccatgggggactctcggagcaaggtgaaggagctctcgtcgtgggaatcagatctgaagcggcganaggcggatatcaagaggagggaanaggcgctgaagaat

SEQ ID NO: 1877 - protein, 88 aa, Zea mays
  misc_feature: Ceres CLONE 256916-F
  misc_feature (24)..(24): Xaa is any aa, unknown, or other
  misc_feature (25)..(25): Xaa is any aa, unknown, or other
  misc_feature (76)..(76): Xaa is any aa, unknown, or other
  misc_feature (84)..(84): Xaa is any aa, unknown, or other
MHHDPNPFDEGSARTTPSQMEEPXXSSSTASGRLSPSGSAALQGRRVVDVPLETMGDSRSKVKELSSWESDLKRRXADIKRREXALKN

SEQ ID NO: 1878 - DNA, 404 bp, Zea mays
  misc_feature: Ceres CLONE 256925-F
  misc_feature: Translation starting site: 130
aatccgacgccggacgccccatgatttcgctctcttcttcccgtcgagacccaaccataccagcggcgccgcackgacgagcgaggcggagtagagtggccggactacctcgacacctccactgcaaccatgggtatctcacgtgattcgatgcacaagcgccgggccaccgttggaaagcagaagacgtggcgcaagaagcgaaagtatgagcttggccgccagcctgctaacaccaaactgtctagcaataagacaattgaggagggtccgtgtacgtggaggcaacktaaaktggagggctctccgattggatacaggtaactactcgtggggaattgaggctcttacccgcaaacccgcatcctggatgtggtctataatgcatcaaacaatgagcttkt

SEQ ID NO: 1879 - DNA, 465 bp, Zea mays
  misc_feature: Ceres CLONE 256945-F
  misc_feature: Encodes the peptide sequence at SEQ ID NO. 1880
  misc_feature (384)..(384): n is a, c, t, g, unknown, or other
aaacaatcaataatccgggacttccttgtcacagttcatgtcgtagctattatgacatgggatggatgctggaacttgctagctagctgaaaggctccggatccttgttgtgcacgtacgttccaaacttgctcatactactcagagcgcggcgacatgttgggctttctgaaacaacggaggcagagccgtcagttctcgtcgtcgtcagcagccgaggaggtcaccgccggcatcgatggctccggcctcgtcgccatcgtcacgggcgcgtctagtgggatcggtgccgagacctgccgagttctggcgctgcggggcgttcgcgttgtgatgggcgtgaggacaccgtctgccggtgagcgcgtcaaggaagagatcgtnaagaacgtccccgctgccggtatcgacgtcctccaacttgatgttagcagcatgtcatccgtcaagagattcgctgacaac

SEQ ID NO: 1880 - protein, 103 aa, Zea mays
  misc_feature: Ceres CLONE 256945-F
  misc_feature: SWISSPROT Homolog: EC 1.3.1.33 Protochlorophyllide reductase
MLGFLKQRRQSRQFSSSSAAEEVTAGIDGSGLVAIVTGASSGIGAETCRVLALRGVRVVMGVRTPSAGERVKEEIVKNVPAAGIDVLQLDVSSMSSVKRFADN

SEQ ID NO: 1881 - DNA, 329 bp, Zea mays
  misc_feature: Ceres CLONE 256968-F
  misc_feature: Encodes the peptide sequence at SEQ ID NO. 1882
  misc_feature (144)..(144): n is a, c, t, g, unknown, or other
  misc_feature (278)..(278): n is a, c, t, g, unknown, or other
acacaaccaagctcgatccatctcactctccgctggtcgctcactcttgcagctccacccttcactcagtcttagtctcttattagctctaggctctagctagccgcgccactccttcgtgtagccatcagccttctcatcgbnaccaatggccactgccgaggtccagaccccgaccgtcgtggcggccgaggaagcgcccgtggtggagaccccgccgccggccgtcgtgcccgaggagtctgcccccgcctaggccgaggccgaggccgaggtgnctgctcctgctgatcccgaggagcttcccgcggccgagcagcaggcagccg

SEQ ID NO: 1882 - protein, 35 aa, Zea mays
  misc_feature: Ceres CLONE 256968-F
MATAEVQTPTVVAAEEAPVVETPPPAVVPEESAPA

SEQ ID NO: 1883 - DNA, 347 bp, Zea mays
  misc_feature: Ceres CLONE 257002-F
  misc_feature: Encodes the peptide sequence at SEQ ID NO. 1884
ctctgtcgcatttcccgtcctgtccttcccttacccggcggcttaaaccctagttctcactcccatcgccgctttcaagscttcccgccgcagcagatggagttctggggtctcgaggtcaagcctggttcccactgttaagtgtgagcctggatatggctttgtgctgcacctttccccaggctgctcttggggaatcgaagaagagttgataatgccttgatgtatgtcaaaattgatgatcagaaacttgccattggaaccctctctgttgacaagaacccacacatacaatttgatctggttttcgataaagagtttgagctgtcgcacacatcaaaaactac

SEQ ID NO: 1884 - protein, 41 aa, Zea mays
  misc_feature: Ceres CLONE 257002-F
MYVKIDDQKLAIGTLSVDKNPHIQFDLVFDKEFELSHTSKT

SEQ ID NO: 1885 - DNA, 158 bp, Zea mays
  misc_feature: Ceres CLONE 257038-F
gaygcttcgctctagtcggaaggtttcgaggaactcccgggctcgaggagatcgggacgatgatgggagggcgcgctctgctgctgctccttggtctcggcgctgctcgtttcagatccgcgccttctgacccgctgctgtacgagccgttttgatga

SEQ ID NO: 1886 - DNA, 392 bp, Zea mays
  misc_feature: Ceres CLONE 257074-F
  misc_feature: Encodes the peptide sequence at SEQ ID NO. 1887
  misc_feature (148)..(148): n is a, c, t, g, unknown, or other
  misc_feature (224)..(224): n is a, c, t, g, unknown, or other
  misc_feature (379)..(379): n is a, c, t, g, unknown, or other
gaggcagaaaagggcggataaactgcttgaactggaagckaccctagtccaaaccaccgcaccgacaccgactccgagccccgccgcgccgcgctacctccgctcctctcttcgcccctgccggcgtcgaggccgaagcgaaggcgangcatgcatcacgaccccaaccccttcgacgagggcagcgcgaggacaaccccttctcaaatggaggagccggaggncaagcagcagtacggcttccggccgactgagcccgtcgggttcggcggcgctacagggggcgacgcgtcgtttgacgtcccgctcgagaccatgggggactctcggagcaaggtgaaggagctctcgtcgtgggaatcagatctgaagcggcganaggcggatatcaa

SEQ ID NO: 1887 - protein, 80 aa, Zea mays
  misc_feature: Ceres CLONE 257074-F
  misc_feature (25)..(25): Xaa is any aa, unknown, or other
  misc_feature (77)..(77): Xaa is any aa, unknown, or other
MHHDPNPFDEGSARTTPSQMEEPEXKQQYGFRPTEPVGFGGATGGDASFDVPLETMGDSRSKVKELSSWESDLKRRXADI

SEQ ID NO: 1888 - DNA, 509 bp, Zea mays
  misc_feature: Ceres CLONE 257130-F
  misc_feature: Translation starting site: 58
  misc_feature: Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature (246)..(246): n is a, c, t, g, unknown, or other
  misc_feature (375)..(375): n is a, c, t, g, unknown, or other
atccgctccccgccttccgcttccctaccccccgcatcacctaccaacgccgacaccatgggggccttcgcgaaggaggagcaccagttcctagccgagctcggcctcgcgcrcaacccaggcgcgttcgcatgcggtgcgtggggcggctcaggtcccaccgtcacctccacgagcccgacccatatcaatcaggtcatcgcagaggtcgtggaggcgtccgtgcacgactacgaggagggcatncgcgcctgcttcgatgccgccaagacatggatgggcgattcctgctccaaagcgaggagagatcgttaggcaaatcggtgatgcactgagagcaaagctccatcaccttggcaggctttgtgtcacttnagatggggaaaattcttcctgaagggatcggtgaggttcaggaaatcatcgacatgttgtgattatgctgtggggctaagtcgccaactaaatggatccattataccatctgaacgaccaaaccatatgatgat

SEQ ID NO: 1889 - DNA, 355 bp, Zea mays
  misc_feature: Ceres CLONE 257217-F
  misc_feature: Encodes the peptide sequence at SEQ ID NO. 1890
aagtctacacccgccggtctcctcctctccagatctgcccatccgccatggcgcctccaccgcaccgccacctgctgctcctcctctttctcctccctctggtcctcctcgctggcacacccgccggcgccgatgaccttgtatcggagctccaatctctccgcgcgcggtccccgtccggcgtgatccacctcaccgacacctccgtcacccgtttcctctccgccccctccgcgcgccgcccctactccgtgctcgtattcttcgacgccgcttcgctccactcaaagcctgacctccacctgccccagctccgcaccgagttcgcgctcctctccgcctccttcctcgctca

SEQ ID NO: 1890 - protein, 102 aa, Zea mays
  misc_feature: Ceres CLONE 257217-F
MAPPPHRHLLLLLFLLPLVLLAGTPAGADDLVSELQSLRARSPSGVIHLTDTSVTRFLSAPSARRPYSVLVFFDAASLHSKPDLHLPQLRTEFALLSASFLA

SEQ ID NO: 1891 - DNA, 445 bp, Zea mays
  misc_feature: Ceres CLONE 257240-F
  misc_feature: Encodes the peptide sequence at SEQ ID NO. 1892
  misc_feature (38)..(38): n is a, c, t, g, unknown, or other
  misc_feature (272)..(272): n is a, c, t, g, unknown, or other
  misc_feature (290)..(290): n is a, c, t, g, unknown, or other
aaatcgacctgggctggacccagcgcgccccgtctgcntcctgcttctctctccgcttccgcttcctgcgcctccaggctccacttctccgctcggcagtcggcactggaaggacagcatgtcggcctcggcgtcgtcaccggcggcggcggcgggcgatgagaagcaggaggcggcgccgtcaggcstgcaagggcgtcaacgacctcgacaaggtcgttctccgcgagtccggggcagctccgcagaggtgtacttgtatggtgggcatntkacatcatggaaakatnakcatggagatgaattactttttgttagcaataaggctattttcaagcctccaaaagctatacgtggaggaataccaatatgctttccgcagttctccaactttggaagtctggaaccacatggatttkcaaggaatatgacatggagtgttgat

SEQ ID NO: 1892 - protein, 109 aa, Zea mays
  misc_feature: Ceres CLONE 257240-F
  misc_feature (24)..(24): Xaa is any aa, unknown, or other
  misc_feature (52)..(52): Xaa is any aa, unknown, or other
  misc_feature (57)..(57): Xaa is any aa, unknown, or other
  misc_feature (58)..(58): Xaa is any aa, unknown, or other
  misc_feature (101)..(101): Xaa is any aa, unknown, or other
MSASASSPAAAAGDEKQEAAPSGXQGRQRPRQGRSPRVRGSSAEVYLYGGHXTSWKXXHGDELLFVSNKAIFKPPKAIRGGIPICFPQFSNFGSLEPHGFXRNMTWSVD

SEQ ID NO: 1893 - DNA, 722 bp, Zea mays
  misc_feature: Ceres CLONE 257290-R
ccaattgggtaccgggccccccctcgaggtcgacggtatcgataagcttttttttttttttttttctttttttttttttttttttttttttttttttttttttttttttttttttttttttttaacgcggaattgtataatgatactgtttaaaataagggacgagggaaatagtctcagcctctcagggcataaatcctccgcacgcccggcctgggtggggcacgtaaccaacataaaaacccctgatggttattactccggtcttgctaccgccagaactcaaacaaaaatgtgccaatgcctcccatgccgaaaatcaccggatatattcatctatagagcaccaacaccggtgcttatttgatcaaacggacgcctgtactttattctaaattcggtccgcacacagattatgtctccacgaacacaacgaattaagagagggaaagctgtttcctagctatgcttcaactgccagcccccggaccctggcgcagctttaagcgccttgtctctgctttcccctgatctatgaaaagaaaccacctgtcgcgtttacctcccctaaaagggtggtttctccagttctcaaagaaatttagaaaatttgagaaaaatttttcttgccctccggggggaataatccttcccggggggaaattgaacccctgagaaaggttttttactctttggggggcggcccccttaaaaatcccctt

SEQ ID NO: 1894 - DNA, 146 bp, Zea mays
  misc_feature: Ceres CLONE 257337-F
  misc_feature (12)..(12): n is a, c, t, g, unknown, or other
ccggtccaccgngcatcgaacccccacttgtgccgattctgctgatccctcgccgactaacggccggcgaatcgacaccatggccgctgcgcgccggggccgtggcgacasaccaacggcgtcgtccgtccccgcccccgcgaccg

SEQ ID NO: 1895 - DNA, 519 bp, Zea mays
  misc_feature: Ceres CLONE 257444-F
  misc_feature: Encodes the peptide sequence at SEQ ID NO. 1896
aacaacacaacaacaacaaccatctccaacgcagcaagcagacagaaggacaggcaggcagcgagtgcaaccgcgagabattcagcrtgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtcgcaaggacatggaaggtagaggcgatgcaacgttcgtgctggtcaaggatgggaaggaggtaggccgtgtgattggggctaagaaggacgagcttgagaggaagatcaggatgttcgtcacgtcatcttcctcgtcctaacttagcagtggcattacactcccaccttctta

SEQ ID NO: 1896 - protein, 135 aa, Zea mays
  misc_feature: Ceres CLONE 257444-F
  misc_feature (50)..(135): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (26)..(26): Xaa is any aa, unknown, or other
  misc_feature (29)..(29): Xaa is any aa, unknown, or other
QHNNNNHLQRSKQTEGQAGSECNREXFSXGSFFSTLVTPPPAADDPNCAVVAAHSKATYDEQWAAHKSSSKLMVIDFSASWCGPCRFIEPAFKELASRFTDAIFVKVDVDELAEVARTWKVEAMQRSCWSRMGRR

SEQ ID NO: 1897 - DNA, 152 bp, Zea mays
  misc_feature: Ceres CLONE 257458-F
  misc_feature (114)..(114): n is a, c, t, g, unknown, or other
  misc_feature (132)..(132): n is a, c, t, g, unknown, or other
  misc_feature (138)..(138): n is a, c, t, g, unknown, or other
  misc_feature (141)..(141): n is a, c, t, g, unknown, or other
attccgtcgtcgtcatcagcagcttctgcttgctctggggggaaggagatatatatagagcgagakakatatctagtagagaggctagtaggtggtcctcgaacgaagatgttngcggtgttcagcgggcangtggtngangtgccggcgga

SEQ ID NO: 1898 - DNA, 492 bp, Zea mays
  misc_feature: Ceres CLONE 257468-F
  misc_feature: Encodes the peptide sequence at SEQ ID NO. 1899
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgt

SEQ ID NO: 1899 - protein, 97 aa, Zea mays
  misc_feature: Ceres CLONE 257468-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRWRRRRPCRASARGAARSRPSPTSCT

SEQ ID NO: 1900 - DNA, 229 bp, Zea mays
  misc_feature: Ceres CLONE 257483-F
  misc_feature: Translation starting site: 121
  misc_feature: SWISSPROT Homolog: EC 2.3.1.74 Naringenin-chalcone synthase
attaagactagctaactagcgtgaaagagyctcctccgacgactactaagctctcgcttgytccggacgacccctgcbggccgcctctggtacaacgtacgaraggaaragaracgatcgatggccggcgccaaccgtgaccgtggacgaggtraggaagggccagckgcgcgaccggccccgccaaccgtgctggccaatcgggacggcgacgcccgccaactgcgtg

SEQ ID NO: 1901 - DNA, 92 bp, Zea mays
  misc_feature: Ceres CLONE 257561-F
aagaaaaacgcattccgcagacgcgcggcgagggagtaggaggcgacggcgggtgccgaggcccgcagcacggggaagctaccggctagcgt

SEQ ID NO: 1902 - DNA, 141 bp, Zea mays
  misc_feature: Ceres CLONE 257566-F
accactcttggcgacagaatccaccgtacaccgctgcctccctctccctgtctcgtctcgtcgaaccagccgaggaagccaacgcagacccagcgatcctcgtcgcgcgccctcctcccccacggagggaaggatggcgga

SEQ ID NO: 1903 - DNA, 469 bp, Zea mays
  misc_feature: Ceres CLONE 257574-F
  misc_feature: Encodes the peptide sequence at SEQ ID NO. 1904
  misc_feature (136)..(136): n is a, c, t, g, unknown, or other
atcgcctccaccgctctctcttcctctgctcttctctgcctgcctgagctcaccgcacctcgcctcctcaccgcgtttcctccgttaatccggtagaaaatggccgatgccgaggatatccagcccctcgtctgcnacaacggaactggcatggtcaaggctgggttcgctkgcgacgacgcccgagggccgtcttccccagcatcgtggggcgcccgcgcacamtggtgtcatggtcgggatggggcagaaggacgcctacgtcggtkacgaggcgcagtccaagaggggtatcctgaccctcaagtaccccatcgagcacgggatcgtcagcaacttggacgacatggagaagatctggcatcacaccttctacaacgagctccgcgtggctcccgaggagcaccccgtcctcctcaccgaggcgccccttaaccccaaggctaacagggagaagatgacccagatc

SEQ ID NO: 1904 - protein, 121 aa, Zea mays
  misc_feature: Ceres CLONE 257574-F
  misc_feature: SWISSPROT Homolog: EC 2.7.10.2 Non-specific protein-tyrosine kinase
  misc_feature (40)..(40): Xaa is any aa, unknown, or other
  misc_feature (55)..(55): Xaa is any aa, unknown, or other
MPRISSPSSATTELAWSRLGSLATTPEGRLPQHRGAPAHXGVMVGMGQKDAYVGXEAQSKRGILTLKYPIEHGIVSNLDDMEKIWHHTFYNELRVAPEEHPVLLTEAPLNPKANREKMTQI

SEQ ID NO: 1905 - DNA, 487 bp, Zea mays
  misc_feature: Ceres CLONE 257606-F
  misc_feature: Encodes the peptide sequence at SEQ ID NO. 1906
actttcgatcgacacagaaaattccccaccaaaatctcctccccctgaagtcccgaagctcgcggaagscgagatgtaccatcccacgagaggcggcgtccgcggcggcagagatcaattcaaatgggacgatgtgaaggttgacaagcatcgggagaattaccttggtcatagtgttaaggctyctggttggtagatggcagaaaggaaaggatctttactggtatactcgggataagaaatccgacacgggagatgctcttaaggaagaaatcaggagagtgaaggaagaggaggaacaggctatgcgtgaggctcttggcttagctcctaagcgcmsaattcgaactcagggtaatcgcttggataagcatgaatgctgagctgattaagagaggatcaactgcggaggacttgggagcaggacacgctgaagcagcacaagtkcaggggtctaggattgtacaaggcccctcgcgatgagggt

SEQ ID NO: 1906 - protein, 40 aa, Zea mays
  misc_feature: Ceres CLONE 257606-F
  misc_feature (38)..(38): Xaa is any aa, unknown, or other
MYHPTRGGVRGGRDQFKWDDVKVDKHRENYLGHSVKAXGW

SEQ ID NO: 1907 - DNA, 320 bp, Zea mays
  misc_feature: Ceres CLONE 257686-F
  misc_feature: Translation starting site: 72
atccaattcacaggctcaccacaccaaccaacaagcaaaaattccccaatcctctcgtctcctcggcgaagatgtcggggcgcggcaagggcgcaagggcctgggcaagggcggcgcgamstcaccggaaggtcttgcgcgacaacatccaggggatcacgaagccggcgatccggagctggcgcggcggggcggcgtgaascsatctcggggctcatctacgaggagacccgcggcgtgctcaagatcttcctggagaacgtcatccgcgacgccgtcacctacaccgagcacgcgcgccgtaagaccgtcaccgccat

SEQ ID NO: 1908 - DNA, 501 bp, Zea mays
  misc_feature: Ceres CLONE 257740-F
  misc_feature: Translation starting site: 120
aagcacaagaacactcctagctagctgaagatctcgagtgcaacgaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggcaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaaactggcgagtgggctgttgttgggggcacggccagtttgctatggcgaacggcatcatc

SEQ ID NO: 1909 - DNA, 417 bp, Zea mays
  misc_feature: Ceres CLONE 257742-F
  misc_feature: Encodes the peptide sequence at SEQ ID NO. 1910
  misc_feature (338)..(338): n is a, c, t, g, unknown, or other
  misc_feature (407)..(407): n is a, c, t, g, unknown, or other
gccttgacacgcagactaggcgccvktctgcgaactgtctctacccttgacgaaggaagaggcagccttctcaccgtcgcacccggcgatgcagcggcacgtcgcctccggccggccgtcgggcacggacgctccgacttttcttaccgcatggtcgtcgaatcccggtaccagagggtcgccgagggcagatcccgcctcgcgcgcytcatcctcgtgcaggcgctgcacctagtggccggasttgcttctattgctgtcgttgtccaaggggtcggcggtgaacaagttcgccgtgctgtccatggccgcgggattcctggctatagtggtggggnaattagggcgaatcggaccatttcagttgctgcttcggctctacacaagcttgtcatcaattgcggttncattctctgt

SEQ ID NO: 1910 - protein, 139 aa, Zea mays
  misc_feature: Ceres CLONE 257742-F
  misc_feature (9)..(9): Xaa is any aa, unknown, or other
  misc_feature (70)..(70): Xaa is any aa, unknown, or other
  misc_feature (82)..(82): Xaa is any aa, unknown, or other
  misc_feature (113)..(113): Xaa is any aa, unknown, or other
  misc_feature (136)..(136): Xaa is any aa, unknown, or other
ALTRRLGAXLRTVSTLDEGRGSLLTVAPGDAAARRLRPAVGHGRSDFSYRMVVESRYQRVAEGRSRLARXILVQALHLVAGXASIAVVVQGVGGEQVRRAVHGRGIPGYSGGXIRANRTISVAASALHKLVINCGXILC

SEQ ID NO: 1911 - DNA, 227 bp, Zea mays
  misc_feature: Ceres CLONE 257746-F
  misc_feature (88)..(88): n is a, c, t, g, unknown, or other
  misc_feature (124)..(124): n is a, c, t, g, unknown, or other
actccccagtccccatagactccagcctgagctgcgacgtgagcgctcgcygctccgcatcgccgtcccagtcccacaccccgcctcnagcctgccccagcgtaatggcgcatcgcaggccgtnctcgcggcgttgtcctcgccgcgctgttcccgctcgccctctctcgcgggctgggcttggtgcacgggcatgtgcggccgcaacgcacgggctggggctcggc

SEQ ID NO: 1912 - DNA, 473 bp, Zea mays
  misc_feature: Ceres CLONE 257777-F
  misc_feature: Encodes the peptide sequence at SEQ ID NO. 1913
  misc_feature (195)..(195): n is a, c, t, g, unknown, or other
acctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggkctgccgacgatgaatcagcgtctggacatctcgaacgckgcggtgacagatggcgacggaggcgtccctgtcgtgcgtccgctcgtkgggcgcgcgctctcgtccatca

SEQ ID NO: 1913 - protein, 38 aa, Zea mays
  misc_feature: Ceres CLONE 257777-F
MQDYVVDGFMKNTNCDDPELKEKLTRLCKTTTVRLGTW

SEQ ID NO: 1914 - DNA, 272 bp, Zea mays
  misc_feature: Ceres CLONE 257815-F
  misc_feature: Encodes the peptide sequence at SEQ ID NO. 1915
acaactcacatcgaggtctcagcttcaggaaagggaaggaagcatgttcgggcaccaccacggccacggcggghaccaccaggccccgccgccgywcgagcagacgctgttcaggatcttctgccgcgccgacgagstactgcctcaccgtgcgtcacgacgccgtcgtcctcgcgcccaccaacccccgcgacgwktaccagcactggtacaaggacatgaggcacagcacgaaggtgaaggacgcggagggccagccagcgttcgcgctc

SEQ ID NO: 1915 - protein, 90 aa, Zea mays
  misc_feature: Ceres CLONE 257815-F
  misc_feature (32)..(32): Xaa is any aa, unknown, or other
  misc_feature (45)..(45): Xaa is any aa, unknown, or other
  misc_feature (65)..(65): Xaa is any aa, unknown, or other
NSHRGLSFRKGKEACSGTTTATAGTTRPRRRXSRRCSGSSAAPTXYCLTVRHDAVVLAPTNPRDXYQHWYKDMRHSTKVKDAEGQPAFAL

SEQ ID NO: 1916 - DNA, 498 bp, Zea mays
  misc_feature: Ceres CLONE 257821-F
  misc_feature: Encodes the peptide sequence at SEQ ID NO. 1917
tacactgagaaccgcagagacaggcgtcttcgtactcgcctatctccgcgacccaaagckttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaag

SEQ ID NO: 1917 - protein, 124 aa, Zea mays
  misc_feature: Ceres CLONE 257821-F
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRK

SEQ ID NO: 1918 - DNA, 256 bp, Zea mays
  misc_feature: Ceres CLONE 257824-F
  misc_feature: Encodes the peptide sequence at SEQ ID NO. 1919
  misc_feature (198)..(198): n is a, c, t, g, unknown, or other
gaccgatctgtccgatctctctcccgagtccactgcaagcbttttcgccttttcctccgccttctcgcgatggcgccgcgcsgcgctctactcgtcctcgccgctctcctcctctccctctcccttagggccgcctccttccattccgacgagctcctcctcaacgatgacgaagagttcgagggcgtcgtcgccgcnccctccgccccctccccgccggcgccccggtggtctcctcctcccgccgcagatcagc

SEQ ID NO: 1919 - protein, 62 aa, Zea mays
  misc_feature: Ceres CLONE 257824-F
  misc_feature (5)..(5): Xaa is any aa, unknown, or other
MAPRXALLVLAALLLSLSLRAASFHSDELLLNDDEEFEGVVAAPSAPSPPAPRWSPPPAADQ

SEQ ID NO: 1920 - DNA, 741 bp, Zea mays
  misc_feature: Ceres CLONE 257896-R
caattgggtaccgggccccccctcgaggtcgacggtatcgataagcttttttttttttttttttgttcatatttcacaaaatttaactgaactcagaaattggcataataactgtacattattgtggaaaaggctgtttccaagacctactctccgcatagaatataactaaatatatttcaagcggctcaattctgacattgagccgacttgtgtacacagaaccaggaaacttcaagcatcagattctttcaagtggccaaattctgaggtgctgacaaagaaatcgttccttcacggaatccaagcgcatcgtttttccttcgtaccgtcgagtcctgaattgcgagaccatttcttcatccaagcactggactgtttttggaaatccggaaaacagggccccttccctccccaccgcaaaaagtttcatcgccgtcccctgtataagggccgaacgaattttgaacagggccgggaaggcaccgatccctggttttccacccccaaaaattttttccccctttgcttcccgaaatccccaaaaaaaccccctaaaaatgaacccttgggcccggaaaaaaaaatacccaatttgggacccccgcgccgtgggcgcccacgagaaaatggggaaaccctcccccaaaaacgccctgggaactaagaataggcgccccaaaagaaaattttctgccaagaaaaaaaaatctgggtttgtaatggaaaaatttctcgtgt

SEQ ID NO: 1921 - DNA, 473 bp, Zea mays
  misc_feature: Ceres CLONE 257984-F
  misc_feature: Translation starting site: 90
  misc_feature (239)..(239): n is a, c, t, g, unknown, or other
  misc_feature (303)..(303): n is a, c, t, g, unknown, or other
  misc_feature (305)..(305): n is a, c, t, g, unknown, or other
  misc_feature (438)..(438): n is a, c, t, g, unknown, or other
atcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagctggaggtcccggcggcccaggtggccgakgcgcccaaggcgaagaaggcgcccaaggagaagaaggcgcctaaggagaagaagccgtccgckgcganagaagccggcggcgcaccctccctacgctgaratgattgtagagcgatcgctgccctcaagganangaaagggtcgagctcggtggccatcagcaagtacgtcgaagggaatcacggcggcaagctccccaccaacttccgcaagcagctcaccgtgcagctgaagaagctcgctgccgccggsaagctgacgagggtnaagaactccttcaagctgccggccaccgacgccaa

SEQ ID NO: 1922 - DNA, 473 bp, Zea mays
  misc_feature: Ceres CLONE 258091-F
  misc_feature: Encodes the peptide sequence at SEQ ID NO. 1923
  misc_feature (199)..(199): n is a, c, t, g, unknown, or other
  misc_feature (200)..(200): n is a, c, t, g, unknown, or other
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcaknntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctgggacatctcgaacgcggcggtgacsagatggcgacggaggcgtccctgtcgtgcgtccgctcgtggggcggcgcgctctc

SEQ ID NO: 1923 - protein, 128 aa, Zea mays
  misc_feature: Ceres CLONE 258091-F
  misc_feature (10)..(128): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
  misc_feature (111)..(111): Xaa is any aa, unknown, or other
MVSSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLGHLERGGDXMATEASLSCVRSWGGAL

SEQ ID NO: 1924 - DNA, 405 bp, Zea mays
  misc_feature: Ceres CLONE 258151-F
  misc_feature: Encodes the peptide sequence at SEQ ID NO. 1925
  misc_feature (122)..(122): n is a, c, t, g, unknown, or other
  misc_feature (225)..(225): n is a, c, t, g, unknown, or other
  misc_feature (314)..(314): n is a, c, t, g, unknown, or other
agcagccaaaacgcagaagctgcactgcatacatcgagctaactatctgcagcgatgtctcgctcctgctgcgtcgccgtgtcggtgcttctcgctgtcgccgcgacascagcgccaccgcncggcatggctgcacgaggaggccatggccacgggccgctggtcgcagagggtgcaaggstggcgccctccgcgtccacctgggctgccgacaagsgtcgccgncgaggccgagcggcggcatggccacgcagggcgacgaccagagctcgtcgggcggcattggcagcagcggtgagcacggcaaggagganggcgagaagcaggggcaagagctgcctcaccaaggaggagtgccacaagaagaagatgatctgcggcaagggctgcacgctctcggcgcac

SEQ ID NO: 1925 - protein, 117 aa, Zea mays
  misc_feature: Ceres CLONE 258151-F
  misc_feature (19)..(19): Xaa is any aa, unknown, or other
  misc_feature (23)..(23): Xaa is any aa, unknown, or other
  misc_feature (43)..(43): Xaa is any aa, unknown, or other
  misc_feature (55)..(55): Xaa is any aa, unknown, or other
  misc_feature (87)..(87): Xaa is any aa, unknown, or other
MSRSCCVAVSVLLAVAATXAPPXGMAARGGHGHGPLVAEGARXAPSASTWAADKXRRRGRAAAWPRRATTRARRAALAAAVSTARRXARSRGKSCLTKEECHKKKMICGKGCTLSAH

SEQ ID NO: 1926 - DNA, 452 bp, Zea mays
  misc_feature: Ceres CLONE 258197-F
  misc_feature: Translation starting site: 284
  misc_feature (236)..(236): n is a, c, t, g, unknown, or other
aktcgcctccttcctgcgccgccgccgccgccgccgccgccgctaccaccgcctcgsgccgcctgckstcccgcgtttccgcacggaagttggtgaaggtttcttgaggctgagaacatggtgctgaagacggaactttgccgcttcagcgcaggaagatttatcctgggaaaggcattagatttatccgtgctgattctcaggtcttcctttttggccaactcgaaatgcaagcnctacttccacaaccgcctgaakcctgcaaagcttacctgggacagcaatgtacaggaagcagcacaagaaggatatccatgctgaagcggtaaagaagaggcgccgcgccaccaagaagccatactccaggtcaatttgtggggtgcttccttgggaagtaatccagaagaagagagctgagaagccagaggtccgcgatgctgctagagaagctg

SEQ ID NO: 1927 - DNA, 484 bp, Zea mays
  misc_feature: Ceres CLONE 258269-F
  misc_feature: Translation starting site: 88
  misc_feature (408)..(408): n is a, c, t, g, unknown, or other
  misc_feature (413)..(413): n is a, c, t, g, unknown, or other
ctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaangcaangaaggttgtaggctgctcctgtgtcgtcgtcaaggactacggtgaagaatctgagggccttaacatagtgc

SEQ ID NO: 1928 - DNA, 197 bp, Zea mays
  misc_feature: Ceres CLONE 258277-F
  misc_feature (48)..(48): n is a, c, t, g, unknown, or other
  misc_feature (192)..(192): n is a, c, t, g, unknown, or other
acgcaaaattccccatcccccaaggaagtcaggccctcgcgcaccagnccggaccacaccgcccgtytgaccgacgcaacccagccgtccagacgcgccgccgaccgtccttccaccaccacgcccgckccgtcgcacgctccctagggttccgcaggccggggatcgccggagatggactggagcgcggtnacggc

SEQ ID NO: 1929 - DNA, 365 bp, Zea mays
  misc_feature: Ceres CLONE 258282-F
  misc_feature: SWISSPROT Homolog: EC 5.5.1.6 Chalcone isomerase
  misc_feature (32)..(32): n is a, c, t, g, unknown, or other
  misc_feature (344)..(344): n is a, c, t, g, unknown, or other
gccacaaccgtagcctgtagcttcatccgtkngctgctcccggttccatcgcgcggtgcggaatttaacatggccgtgcggagtggtggtcgacggcgtctcttcccgccggtggcccgcccgccgggtccgccggctcgcacttcctcggcggcgcaggcgtgcgaggcctcgagatcggaggcaacttcatcaagttcacggccatcggcgtgtacctggaggacgcggccgtgcccgccttggccaagaagtggggcggcaagacggccgacgagctcgcctccgacgccgccttcttccgcgacgtcgtcacgggcgacttcgagaagttcacgagggtnacgatgatcctcccgctgacg

SEQ ID NO: 1930 - DNA, 176 bp, Zea mays
  misc_feature: Ceres CLONE 258302-F
atccaattcacaggctcaccacaccaaccagcaagcaaaaattccccaatcctctcgtctccgcggcgaagatgtcggggcgcggcaagggcggcaagggcctgggcaagggcggcgcgamstcatccggaaggtcttgcgcgacaacatccaggggatcacgaagccggcgatcc

SEQ ID NO: 1931 - DNA, 1828 bp, Zea mays
  misc_feature: Ceres CLONE 258311
  misc_feature: Encodes the peptide sequence at SEQ ID NO. 1932
aattgggcacagaagaggagacagagagacggagaggggagacccggtcactgccaatgccaagaacaagaaaccagagaggacagtcgtcaatccaatccgagtctcctccaaaaacccatcaatctgcaggaacgagagcagcaggagagcatcctaggaaaaaagttaggaccaactgaccgagcaaaaaaggtagcatctctgtatcaccaaggcaccgccgattcacagaccaaatccctcccccctcctctggtccatcccacacgtagagcagccggtatttcttcgatccgtgcttgcgctttttttttctctttgtaaagatttcgtttccctcccttttaactgttgtcgagaagtttcgacaagagtggtgtgagtgttgaagagctcctcaacatgatggatccggccttgcttgacgacgtcatacgccggctgctggaggtgaagaatctcaagcctgggaagaacgcgcagttgtcggagtcggagatcaagcagctctgcgctgccgccaaggagatcttcctgcaccagcccaacctgctggagctcgaggcgcccatcaaaatctgcggtgatgtccatggccagtactctgatctcctgaggctattcgattatggtggctatccgcctcaggccaactaccttttcttgggtgattatgtggatcgtggaaagcaaagcttggaaacaatatgtcttcttttggcctacaaggtcaagtacccagagaacttctttcttctaaggggaaaccatgaatgcgcatcagtaaatcgcatctatggtttttatgacgagtgcaaacgcagattcagtgtaaagctgtggaaaacattcactgactgttttaactgcttgccagtgtcagcattgatagacgaaaagatcctctgtatgcatggtggtctatctccagagttgaacaagctcgaacaaatacttaatctgagtcgccccacagacgtgcctgatactggattgctctgtgaccttctttggtctgatccttctaatgaagcaacaggatgggccataaatgatcgaggtgtttcatatacatttggtcctgataaagtttctgaattccttgagaagcatgatttggacctcatctgccgagcccatcaggttgtcgaagatggatatgagtttttcgctagccgccaactcgtaacaatgttttcagcccctaactactgtggagaatttgataacgctggtgccatgatgagtgtagatgagacattgatgtgctccttccaaatactgaaacctgcgaggaaggtgttgggtggttcaactaataacaaaatcaggcttcaagtcatcgagaggatggtgacaatggcaagcctgatatcaggttggttggtgagcagcacgccagtggtcgacggggggttgttccatcataatcatattacagcggctgcaactgacaggcccaatgcatcttctcttccatgttggatcaacactcttgtaatgtattatttactgtgcggatctgagaggatgtgaatgatttcatttgcgtcctcaagttcaaaagattcaggaaggcatgcttgaaataaaaatagccagaaacatgcaaggtgctccacgacgcagcacggcatttccagtgttttctttttgctgtctagttctgaatatattttaccgccagaccagcacgtaagcttgcctggcaatggtttttatttgttgctatgccatctcaaaagtcaaaaccatggatttatatcaaaagtcaaaagactttgagaagtatttaaaaaaaaaaaaaataaaaaaaaaaaaaaaa

SEQ ID NO: 1932 - protein, 377 aa, Zea mays
  misc_feature: Ceres CLONE 258311
  misc_feature (55)..(250): Pfam Name: Metallophos Pfam Description: Calcineurin-like phosphoesterase
  misc_feature: SWISSPROT Homolog: EC 3.1.3.16 Phosphoprotein phosphatase
MMDPALLDDVIRRLLEVKNLKPGKNAQLSESEIKQLCAAAKEIFLHQPNLLELEAPIKICGDVHGQYSDLLRLFDYGGYPPQANYLFLGDYVDRGKQSLETICLLLAYKVKYPENFFLLRGNHECASVNRIYGFYDECKRRFSVKLWKTFTDCFNCLPVSALIDEKILCMHGGLSPELNKLEQILNLSRPTDVPDTGLLCDLLWSDPSNEATGWAINDRGVSYTFGPDKVSEFLEKHDLDLICRAHQVVEDGYEFFASRQLVTMFSAPNYCGEFDNAGAMMSVDETLMCSFQILKPARKVLGGSTNNKIRLQVIERMVTMASLISGWLVSSTPVVDGGLFHHNHITAAATDRPNASSLPCWINTLVMYYLLCGSERM

SEQ ID NO: 1933 - DNA, 432 bp, Zea mays
  misc_feature: Ceres CLONE 258332-F
  misc_feature: Pfam Name: F_actin_cap_B Pfam Description: F-actin capping protein, beta subunit
  misc_feature (260)..(260): n is a, c, t, g, unknown, or other
  misc_feature (356)..(356): n is a, c, t, g, unknown, or other
  misc_feature (371)..(371): n is a, c, t, g, unknown, or other
agcaaagaaagataacagaagagacagacggaaagaacaccggagcggagagccacaggaggaggagctcgagggacgacgaccagctgaattaggactggagggggcagacgacgtcgtcgtaagcggcasagcaggagaagggaagactcaaacgagggatctccgagagaggagtgtggtaggcaggaagaaagaataaggcgagccgagagccattcgcatggaggcggcgatggatctgatgcggcggatgsaancgggagcgcggagacggcgctcaacgcgctgctctccctcctccccgaccactccctcgacctcctctcccaggtcgacctcccgctccaggtttncatggataaggagancctgaaggaatacatttctatgcgaatataaccgtgatgctgactcctacsgatctccttg

SEQ ID NO: 1934 - DNA, 214 bp, Zea mays
  misc_feature: Ceres CLONE 258345-F
  misc_feature (2)..(2): n is a, c, t, g, unknown, or other
  misc_feature (104)..(104): n is a, c, t, g, unknown, or other
ancgctctccgccgccacttctcctccggcatcgacgaggcgamscagcgcccgaktccctctccctgctcccacgacccatggcggcggatatggcgtacgcncgccgatgaaggggcaaggccgggttcgaggctggcatgatggatccgcagcacaggatccgcatcacgctctcctccaagagcgtcaagaacctcgagaaagtctgcgg

SEQ ID NO: 1935 - DNA, 200 bp, Zea mays
  misc_feature: Ceres CLONE 258368-F
akagcagagctgcctccagacgagacgaggaggacgcggcgccgttcgggcttggcagcaaccagcgtctasgcaagtgcccttctgtytcctatctccccggagtccccgctgcccagcccggtctcactttccagtctccgagactccgagtctsgctcgcaccccgtccccctgcagcctgtgctctgggttggagg

SEQ ID NO: 1936 - DNA, 494 bp, Zea mays
  misc_feature: Ceres CLONE 258370-F
  misc_feature: Encodes the peptide sequence at SEQ ID NO. 1937
attttttccactttcgagcgcagaaacgagagggcaggagcagccgcagtcccggcgatcccgccgccggtcgccctcatacttcctcgtcactgccttcgtttctctttccaacaatcaagatgagccgtggcgtasgcgggtggtggtcaaagttctctgggttacctctttggaagckggtgagccccccaaaccagcagtggcaccagctgtaagtgctccacctgctgctgcagtcttcccacctcstgagaaaccacctgctgcaaasctgatggcaccagtcagattgctgctggggttaccagccaaaccaataactaccacagggccgacggtcagaacaccggcaacttccttacggaccgcccttcgaccaaggtccacgctgctcctgggcggtggctcttccctgggatacctgtttggtggcaactgatgccgctcaccaagctatcaccccccactgtcgccgcatgccttttctgaat

SEQ ID NO: 1937 - protein, 146 aa, Zea mays
  misc_feature: Ceres CLONE 258370-F
  misc_feature (46)..(46): Xaa is any aa, unknown, or other
  misc_feature (84)..(84): Xaa is any aa, unknown, or other
  misc_feature (91)..(91): Xaa is any aa, unknown, or other
FFPLSSAETRGQEQPQSRRSRRRSPSYFLVTAFVSLSNNQDEPWRXRVVVKVLWVTSLEAGEPPKPAVAPAVSAPPAAAVFPPXEKPPAAXLMAPVRLLLGLPAKPITTTGPTVRTPATSLRTALRPRSTLLLGGGSSLGYLFGGN

SEQ ID NO: 1938 - DNA, 491 bp, Zea mays
  misc_feature: Ceres CLONE 258372-F
  misc_feature: Encodes the peptide sequence at SEQ ID NO. 1939
  misc_feature (47)..(47): n is a, c, t, g, unknown, or other
cccttttcttctcactccactccgccgcccggattcagagcgacasngcaggaggcggagagggcggacatggcggcgatgttggtgggcgcgctgcggaggggaagtggatgccgcggcggcttgcgccttatcgctcattcgcttcgcagattcgtgagcacgctcgtcgtagcggasacgaaggcgggttcgtcaagccgtcgtcgctgagcgcattggccgccgcggaggcaattgccaaggacaacaaagtttctgtcctgctgggtggttccgggccggcgcttcacaaggccgccgaccatgccgcgtgctgccatccactggtgtctgaggtgctcgtggccgattccgaagccttggcgcatcctctggctgaaccctgggccgagctactccgttccgttcagcagaaaggatgctactctcatgtcatagctttcatccacatcattcgggaagaatttgcttccacgtgctgcggctct

SEQ ID NO: 1939 - protein, 163 aa, Zea mays
  misc_feature: Ceres CLONE 258372-F
  misc_feature (15)..(15): Xaa is any aa, unknown, or other
  misc_feature (60)..(60): Xaa is any aa, unknown, or other
LFFSLHSAARIQSDXAGGGEGGHGGDVGGRAAEGKWMPRRLAPYRSFASQIREHARRSGXEGGFVKPSSLSALAAAEAIAKDNKVSVLLGGSGPALHKAADHAACCHPLVSEVLVADSEALAHPLAEPWAELLRSVQQKGCYSHVIAFIHIIREEFASTCCGS

SEQ ID NO: 1940 - DNA, 391 bp, Zea mays
  misc_feature: Ceres CLONE 258441-F
  misc_feature: Translation starting site: 87
  misc_feature: SWISSPROT Homolog: EC 5.2.1.8 Peptidylprolyl isomerase
ctctccgtgctttctcagaggcgggttggcttctcctcccccaccggttcgtgttcaggttctggttcgtgggcgagagggaagagatggcggcgtcggacgttgagtaccgttgcttcgttggcggcctcgctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcasccatcgagggcatgaacggcaaggagctcgacggccgcaacatcaccgttaacgaggcccagtcccgcggcggccgcgaggcsgggttgggcggatacggtggcgggcgcgtgat

SEQ ID NO: 1941 - DNA, 415 bp, Zea mays
  misc_feature: Ceres CLONE 258454-F
  misc_feature: SWISSPROT Homolog: EC 1.15.1.1 Superoxide dismutase
  misc_feature (35)..(35): n is a, c, t, g, unknown, or other
  misc_feature (87)..(87): n is a, c, t, g, unknown, or other
aagacctgctgtgtccaccaaccgtgagcccatgnaggcgaccgacgacgctagcttagactaggaaccaacaatggccacgcgcynctgctcctcctcctgctcgccgcgctgctcccggcggcggccacggcggacccggacgcggtgcaggactactgcgtgccggacacggcggcgggcgcgggcgcgggcgggccgtggatctagcgctgctcccgtcctacccgtgcaggagccccgccaacctgacggcggcggacttcgcttcgcgggcgtgcgcgcgcgggcaacttctccgcggacacggggttcgcgggggtgtcggtgacccccgcgcagttcccggcgctgcacaccctcggcgtgtccttcgcgcgcgccgacctgtccgcggcgggcgggtcaaccgcgc

SEQ ID NO: 1942 - DNA, 275 bp, Zea mays
  misc_feature: Ceres CLONE 258527-F
  misc_feature: Encodes the peptide sequence at SEQ ID NO. 1943
acaccgcacacccttgcttgtytccaggcgtacttgcgtttagcgtctcttccctgctgccatctctgtccggaggcaagccatggcgcgggcggggacggcgtcgctcgccaggcggastccgccgatcgagggcaacatctgcttcaagaaggcgcgcctcggcgcggccatccgactgctacaccgaggcaattgcgctctgccccgacgtcgccgtctactggatcaatcgggccctgtgccatttcaagcgcaaggagtgggccaaggtc

SEQ ID NO: 1943 - protein, 91 aa, Zea mays
  misc_feature: Ceres CLONE 258527-F
  misc_feature (7)..(7): Xaa is any aa, unknown, or other
  misc_feature (40)..(40): Xaa is any aa, unknown, or other
TAHPCLXPGVLAFSVSSLLPSLSGGKPWRGRGRRRSPGGXRRSRATSASRRRASARPSDCYTEAIALCPDVAVYWINRALCHFKRKEWAKV

SEQ ID NO: 1944 - DNA, 150 bp, Zea mays
  misc_feature: Ceres CLONE 258593-F
  misc_feature (14)..(14): n is a, c, t, g, unknown, or other
  misc_feature (41)..(41): n is a, c, t, g, unknown, or other
  misc_feature (97)..(97): n is a, c, t, g, unknown, or other
accggccaccgcsntccagagccccacgccccgtccgaacnccagagcagagcaaagcctcctcgacctccctgtccccagccttccccgatggccngcacgaagcagacggcgcgcaagtcgacgggcggcaaggcgccgcggaacagc

SEQ ID NO: 1945 - DNA, 448 bp, Zea mays
  misc_feature: Ceres CLONE 258614-F
  misc_feature: Encodes the peptide sequence at SEQ ID NO. 1946
  misc_feature (96)..(96): n is a, c, t, g, unknown, or other
agattacattcacctcccatccatttctcaccagaagcgaaggcgaaggcggaggcggaggagcggaggtaggagatctcgagcaagccggrsaangtagatgaagacgttcgacccgtggccggtctttttccgccgggagtggaagckcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagaaacgcatgtttggccagccagttctgttatgcttttgaatgaaaaatttagacccctctttctcgtttccttaatcgaaatgcttgaactctatgttccatttgtaatgtaataagaggcaaatgaattgaaccaacagcaatcaacttctgatta

SEQ ID NO: 1946 - protein, 57 aa, Zea mays
  misc_feature: Ceres CLONE 258614-F
  misc_feature (17)..(17): Xaa is any aa, unknown, or other
MKTFDPWPVFFRREWKXNWPFLTGFAITGFIITKMTSNFTEEDLKNSKFVQEHKKKH

SEQ ID NO: 1947 - DNA, 240 bp, Zea mays
  misc_feature: Ceres CLONE 258637-F
agtcgcctccttcctgcgccgccgccgccgccgccgctaccaccgcctcggccgcctgcktccgcgtttccgcacggaagttggtgaaggtttcttgaggctgagaacatggtgctgaagacggaactttgccgcttcacgcaagaagatttatcctgggaaaggcattagatttatccgtgctgattctcaggtctacctttttgccaactcgaaatgcaascgctacttccacaaccg

SEQ ID NO: 1948 - DNA, 410 bp, Zea mays
  misc_feature: Ceres CLONE 258641-F
  misc_feature: Encodes the peptide sequence at SEQ ID NO. 1949
  misc_feature (195)..(195): n is a, c, t, g, unknown, or other
acctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtga

SEQ ID NO: 1949 - protein, 70 aa, Zea mays
  misc_feature: Ceres CLONE 258641-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAV

SEQ ID NO: 1950 - DNA, 171 bp, Zea mays
  misc_feature: Ceres CLONE 258645-F
aggacaaagacacttgctcacaccagaaccctctccgcaatctccccgcctcgctcccgcctccacccaatggcgtctctccctaacggtggcggcgcgstccttgggctcatgcggcgcgcgccctgtggacaaggaggtggacttcgccaactacttctgcacgtacgc

SEQ ID NO: 1951 - DNA, 138 bp, Zea mays
  misc_feature: Ceres CLONE 258717-F
aaaacgggaactcttcacagcttcgcacctcgcgtcacaacaccaagacgcacgtaggagggaactcaagcttcagtcgtccatggctcagcagcaaacaaatcctgaagaaggtggtcctcgggcaggagggtcggg

SEQ ID NO: 1952 - DNA, 191 bp, Zea mays
  misc_feature: Ceres CLONE 258766-F
  misc_feature: Encodes the peptide sequence at SEQ ID NO. 1953
agagtttccgtgccgtagcaacagacaagggagagtgdgagactagcgcaacaggacagcgcacggaaagcgaggggaggggagacggagagggcgcatcggacggcggcgagatgctggcggtgttcgatcccacggtggccaagtgcccggagtctccgcakccccccggtcgccgggcggccgctgga

SEQ ID NO: 1953 - protein, 63 aa, Zea mays
  misc_feature: Ceres CLONE 258766-F
  misc_feature (12)..(12): Xaa is any aa, unknown, or other
  misc_feature (54)..(54): Xaa is any aa, unknown, or other
SFRAVATDKGEXETSATGQRTESEGRGDGEGASDGGEMLAVFDPTVAKCPESPXPPGRRAAAG

SEQ ID NO: 1954 - DNA, 855 bp, Zea mays
  misc_feature: Ceres CLONE 258773
  misc_feature: Encodes the peptide sequence at SEQ ID NO. 1955
caatccaacaagcacaaacctgcagtcatctatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcaccccttcctccttcttgaagcgaagccccttgaaatgaatgaaccatgcatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttgttcaaatatatataccgtcgatggaactccaaatgtaatgtcacgcaaatgtgtgtttttcatcgattgaatggataataataaaaaggcatgctggctaaaaaaaaaaaaaaaaaa

SEQ ID NO: 1955 - protein, 156 aa, Zea mays
  misc_feature: Ceres CLONE 258773
MKSRSMASSAALLVLALALVAATAPQVAEAKKKRAAESGEAAEAKKIQDDFCSTLCEGKKGTDLVVCKESCALSQQSNLVLYGRIQCKGKCTEQKGITAPAMKVCQEECDKAYVVKAAEVTKACSVTCAKEKNPRLSENCKRSCTPSSFLKRSPLK

SEQ ID NO: 1956 - DNA, 177 bp, Zea mays
  misc_feature: Ceres CLONE 258905-F
  misc_feature (77)..(77): n is a, c, t, g, unknown, or other
cccctcctccgcacaaacgcgtcgcatccgctccacaggatcctctgcgccaccgcaaccgtgtgaccgcccgtkcngccgggatdcccgatccgccgacccgtcccagccccgctcgcagccatgtcgccgtcggagccgacgcggtgaggagagcgtgtacatggccaagcttgc

SEQ ID NO: 1957 - DNA, 319 bp, Zea mays
  misc_feature: Ceres CLONE 258910-F
  misc_feature: Encodes the peptide sequence at SEQ ID NO. 1958
  misc_feature (97)..(97): n is a, c, t, g, unknown, or other
  misc_feature (98)..(98): n is a, c, t, g, unknown, or other
  misc_feature (186)..(186): n is a, c, t, g, unknown, or other
attatttatcgtttatccacggaacttccggtgccggcgggaccacttgtggcgatccatccctcaccatgtcgtcggagaaggaggcggcgctcgnngcttcgatgacagcccaaccatatttgacaagatcatcaaaaaggaaataccttctactgtggtttatgaggacgagaaggtactggnctttcagggacataaaccctcaagctccaacacacattctcatcatccccaaagtcaaggatggactaactggcctggcaaaggctgaagagaggcacatagaaatacttggctatctcctctatgttgccaa

SEQ ID NO: 1958 - protein, 83 aa, Zea mays
  misc_feature: Ceres CLONE 258910-F
  misc_feature (10)..(10): Xaa is any aa, unknown, or other
  misc_feature (40)..(40): Xaa is any aa, unknown, or other
MSSEKEAALXASMTAQPYLTRSSKRKYLLLWFMRTRRYWXFRDINPQAPTHILIIPKVKDGLTGLAKAEERHIEILGYLLYVA

SEQ ID NO: 1959 - DNA, 217 bp, Zea mays
  misc_feature: Ceres CLONE 258982-F
  misc_feature: Encodes the peptide sequence at SEQ ID NO. 1960
  misc_feature (148)..(148): n is a, c, t, g, unknown, or other
  misc_feature (187)..(187): n is a, c, t, g, unknown, or other
ctcttttccgccctccacccctcgcgagctctccacccctccacacgaccctcctcggcggcggcggcggcgatgcagatggcggcgaccaccaccgagtcccagacgccgtgscctcaacaccctcacgcccacccccacgcgcccncgcagcatgctcacccgcaccaccacatgccgcagccwnggtgggtcgtcatcccgtacccgccgccgc

SEQ ID NO: 1960 - protein, 48 aa, Zea mays
  misc_feature: Ceres CLONE 258982-F
  misc_feature (14)..(14): Xaa is any aa, unknown, or other
  misc_feature (26)..(26): Xaa is any aa, unknown, or other
  misc_feature (39)..(39): Xaa is any aa, unknown, or other
MQMAATTTESQTPXPQHPHAHPHAPXQHAHPHHHMPQPXWVVIPYPPP

SEQ ID NO: 1961 - DNA, 218 bp, Zea mays
  misc_feature: Ceres CLONE 259035-F
  misc_feature: Encodes the peptide sequence at SEQ ID NO. 1962
  misc_feature (136)..(136): n is a, c, t, g, unknown, or other
catacatttcgactctcaactcccaaggtccctttttttttctcgatctggaagcgccgcagtagcagccatggacgtgagcggacaggcgggaaggcgaagaagggcgcggccgggcgcwaggycggcgggcgancgaagaagtcggtgtcgcggtcctccagggccgggctgcagttccccgtcagccgcgtcgggcgtacctcaaaaagggccgg

SEQ ID NO: 1962 - protein, 72 aa, Zea mays
  misc_feature: Ceres CLONE 259035-F
  misc_feature (41)..(41): Xaa is any aa, unknown, or other
  misc_feature (42)..(42): Xaa is any aa, unknown, or other
  misc_feature (46)..(46): Xaa is any aa, unknown, or other
HTFRLSTPKVPFFFSIWKRRSSSHGRERTGGKAKKGAAGRXXGGRXKKSVSRSSRAGLQFPVSRVGRTSKRA

SEQ ID NO: 1963 - DNA, 436 bp, Zea mays
  misc_feature: Ceres CLONE 259167-F
  misc_feature: Encodes the peptide sequence at SEQ ID NO. 1964
  misc_feature (309)..(309): n is a, c, t, g, unknown, or other
atcagaatcggaccaccacacgcccgaggcccgactgcaagcgcctgagcccaagacccatggccatggcgccgccaccgtcgcagcgtctctgcccgtggcgcaggggctcgggaagcccctctgcgccggaagcaacgcgccgtcgctccgggccgtcgcgggcgcgccccgtcgtcggtcggccaggaccaggatggccgtcgtccgggcgtccgcgcaaaakcagcacccggccaaggagtgggcggccgcggctgccgtggcggcggcgctgggtgcttccggagttcgcggaggccgcgccgnggatctccccgtcgctcaagaacttcctcctcagcatcgtctccggtggggtcgtgctcgtcgccatcgtcggcgccgtcgtcgccgtctctaacttcgatcccgtcagcggggttgagctgcatgc

SEQ ID NO: 1964 - protein, 125 aa, Zea mays
  misc_feature: Ceres CLONE 259167-F
  misc_feature (56)..(56): Xaa is any aa, unknown, or other
  misc_feature (84)..(84): Xaa is any aa, unknown, or other
MAMAPPPSQRLCPWRRGSGSPSAPEATRRRSGPSRARPVVGRPGPGWPSSGRPRKXSTRPRSGRPRLPWRRRWVLPEFAEAAPXISPSLKNFLLSIVSGGVVLVAIVGAVVAVSNFDPVSGVELH

SEQ ID NO: 1965 - DNA, 403 bp, Zea mays
  misc_feature: Ceres CLONE 259260-F
  misc_feature: Encodes the peptide sequence at SEQ ID NO. 1966
  misc_feature (334)..(334): n is a, c, t, g, unknown, or other
aaaaaacagaggaggaaaaaatatcaccttctcttcctgcattcccctgctcgatccccggcgaggaattcgccccgaatccatcgatttgctcagtccagtccgccgatccgtggatcgattcgtgcgtgggctctgtcctccccggggttccgatctggtcctcgcctcgccggagaggagctggaggaratkaacggcaccgggggcagccaccaccagcagcagcacaggctccggcagcagcagcagcagcaggcgctcctgatgcagcaggcgctcagcagcasagcagcaacatcagtaccagtccggcgtcctcgcgccgcggcanccgscyatttacccagatggaacctattttccaatggcaatcttccacctggctttgatccttccactt

SEQ ID NO: 1966 - protein, 134 aa, Zea mays
  misc_feature: Ceres CLONE 259260-F
  misc_feature (65)..(65): Xaa is any aa, unknown, or other
  misc_feature (97)..(97): Xaa is any aa, unknown, or other
  misc_feature (112)..(112): Xaa is any aa, unknown, or other
  misc_feature (113)..(113): Xaa is any aa, unknown, or other
  misc_feature (114)..(114): Xaa is any aa, unknown, or other
KKQRRKKYHLLFLHSPARSPARNSPRIHRFAQSSPPIRGSIRAWALSSPGFRSGPRLAGEELEEXNGTGGSHHQQQHRLRQQQQQQALLMQQALSSXAATSVPVRRPRAAAXXXLPRWNLFSNGNLPPGFDPST

SEQ ID NO: 1967 - DNA, 461 bp, Zea mays
  misc_feature: Ceres CLONE 259265-F
  misc_feature: Encodes the peptide sequence at SEQ ID NO. 1968
  misc_feature (279)..(279): n is a, c, t, g, unknown, or other
agaggaaaaatctcgcattcgtcaaaccaggcaaatggaggcatgagctccgccgcctccccgtctctcgccgatctcccccaaaccctagcctcgacctgaccgccagckggcccgcagccggagaaggagtcggagtcgcccccacccaccctctcctctgccgcgggcggggagcgggcggcggacgagatgccgtcgcacggggatctggaccggcagatcgcgcmstgcsacttgcaagtacctgcccgaggcggaggtcaaggcgctctgsancaggccaaggccatccttatggaggaatggaacgtgcagcccgkgcgctgccccgtcaccgtctgcggcgacatccacggccagttctatgacctcatcgagctcttccgcatcggcggcgactctcccgacaccaactacctcttcatgggcgactacgtsatcgtggctactattcagtt

SEQ ID NO: 1968 - protein, 89 aa, Zea mays
  misc_feature: Ceres CLONE 259265-F
  misc_feature: SWISSPROT Homolog: EC 3.1.3.16 Phosphoprotein phosphatase
  misc_feature (13)..(13): Xaa is any aa, unknown, or other
  misc_feature (15)..(15): Xaa is any aa, unknown, or other
  misc_feature (29)..(29): Xaa is any aa, unknown, or other
  misc_feature (44)..(44): Xaa is any aa, unknown, or other
MPSHGDLDRQIAXCXLQVPARGGGQGALXQAKAILMEEWNVQPXRCPVTVCGDIHGQFYDLIELFRIGGDSPDTNYLFMGDYVIVATIQ

SEQ ID NO: 1969 - DNA, 389 bp, Zea mays
  misc_feature: Ceres CLONE 259342-F
  misc_feature: Translation starting site: 74
  misc_feature (235)..(235): n is a, c, t, g, unknown, or other
  misc_feature (379)..(379): n is a, c, t, g, unknown, or other
actcatacatttcgactctcaactcccaaggtccctttttttttctcgatctggaagcgccgcagtagcagccatggacgtgagtggagcaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcaskgtanggcacgggtcccccgtctacctcgccgccgtcctggagtacctcgcggccgaggtgctcgagctcgccggcaacgscaagggacaacaagaagacgcgcatcattccgcgccacgtgctcctcgccatccgcaacgacgagganctcggcaagc

SEQ ID NO: 1970 - DNA, 448 bp, Zea mays
  misc_feature: Ceres CLONE 259481-F
  misc_feature: Encodes the peptide sequence at SEQ ID NO. 1971
  misc_feature (70)..(70): n is a, c, t, g, unknown, or other
aaaaaatgtctccccgcaaagagaccaaaaccctagccgtcaccccgtaacctcactggcggccatggbnttctccggcaggatcaagcagctcgtgaagaagtacggcaaggtggccgcgggcgtccatctatccgtctcctttgcctccatcttcggcctctacgctgccatcaacaacaacgtcgacgtcgaagccgtcttccggagatttggcatctcccccggcgttgccgtcgacggggaggcctcaccctcacccgcccctgtctcccgcgatgagcacctgcaacacgcctccctagcgccctgtcctagtgaggtactgcaagaagagtcggagcagcggcagccccgcaacaggacgatggagctcgtggcgttgagtggaggccgctcgggttcgcgctcctctgcaactcacgccgcccgtcgccagggcccttag

SEQ ID NO: 1971 - protein, 127 aa, Zea mays
  misc_feature: Ceres CLONE 259481-F
  misc_feature (2)..(2): Xaa is any aa, unknown, or other
MXFSGRIKQLVKKYGKVAAGVHLSVSFASIFGLYAAINNNVDVEAVFRRFGISPGVAVDGEASPSPAPVSRDEHLQHASLAPCPSEVLQEESEQRQPRNRTMELVALSGGRSGSRSSATHAARRQGP

SEQ ID NO: 1972 - DNA, 236 bp, Zea mays
  misc_feature: Ceres CLONE 259543-F
  misc_feature: Pfam Name: Transferase Pfam Description: Transferase family
  misc_feature (48)..(48): n is a, c, t, g, unknown, or other
  misc_feature (49)..(49): n is a, c, t, g, unknown, or other
cccaacaaattcccgagacgccattctcaccatccacacaaagccacnncccaagagcagagtcgtcgtcgtcgtcgggcatggcggggttcaaggtgacgcggatctcggagggccccgtgaagccggcgtcggcgacsckgtatkgagacgctgccgctggcttgggtggaccggtacccgacgcaccgtggccttgwggagtcgatgcacatcttccggtcgggcgcgggcta

SEQ ID NO: 1973 - DNA, 103 bp, Zea mays
  misc_feature: Ceres CLONE 259563-F
acacgcacaccgcgacccagtccagagccagtacgtgcgamrcaacgcacgctgctggtccgcgtacsagaacgacggtcaggtcggccggtgcttttcagtt

SEQ ID NO: 1974 - DNA, 450 bp, Zea mays
  misc_feature: Ceres CLONE 259583-F
  misc_feature: Encodes the peptide sequence at SEQ ID NO. 1975
  misc_feature (250)..(250): n is a, c, t, g, unknown, or other
atcaatcaaatactcagacaaccatggggcacagcaggcgcmacggcaaggacgacaccgaggagctgcttgcmsccaccggcagctgtggtgccatgccctgggctacgtcaagtccatggcgctcaagtgcgcctggacctgcgcatccccgacaccatcgaccgctgcggcggagcgccaccctgggcgagctgctcgcgccagcgagatcccggcgtccaaccacgactacctccggcgggtcatncgcacgctgacagccatgcgcatcttcgcggccagccacgaccccgccaaggccgacgacgcggccgccatctcctaccagctgaccccggcgtcccggctgctcgtcagcagcagcagcgtcgacgaccgccgsgcctcgaaggacaacactactacccccgagcatcctccccaacatcgcccacctggtccgcccca

SEQ ID NO: 1975 - protein, 149 aa, Zea mays
  misc_feature: Ceres CLONE 259583-F
  misc_feature (14)..(14): Xaa is any aa, unknown, or other
  misc_feature (25)..(25): Xaa is any aa, unknown, or other
  misc_feature (83)..(83): Xaa is any aa, unknown, or other
SIKYSDNHGAQQAXRQGRHRGAACXHRQLWCHALGYVKSMALKCAWTCASPTPSTAAAERHPGRAARASEIPASNHDYLRRVXRTLTAMRIFAASHDPAKADDAAAISYQLTPASRLLVSSSSVDDRRASKDNTTTPEHPPQHRPPGPP

SEQ ID NO: 1976 - DNA, 274 bp, Zea mays
  misc_feature: Ceres CLONE 259777-F
  misc_feature: Encodes the peptide sequence at SEQ ID NO. 1977
  misc_feature (254)..(254): n is a, c, t, g, unknown, or other
  misc_feature (269)..(269): n is a, c, t, g, unknown, or other
acaactcacaattcacatcgaggtctcagcttcaggaaarggaaggaagcatgttcgggcacaccaccaccacggccacggcgggcaccaccaggccccgccgccgcacgagcagacgctgttcaggatcttctgccgcgccgacgagstgactkcctcaccgtgcgccacgacgccgtstcctcgcgcccaccaacccccgcgacgagtaccagcactggtacaaggacattaggcacarcacgaaggttaangacgcggagggccanccggc

SEQ ID NO: 1977 - protein, 77 aa, Zea mays
  misc_feature: Ceres CLONE 259777-F
  misc_feature (50)..(50): Xaa is any aa, unknown, or other
  misc_feature (52)..(52): Xaa is any aa, unknown, or other
  misc_feature (60)..(60): Xaa is any aa, unknown, or other
QLTIHIEVSASGKGRKHVRAHHHHGHGGHHQAPPPHEQTLFRIFCRADEXTXSPCATTPXPRAHQPPRRVPALVQGH

SEQ ID NO: 1978 - DNA, 528 bp, Zea mays
  misc_feature: Ceres CLONE 259838-F
  misc_feature: Encodes the peptide sequence at SEQ ID NO. 1979
  misc_feature (496)..(496): n is a, c, t, g, unknown, or other
agataacaagcggccccaccacaccgctgcagtcgccgtgctcgcgcatggagcttggaggcggagggcgaggcggcggcgaccgggtccggcggcagttgcagtcggtggggcggctggcagcgtatctcggcggcggtttcctcctcctctccgccacctcttccgtcgccgtccgcgccctccgcgccatctccgacgccaaccagaggaagttcgcgavcgtgcggttgcctgcgaggggaagggcagctactcgtgcaggctctgcaggggcagcgccaccatcgagtggtctccgatgcacgacccggtgttcgtgaatccgtgcctctgccctacctgcgatgggactcgggtgcagcgctggcttgaactgcctgggaaatggttacgcttgaagaagcgatgtcagttttcattatcgatgatagatgggttgttggggagttggtaaggaaacaattcgaaatttactgatgaattcgttgccttngtgtgattataattgctgtgagtctatgattt

SEQ ID NO: 1979 - protein, 91 aa, Zea mays
  misc_feature: Ceres CLONE 259838-F
  misc_feature (59)..(59): Xaa is any aa, unknown, or other
MELGGGGRGGGDRVRRQLQSVGRLAAYLGGGFLLLSATSSVAVRALRAISDANQRKFAXVRLPARGRAATRAGSAGAAPPSSGLRCTTRCS

SEQ ID NO: 1980 - DNA, 469 bp, Zea mays
  misc_feature: Ceres CLONE 259960-F
  misc_feature: Encodes the peptide sequence at SEQ ID NO. 1981
  misc_feature (273)..(273): n is a, c, t, g, unknown, or other
gacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgttacgagccgtttgatgaggacttcgagggtagatggatcgtctccaagaaggattaaattaccaaggtgttatggaagcatgccaagagttgatgggcatgaggactatggcctccttgttagtgacaaggcaangaaatacgccataatcaaggagcttkatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttcgtcca

SEQ ID NO: 1981 - protein, 106 aa, Zea mays
  misc_feature: Ceres CLONE 259960-F
  misc_feature (41)..(41): Xaa is any aa, unknown, or other
  misc_feature (50)..(50): Xaa is any aa, unknown, or other
MRTSRVDGSSPRRIKLPRCYGSMPRVDGHEDYGLLVSDKAXKYAIIKELXEPVTLNDGTVVLQFEVRLQNGLECGGAYIKYIRPQDAGWDAKEFDNETPYTIMFRP

SEQ ID NO: 1982 - DNA, 513 bp, Zea mays
  misc_feature: Ceres CLONE 259984-F
  misc_feature: Translation starting site: 89
  misc_feature: SWISSPROT Homolog: EC 2.3.1.74 Naringenin-chalcone synthase
  misc_feature: SWISSPROT Homolog: EC 2.3.1.95 Trihydroxystilbene synthase
  misc_feature (81)..(81): n is a, c, t, g, unknown, or other
  misc_feature (200)..(200): n is a, c, t, g, unknown, or other
  misc_feature (354)..(354): n is a, c, t, g, unknown, or other
attcaacctctagctgattgatctctggtttaccactctttccttccctccttcaattctaaataccacaaatcaaagttnctttgcgatggtgagcagcagcatggacacgacgagtgacaaacgtgcgtcatccatgctggctcctaaccctggcaaggccacgatcctcgcccttggccacgccttcccgcagcagndtgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccgganctggcgcaggaggggctgccgacgatgaatcagcgtctggacatctcgaaacgcggcggtgacsagatggcgacggaggcgtccctgtcgtgcgtccgctcgtggggcggcgcgctctcgtccatcacccacctcgtgtacgtctcgtcggagcgaggg

SEQ ID NO: 1983 - DNA, 444 bp, Zea mays
  misc_feature: Ceres CLONE 260015-F
  misc_feature: Encodes the peptide sequence at SEQ ID NO. 1984
aatattctaagacacctggtggacgctgttctcacgaagcccgccgttcggagttctacaatcccaaatagcatcgtcatcgcaaaatgcaggcgctcctactccccgcgcgggccgscgccgccgccgsattccttcggcagcgtgcggtttccgcgtccacgtgtgcgtcgcagggctgccgcctcctactcggtgcctctggttgtctcagctgtggggtaagatctcggctgcgcttcacagtggtggcggcgtcatcgtcctcgtcgggaccggctatacccgacgcctccacccaccgaggagggaggtggagcgggtcaagctcgagcaggttatgaggagacttagagaaaacagcaaggtatttcaagaatttgggtacctgggggttctgggtcccagttggtgtgcacaattgtctctgctggaattttggca

SEQ ID NO: 1984 - protein, 85 aa, Zea mays
  misc_feature: Ceres CLONE 260015-F
  misc_feature (11)..(11): Xaa is any aa, unknown, or other
  misc_feature (15)..(15): Xaa is any aa, unknown, or other
MQALLLPARAXAAAXFLRQRAVSASTCASQGCRLLLGASGCLSCGVRSRLRFTVVAASSSSSGPAIPDASTHRGGRWSGSSSSRL

SEQ ID NO: 1985 - DNA, 354 bp, Zea mays
  misc_feature: Ceres CLONE 260023-F
  misc_feature: Encodes the peptide sequence at SEQ ID NO. 1986
aatctcgataggggtgcgcgaggacgakgagaaaaaacagaggbtgaaaaaatatcaccttctcttcctgcattcccctgctcgatccccggcgaggaattcgccccgaatccatcgatttgctcagtccagtccgccgatccgtggatbbattcgtgcgtgggctctgtcctccccggggttccgatctggtcctcgcctcgccggagaggagctggaggagatgaacggcaccgggggcagccaccaccagcagcagcacaggctccggcagcagcagcagcagcaggcgctcctgatgcagcaggcgctsagcagcasagcagcaacatcagtaccagtccggcgtcctcg

SEQ ID NO: 1986 - protein, 43 aa, Zea mays
  misc_feature: Ceres CLONE 260023-F
  misc_feature (33)..(33): Xaa is any aa, unknown, or other
MNGTGGSHHQQQHRLRQQQQQQALLMQQALSSXAATSVPVRRP

SEQ ID NO: 1987 - DNA, 502 bp, Zea mays
  misc_feature: Ceres CLONE 260038-F
  misc_feature: Encodes the peptide sequence at SEQ ID NO. 1988
  misc_feature (427)..(427): n is a, c, t, g, unknown, or other
  misc_feature (440)..(440): n is a, c, t, g, unknown, or other
acttcgcaaaccctcctaccccattccgccgcccgccccgsgaccccgaggaggaggcaagatgaagacgatcctggcgtcggagvattggacatcccggagcgttcacagtgacggtggcggccaagctggtgacggtggagggcccccgcggtaagctcacccggaacttcaagcacctcaacctcgacttccagctgcaggagggcggccgcaagctcaaggtggacgcatggttcggcacccgcscaccatggccgccatccgcaccgccatctcccacgtccagaacctcatcaaggggggtcaccaagggctaccgctacaagatgaggtttgtctacgcccatttccccatcaacgcgtccatcaccaactccaacaccgccatcgagataaggaacttcctcggcgagaagaaggtcanaaaggtggacatnctttacggcgtgaccatcctccgctccgagaaggtcaaggacgagctttatttctcgatggc

SEQ ID NO: 1988 - protein, 57 aa, Zea mays
  misc_feature: Ceres CLONE 260038-F
  misc_feature (33)..(33): Xaa is any aa, unknown, or other
  misc_feature (37)..(37): Xaa is any aa, unknown, or other
MRFVYAHFPINASITNSNTAIEIRNFLGEKKVXKVDXLYGVTILRSEKVKDELYFSM

SEQ ID NO: 1989 - DNA, 285 bp, Zea mays
  misc_feature: Ceres CLONE 260046-F
  misc_feature: Encodes the peptide sequence at SEQ ID NO. 1990
  misc_feature (59)..(59): n is a, c, t, g, unknown, or other
  misc_feature (126)..(126): n is a, c, t, g, unknown, or other
  misc_feature (177)..(177): n is a, c, t, g, unknown, or other
  misc_feature (231)..(231): n is a, c, t, g, unknown, or other
actcatacatttcgactctcaactcccaaggtccctttttttttctcgatctggaagcnccgcagtagcagccatggacgtgagcggacaggcggtaaggcgaagaagggcgcggcggggcgcaangycggcgggcgacgaagaagtcggtgtcgcggtcctccaggggccgggctncagttccccgtcagccgcgtcgggcggtacctcaaaaagggccggtacgcgcangtatggcacgggttccccgtytacctcgccgccgtcctggagtacctcgcggcc

SEQ ID NO: 1990 - protein, 95 aa, Zea mays
  misc_feature: Ceres CLONE 260046-F
  misc_feature (20)..(20): Xaa is any aa, unknown, or other
  misc_feature (42)..(42): Xaa is any aa, unknown, or other
  misc_feature (43)..(43): Xaa is any aa, unknown, or other
  misc_feature (77)..(77): Xaa is any aa, unknown, or other
THTFRLSTPKVPFFFSIWKXRSSSHGRERTGGKAKKGAAGRXXGGRRRSRCRGPPGAGLQFPVSRVGRYLKKGRYAXVWHGFPVYLAAVLEYLAA

SEQ ID NO: 1991 - DNA, 506 bp, Zea mays
  misc_feature: Ceres CLONE 260066-F
  misc_feature: Translation starting site: 188
  misc_feature: Pfam Name: Ran_BP1 Pfam Description: RanBP1 domain
gaggacgtcctgctcgacatgaaggcgamgtgtaccggtttgataaagacgggaatcaatggaaggaacggggcacgggcaccgtcaagcttctcaagaacaaggagaccggcaaggtccgactcgtcatgcgccaggccaagacgcttaagatctgcgcgaaccacctcgtgcccccaccacgagaatgcaggaacatgccggcagcgacaaatcgtgcgtctggcacgcttctgactttgcggatggcgaactcaaggaggagatgtttgccatcaggtttggttcggtagaaaactgcaagaagttcaaggagttggttgaggagattgctgagtcacttacagagaacgaggacaaggaaggtcaagatggctcttccacggccggattgctggagaagctcactgtgagcgagggcaaatctgaggaaagtggcaagtcggagtccactgatttgccctaactcattctttcacttctccagccgtcacagacaaccggcc

SEQ ID NO: 1992 - DNA, 449 bp, Zea mays
  misc_feature: Ceres CLONE 260154-F
  misc_feature: Encodes the peptide sequence at SEQ ID NO. 1993
  misc_feature (45)..(45): n is a, c, t, g, unknown, or other
  misc_feature (228)..(228): n is a, c, t, g, unknown, or other
agttttgccaccaaggtcacaccatccaccacggccatggagtcnggcgcagasaggtggcgttcgagtccccggcacatttccgcatctacaagagcgggaggatcgagcgcctgaaccggcccccggtccttcccgccggcctcgacgaggcaccggtgtcacctcaaaggacgtcgtctggacgccggcaccggsctttccgtacgcatctatctcyccaagcdnaggaaccatccaagaagctcccggtcctcgtctacttccacggcggcgcgttcctcctcgagtcggccggctctgcacgtaccacacctacgtcaacccactcgcagccgccgcggggcgtcctggtggtgtccgtggactaccgcctggcaccggagcacccggtcccggcggcctacgagggactcgtgggccgcgctccagtgggtgacgtcggcgca

SEQ ID NO: 1993 - protein, 149 aa, Zea mays
  misc_feature: Ceres CLONE 260154-F
  misc_feature: SWISSPROT Homolog: EC 3.1.1.3 Triacylglycerol lipase
  misc_feature (15)..(15): Xaa is any aa, unknown, or other
  misc_feature (18)..(18): Xaa is any aa, unknown, or other
  misc_feature (66)..(66): Xaa is any aa, unknown, or other
  misc_feature (73)..(73): Xaa is any aa, unknown, or other
  misc_feature (76)..(76): Xaa is any aa, unknown, or other
FCHQGHTIHHGHGVXRRXVAFESPAHFRIYKSGRIERLNRPPVLPAGLDEAPVSPQRTSSGRRHRXFRTHLSXQAXEPSKKLPVLVYFHGGAFLLESAGSARTTPTSTHSQPPRGVLVVSVDYRLAPEHPVPAAYEGLVGRAPVGDVGA

SEQ ID NO: 1994 - DNA, 172 bp, Zea mays
  misc_feature: Ceres CLONE 260269-F
  misc_feature (85)..(85): n is a, c, t, g, unknown, or other
  misc_feature (126)..(126): n is a, c, t, g, unknown, or other
ccctcacagtcacagacacacaccgctgcttcaagaaaccaccgagagcccaaccgcacaggcaggagagagagcagggagccanggacagtagcgtggggccggggagcaacgatggaggggaangaggaggacgtgcgcctgggcscaacaagttctcggagcgtcaccc

SEQ ID NO: 1995 - DNA, 416 bp, Zea mays
  misc_feature: Ceres CLONE 260300-F
  misc_feature: Translation starting site: 130
  misc_feature: Pfam Name: Tim17 Pfam Description: Tim17/Tim22/Tim23 family
  misc_feature (32)..(32): n is a, c, t, g, unknown, or other
  misc_feature (297)..(297): n is a, c, t, g, unknown, or other
  misc_feature (409)..(409): n is a, c, t, g, unknown, or other
ggttagttgtttcacacggacgcgcgtttgtngcgatcgacgatcgagaaaatcctagggttttcctctctcgccgccgccgacttaaagaggacagaggagtaggcgaagtagcgccgggagaggaacatggggacgccggagacgtcgcgggagccgtgcccggaccggatcctggacgacgtcggcggcgcgttcgggatgggcgccgttggsgctccgctatcacttcatcaagggcatctacaactcccccaacggatgcgcctgttycggagcgcgcagaccgtgcgcatnaacgcgccgcgtgtggggggcagcttcgccgtctggggcggcctcttctccaccttcgactgcgccatggtgtacgcgcgccataaggaggatccttggaactccatcgttncgggcgc

SEQ ID NO: 1996 - DNA, 421 bp, Zea mays
  misc_feature: Ceres CLONE 260397-F
  misc_feature: Encodes the peptide sequence at SEQ ID NO. 1997
  misc_feature (154)..(154): n is a, c, t, g, unknown, or other
  misc_feature (249)..(249): n is a, c, t, g, unknown, or other
  misc_feature (289)..(289): n is a, c, t, g, unknown, or other
  misc_feature (303)..(303): n is a, c, t, g, unknown, or other
atccactaccgcagccgcagcccagcaccggccgctctwcgccggcacgtcctcgtttctktccgargtcatcgcctccgcaacttcgtggccggtgaggtcgcaccaccatggcgtcgctcctagcccggcaggcagcgcaggcgctccgsgnaggcaaacggcgcmstcgggccggccgcgtcggsgatgcaagggcactccgtacctacatgaacgcggggattcccaagcggttcaaagaggatnaggagaaagaacagctttcaaaagatctcgcaaaagattngaatgctgtgtttnaaaggagcatcaatacattgtttttgactgaaatggtccgtggcttgatgctaactctcaagtacttctttgatagaaatgtcacaattaactatccgtttgagaagggtcctctgag

SEQ ID NO: 1997 - protein, 103 aa, Zea mays
  misc_feature: Ceres CLONE 260397-F
  misc_feature: SWISSPROT Homolog: EC 1.6.5.3 NADH dehydrogenase (ubiquinone)
  misc_feature (15)..(15): Xaa is any aa, unknown, or other
  misc_feature (20)..(20): Xaa is any aa, unknown, or other
  misc_feature (47)..(47): Xaa is any aa, unknown, or other
  misc_feature (60)..(60): Xaa is any aa, unknown, or other
  misc_feature (65)..(65): Xaa is any aa, unknown, or other
MASLLARQAAQALRXGKRRXRAGRVGDARALRTYMNAGIPKRFKEDXEKEQLSKDLAKDXNAVFXRSINTLFLTEMVRGLMLTLKYFFDRNVTINYPFEKGPL

SEQ ID NO: 1998 - DNA, 468 bp, Zea mays
  misc_feature: Ceres CLONE 260414-F
  misc_feature: Encodes the peptide sequence at SEQ ID NO. 1999
accatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaagattgaaattttctcactcatgatgtttgttctcaaaaaaaaaaaaaaaaag

SEQ ID NO: 1999 - protein, 56 aa, Zea mays
  misc_feature: Ceres CLONE 260414-F
  misc_feature (3)..(56): Pfam Name: Ribosomal_S14 Pfam Description: Ribosomal protein S14p/S29e
MGHSNVWNSHPKNYGPGSRVCRVCANPHGLIRKYGLMCCRQCFRSNAKDIGFIKYR

SEQ ID NO: 2000 - DNA, 452 bp, Zea mays
  misc_feature: Ceres CLONE 260468-F
  misc_feature (228)..(228): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcrbtnaggcacgggtgcccccgtctacctcgccgccgtcctggagtacctcgcggccgaggtgctcgagctcgccggcaacgscaagggacaacaagaagacgcgcatcattccgcgccacgtgctcctcgccatccgcaacgacgaggagctcggcaagctgctggccggcgtcaccatcgcccacggsgtcgttcctccccaacatccacactgtgctcctccccaa

SEQ ID NO: 2001 - DNA, 320 bp, Zea mays
  misc_feature: Ceres CLONE 260470-F
  misc_feature: Encodes the peptide sequence at SEQ ID NO. 2002
aaggcaaagcaacacttgcttgtccagtaagtgaaggaagcggcastgtccatcatccctcattctcagtttggggtcctgggcctgtggctgtggtggagagaggtcaggagtggagcraggtcggaggaggtcaccacaccagcagcggcgacgacgatgctgatcctggacctggcgatctggatcatcccggtgacgctcgtcctcgtgccgttccgsggctggtggtcctggtggccaggctgcaggagctggaggagtgcatcatgcggccgcggcscgactcatggactcgtgggcgtggggccgcgtcgcgc

SEQ ID NO: 2002 - protein, 106 aa, Zea mays
  misc_feature: Ceres CLONE 260470-F
  misc_feature (15)..(15): Xaa is any aa, unknown, or other
  misc_feature (40)..(40): Xaa is any aa, unknown, or other
  misc_feature (74)..(74): Xaa is any aa, unknown, or other
  misc_feature (94)..(94): Xaa is any aa, unknown, or other
GKATLACPVSEGSGXVHHPSFSVWGPGPVAVVERGQEWSXVGGGHHTSSGDDDADPGPGDLDHPGDARPRAVPXLVVLVARLQELEECIMRPRXDSWTRGRGAASR

SEQ ID NO: 2003 - DNA, 471 bp, Zea mays
  misc_feature: Ceres CLONE 260506-F
  misc_feature: Encodes the peptide sequence at SEQ ID NO. 2004
  misc_feature (340)..(340): n is a, c, t, g, unknown, or other
  misc_feature (344)..(344): n is a, c, t, g, unknown, or other
  misc_feature (401)..(401): n is a, c, t, g, unknown, or other
acggcgtctttgggtgagcacaccgcgcmraacgagaggggcaaacaagcttgctactgtgatttctcgtccgagcagcgcgaggagagakagakagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaacatttaaggccaagatctaccgccttttcggcccgggagatgcccgtccactccgtcctcggcggcggcaagtctgccgatcttatcctatggargaacangaanatctctcgcggggtactttctggtgccacagccatctggctcctattcgaggtcatngagtaccatctcctcaccttggtgtgccactgtctcatcctctcgctggccatcctcttcctgtggtcca

SEQ ID NO: 2004 - protein, 124 aa, Zea mays
  misc_feature: Ceres CLONE 260506-F
  misc_feature (79)..(79): Xaa is any aa, unknown, or other
  misc_feature (81)..(81): Xaa is any aa, unknown, or other
  misc_feature (82)..(82): Xaa is any aa, unknown, or other
  misc_feature (101)..(101): Xaa is any aa, unknown, or other
MADHKEEPVPESVMDKITEKFHGGDSSSSSSDSDDEKKGSSLASAAEHLRPRSTAFSAREMPVHSVLGGGKSADLILWXNXXISRGVLSGATAIWLLFEVXEYHLLTLVCHCLILSLAILFLWS

SEQ ID NO: 2005 - DNA, 480 bp, Zea mays
  misc_feature: Ceres CLONE 260536-F
  misc_feature: Translation starting site: 303
  misc_feature (343)..(343): n is a, c, t, g, unknown, or other
aaactgcggatagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacasrcttgtggttcgcgtccaagcagtccctctcctacctcgatggcacgctgcccggcgactatggcttcgacccgctgggcctctcggacccggagcaccgngggcttcatcgagcccaagtggctggcctacggcgaggtgatcaacggccgctacgccatgctgggcgcggtggggcscattcgcccggagatcttcggcaagatgggcatcatcccgccggagaccgcgctgccgt

SEQ ID NO: 2006 - DNA, 490 bp, Zea mays
  misc_feature: Ceres CLONE 260571-F
  misc_feature (98)..(98): n is a, c, t, g, unknown, or other
  misc_feature (177)..(177): n is a, c, t, g, unknown, or other
gcaccaccaccgtcactcaacacagcacaggcagctcgagagakagagagagagaaagatgtcgtggttcgggcaccaccaccacaaccagccggctnccccggcgtcgggccccaaccaggtgttcaagatcttctgccgcgccaacgagaactactgcctggccgtccgcgacgnccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcgaccagtcccacccggtcaagctcgcgcctttcagcccggaccaggaggacgcgtcggtgctgtggacggagagcaaggacgtgggcaagggcdtccgctgcatccgcatggtcaacaacacccgcctcaacttcgacgccttccacggcgacaaggaccacgg

SEQ ID NO: 2007 - DNA, 698 bp, Zea mays
  misc_feature: Ceres CLONE 260619
  misc_feature: Encodes the peptide sequence at SEQ ID NO. 2008
aaacacacacacacacaaacagaaaactgagtcagagaggtgcagatcaatgcggcggtggtggtgcgccgccggcggcctcgcccgctgcgtcctctcgtcctccacctccgccatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtcggcgcatcatcagcaagtgcggcactacgccaagaaggagaggtcgcgcgctccgctcacgcccactaaatccaaagtcaagaaatacaagatgaaggccccctcgtccatgaagttcagattcagaaccatgaaagacggacaggtccgcaggtggagggccagtagtgtgtgtgtgtgtgcgcgcgcgcgcgagctcgtctttgccggtggtgactctggatttggatcaccttccgaactgaactgaaaataaggaagcgtgaatccgggggccagttaaagatggtggtatggtatggtagcggcgttgtactagatgcgtgatgggacgatggttacggaccatgatgatgacgctgtgttccatttagctctctgctgcgtgcttttgtataaaagaagtggttcgatgtcgcaaaaaaaaaaaaaaaaaa

SEQ ID NO: 2008 - protein, 153 aa, Zea mays
  misc_feature: Ceres CLONE 260619
MRRWWCAAGGLARCVLSSSTSAIASHARPLPAPLMPKSPSFTVPFSLSCRRHHSLQGFFHLVIASSFRPPSAHHQQVRHYAKKERSRAPLTPTKSKVKKYKMKAPSSMKFRFRTMKDGQVRRWRASSVCVCARARELVFAGGDSGFGSPSELN

SEQ ID NO: 2009 - DNA, 387 bp, Zea mays
  misc_feature: Ceres CLONE 260676-F
  misc_feature: Encodes the peptide sequence at SEQ ID NO. 2010
  misc_feature (135)..(135): n is a, c, t, g, unknown, or other
  misc_feature (323)..(323): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcabgtaggcacgggtgcccccgtctacctcgccgccgtcctggagtacctcgcggccgagtgctcgagctcgccggcaacgscaaggggacaacaagaanacgcgcatcattccgcgccacgtgctcctcgccatccgcaacgacgaggagctcggcaagctgc

SEQ ID NO: 2010 - protein, 74 aa, Zea mays
  misc_feature: Ceres CLONE 260676-F
  misc_feature (45)..(45): Xaa is any aa, unknown, or other
TFRLSTPKVPFFFSIWKRRSSSHGRERTGGKAKKGAAGRKAGGRXKKSVSRSSRAGLQFPVSRVGRTSKRAGTR

SEQ ID NO: 2011 - DNA, 137 bp, Zea mays
  misc_feature: Ceres CLONE 260678-F
acacgcacaccgcgacccagtccagagccagtacgtgcgamggcacgcacgctgctggtccgcgtacsagacgacggtcaggtcggccggtgcttttcagtttggaataatgacggcgacgacgacgacagccgccg

SEQ ID NO: 2012 - DNA, 406 bp, Zea mays
  misc_feature: Ceres CLONE 260686-F
  misc_feature: Translation starting site: 70
  misc_feature (134)..(134): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggccaaggccggcgggcgancgaagaagtcggtgtcgcggtcctccagggccgggctgcagttccccgtcagccgcgtcgggcggtacctcaaaaagggccggtacgcgcrgtaggcacgggttcccccgtctacctcgccgccgtcctgggagtacctcgcggccgagtggctcgagctcgccggcaacgscaaagggacaacaagaagacgcgcatcattccgcgccacgtgctcctcgccatccgcaacgacgaggagctcggcaagctgctggccggcgtcaccatcg

SEQ ID NO: 2013 - DNA, 429 bp, Zea mays
  misc_feature: Ceres CLONE 260718-F
  misc_feature (119)..(119): n is a, c, t, g, unknown, or other
  misc_feature (254)..(254): n is a, c, t, g, unknown, or other
  misc_feature (272)..(272): n is a, c, t, g, unknown, or other
atcgcagaaattctccgcaacttcacagcgtatcatcgttttccatcgctcctactcctatcatccagaaaatctgagcggtattgatggcgcccaaggsgagaagaagccggcggcrnagaaggtggcggaggaggagccctcggagaaggcggctccggcggagaaggcccccgcggwaagaaggycaaggcggagaagcggctacctgcgggcaagtccgccggcaatgatggcggcgayaagawggggangaataaggcgaakaagancgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggttacaacaa

SEQ ID NO: 2014 - DNA, 216 bp, Zea mays
  misc_feature: Ceres CLONE 260764-F
atcacaattcacagcgctcaagttctcgcgcccacagccaaatttttctccactcaatcgcggcataagctgcactgcmscatggacgccagcggascggtagcaaggcgaagaagggggcggctggbcgcaaggtctggcggccccaggaagaagtcggtgttcgcggtccgtcaaggccgggctgcagttccccgttcggccggatcgggcgct

SEQ ID NO: 2015 - DNA, 475 bp, Zea mays
  misc_feature: Ceres CLONE 260766-F
acttgtgacagtttctcatacatcacagacaatgaataccaagaagaatgttgttctttgctgccttcttttcgtgctcgttctgcatgcagatcacgctctagccaagtgtggctatacaactcctttaattccattctgcaaagcgtggatgtgcaaggcggagtgttggacggaggctaagttaactggaggcaaagtcacgcaacagaagtgcatgagaggcgggatcaagggctggtgttactgcgaattctgcatttaattttgcaaaggagaaggatcaccatttctttgcttggtcttgccttggtcaataacttagtgtaataatgctagttaagtctctaggcagactaggctagatcgagttgtttgttgttggtagctaggcattgctagcgtctgctattgttttaagatattttattgttagttgaacaattatgtcaatgtccatctgtcagagattagt

SEQ ID NO: 2016 - DNA, 500 bp, Zea mays
  misc_feature: Ceres CLONE 260882-F
  misc_feature: Translation starting site: 308
actcacaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgca

SEQ ID NO: 2017 - DNA, 413 bp, Zea mays
  misc_feature: Ceres CLONE 261082-F
  misc_feature: Translation starting site: 67
  misc_feature (188)..(188): n is a, c, t, g, unknown, or other
agcagcacactcccgcagtagcagcagccgccgccgccgccgcccagccgcagaaacaggaggaagatgccggcggggcacgggcttcggtcgcggacccgcsatttcgcgcggccgttccgcaagaagggttacatcccgctcaccacgtacctgcgcacctacaagatcggcgactacgtcsastncaaaggtgaacggcgccgtgcacaagggcatgccgcacaagttctaccacggccgcaccggtcgcgtctggaacgtcaccaagcgcgccatcgstttgagatcaacaagcaggttaatggccgcatcatcaggaagcgtatccatgtccgtgtggagcatgtgcagccctcccgttgcacagaggaggagttccgcttgaggaaagccaagaacgatcagctgaa

SEQ ID NO: 2018 - DNA, 496 bp, Zea mays
  misc_feature: Ceres CLONE 261084-F
  misc_feature: Encodes the peptide sequence at SEQ ID NO. 2019
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctc

SEQ ID NO: 2019 - protein, 137 aa, Zea mays
  misc_feature: Ceres CLONE 261084-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTRWRRRRPCRASARGAARSRPSPTSCTS

SEQ ID NO: 2020 - DNA, 483 bp, Zea mays
  misc_feature: Ceres CLONE 261130-F
  misc_feature: Encodes the peptide sequence at SEQ ID NO. 2021
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
atcggattcacggaccaatcctcgtcttctcccaattctcattgcatcgaatcgggctcgatgctgcccctctccctcttcgtttccctcttggtgctccctctcccccacgcatccgccgacggacatctgcatcatcggcggtggcatctccggcgcctccaccgccttcttcctcaccagctacaccagcaccctcggtggagcgcactgcgcgttttgagcgccgtcagaaggtgggcggccgctgggcaccgtcactctcgcgggcgacasttcgaggccgggggctccatcatccacccccgcaacctccackcgcgccgcttnnncgacctcctgggactcgccgtgaagaccggcggcgacgkcgacggcgacgactggctagggatctgggacggcaaaagcttcgtcttccagacggcccgcccacctcctgtcggcagctcctggtggcggcgcaactgcacagtctcgtca

SEQ ID NO: 2021 - protein, 141 aa, Zea mays
  misc_feature: Ceres CLONE 261130-F
  misc_feature (72)..(72): Xaa is any aa, unknown, or other
  misc_feature (87)..(87): Xaa is any aa, unknown, or other
  misc_feature (90)..(90): Xaa is any aa, unknown, or other
  misc_feature (91)..(91): Xaa is any aa, unknown, or other
  misc_feature (104)..(104): Xaa is any aa, unknown, or other
MLPLSLFVSLLVLPLPHASADGHLHHRRWHLRRLHRLLPHQLHQHPRWSALRVLSAVRRWAAAGHRHSRGRXFEAGGSIIHPRNLHXRRXXDLLGLAVKTGGDXDGDDWLGIWDGKSFVFQTARPPPVGSSWWRRNCTVSS

SEQ ID NO: 2022 - DNA, 408 bp, Zea mays
  misc_feature: Ceres CLONE 261198-F
  misc_feature: Encodes the peptide sequence at SEQ ID NO. 2023
  misc_feature (182)..(182): n is a, c, t, g, unknown, or other
  misc_feature (184)..(184): n is a, c, t, g, unknown, or other
  misc_feature (244)..(244): n is a, c, t, g, unknown, or other
  misc_feature (337)..(337): n is a, c, t, g, unknown, or other
  misc_feature (339)..(339): n is a, c, t, g, unknown, or other
  misc_feature (351)..(351): n is a, c, t, g, unknown, or other
attctcccctccgtttcgaaaaccaaatctctctgtctactaggcgggagaktgagacggccatggcggaggcgcaascttagtaccggcgcaaggtcccgacgaggcgcccctcgatgcgtccgccattcagagccgggtggagcagctctcattgaaaaggctggaggtggagccgasgnanggtggcgggaggatgaggtggcactaggtttggactccacgcacaaggcggctcaggatncgatggatgagtgggactcggccactgctgcggtttcaattgatgatttggatgcatacctggaacaactgagaaaggatttagccatggcanancaggggaatcanaaggtatctggtgagattagtgtcactgcagagacaacattcaatgatatgattcaa

SEQ ID NO: 2023 - protein, 136 aa, Zea mays
  misc_feature: Ceres CLONE 261198-F
  misc_feature (18)..(18): Xaa is any aa, unknown, or other
  misc_feature (26)..(26): Xaa is any aa, unknown, or other
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (82)..(82): Xaa is any aa, unknown, or other
  misc_feature (113)..(113): Xaa is any aa, unknown, or other
  misc_feature (117)..(117): Xaa is any aa, unknown, or other
ILPSVSKTKSLCLLGGRXRRPWRRRXLSTGARSRRGAPRCVRHSEPGGAALIEKAGGGAXXXWREDEVALGLDSTHKAAQDXMDEWDSATAAVSIDDLDAYLEQLRKDLAMAXQGNXKVSGEISVTAETTFNDMIQ

SEQ ID NO: 2024 - DNA, 470 bp, Zea mays
  misc_feature: Ceres CLONE 261263-F
  misc_feature: Encodes the peptide sequence at SEQ ID NO. 2025
accgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgcccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcgcaactgggacgacatggagaagatctggcatcacaccttctacaacgagctccgcgttggctcccgaggagcaccccgtcctcctcaccgaggcgcccctgaaccccaaggctaacagggagaagatgacccagatcatgttcgaga

SEQ ID NO: 2025 - protein, 124 aa, Zea mays
  misc_feature: Ceres CLONE 261263-F
  misc_feature: SWISSPROT Homolog: EC 2.7.10.2 Non-specific protein-tyrosine kinase
MPRISSPSSATTELAWSRLGSLATTPEGRLPQHRGAPAHTGVMVGMGQKDAYVGDEAQSKRGILTLKYPIEHGIVATGTTWRRSGITPSTTSSALAPEEHPVLLTEAPLNPKANREKMTQIMFE

SEQ ID NO: 2026 - DNA, 484 bp, Zea mays
  misc_feature: Ceres CLONE 261278-F
  misc_feature: Encodes the peptide sequence at SEQ ID NO. 2027
catttcgggctgggtccgggaactcgaatctatctcctaaccctatcaagctagctagctgcgatgccgagcttccctccgccgggagccgtcaccatctgcgagatcaaccgcgacctcgttgcgtggatgccctctccgacgaccgcgccaaggacgcatatggggatgtcctcgggatggtcttcgccccgattccgttccagccggasbcttcttctcgccagccgcgagcctgctgctcctgccgcggaccaagtcgagcctgctgacactgtgcccaccgctggtttggcagccaccatatccgacttcttcaggcggatggtcttccctccactagacccaaatctgctagaagaatttgacactcagaaagtaagttggaatccatacaagcattgcttagcattcgtgtctgggaaagaaccaggttaccgtccaagactttgaggactcagatgctaaagaaccatggcatttt

SEQ ID NO: 2027 - protein, 129 aa, Zea mays
  misc_feature: Ceres CLONE 261278-F
  misc_feature (50)..(50): Xaa is any aa, unknown, or other
MPSFPPPGAVTICEINRDLVAWMPSPTTAPRTHMGMSSGWSSPRFRSSRXLLLASREPAAPAADQVEPADTVPTAGLAATISDFFRRMVFPPLDPNLLEEFDTQKVSWNPYKHCLAFVSGKEPGYRPRL

SEQ ID NO: 2028 - DNA, 385 bp, Zea mays
  misc_feature: Ceres CLONE 261367-F
  misc_feature: Translation starting site: 68
  misc_feature (107)..(107): n is a, c, t, g, unknown, or other
  misc_feature (191)..(191): n is a, c, t, g, unknown, or other
ctagcgccgcaccctcccgcccaccgccgtcgccgcccaaccgcagtaaggaggaaggagcaggaagatgccggcggggcacgggctgcggtcgcggacccgscatngtttcgcgcggcccttccgcaagaaggggtacatyccactcamcacgtacctgcgcacctacaagatcggcgactacgtsavtncaaagttaacggcgccgtgcacaagggcatgccgcacaarttctaccacggccgcaccgggarcgtctggaacgtcaccaagcgcgccatcgstcgagatcaacaagcaggttaatkgccgcatcatcaggaagcggatccatgtccgcgtggagcatgtgcagccctcccgtttcacgaggagttccgcttga

SEQ ID NO: 2029 - DNA, 308 bp, Zea mays
  misc_feature: Ceres CLONE 261387-F
  misc_feature: Encodes the peptide sequence at SEQ ID NO. 2030
  misc_feature (50)..(50): n is a, c, t, g, unknown, or other
  misc_feature (222)..(222): n is a, c, t, g, unknown, or other
gattctgtgatcgakatcgaggccgatcggcaggttttcttatgcgtgcnctctgctactgccatggcggtactcaccttcttctccaactctctgccggagtcaatggagctagcaggaacaggatgctcattccagccattctttcgattcttcagcttattcacctcgcagcgctaggcgtggacggagcggcgtcgttcaggttcaccaacgcttgcnagcacccggtgtgggtgggcgcgctccacggcgccastcgccgccgctcgcaagctcgggcttctacctggcgcggtccgcacgtc

SEQ ID NO: 2030 - protein, 89 aa, Zea mays
  misc_feature: Ceres CLONE 261387-F
  misc_feature (61)..(61): Xaa is any aa, unknown, or other
  misc_feature (73)..(73): Xaa is any aa, unknown, or other
MRALCYCHGGTHLLLQLSAGVNGASRNRMLIPAILSILQLIHLAALGVDGAASFRFTNACXHPVWVGALHGAXRRRSQARASTWRGPHV

SEQ ID NO: 2031 - DNA, 701 bp, Zea mays
  misc_feature: Ceres CLONE 261407-R
  misc_feature: SWISSPROT Homolog: EC 1.11.1.6 Catalase
caattgctgaccgggccccccctcgaggtcgacggtatcgataagcttttttttttttttttttgatttttttttatattttttttttttttttttttttttttttttttttaaaaaacaacctgacattttccagataggttcatgacaaaataacaagacaggccggtgtccgggcgcgggcccccgacggtgtcctcccacagcttgtcgaggaggcccatcccactccgtcgtaatcacccaactgccactaccaaaccccgatctgggacagtatctagtgcctcctctacccaaaaaacttgtggatctgggcgaaaaaatttttccattaagatgttctaggtaaaggtctcgtgcgaattcctgcagcccgggggatccactagttctagagcggccccccccccggtggaactccaacttttgttccctttaaggagggttaattgcgcgcttggcgtaatcatgggcatagctgtttcctgtgtgaaattgttatccgctcacaattccacacaacatacgagccggaagcataaagtgtaaagcctggggtgcctaatgagtgagctaacccccattaattgcgttgcgctccctgcccgctttccagtcgggaaacctgtcctgccagctgcattaatgaatacgcccaaccccggggagaggcggttttgctattggggccctcttcc

SEQ ID NO: 2032 - DNA, 396 bp, Zea mays
  misc_feature: Ceres CLONE 261411-F
  misc_feature: Translation starting site: 126
  misc_feature: SWISSPROT Homolog: EC 3.4.25.1 Proteasome endopeptidase complex
  misc_feature (68)..(68): n is a, c, t, g, unknown, or other
aacaaagcaaagcaggcctccggctccctgaactgacttcagaagtcaccaacgcacccagcacaganagaagaccctcgccggacgctcgctctcgccggggacaactcaatcccgaggccaggatggccgctacgatcgckcgatcaccgtgttctcacccgacggccacctcttccaggtcgagtacgccctcgaggccgtccgcaaggcaacgcgctktcgstaccgcggcgtcgacaccgtcgtcctcggcgtcgagaagaagtccacccccaagctccaggactccaggtccgtgcgcaagatcgtgagcctggacacccacatcgcgctggcgtgcgcgggggctcaaggccgacgcgcgcgtgctcatcaaccgcgctcgstggagtg

SEQ ID NO: 2033 - DNA, 204 bp, Zea mays
  misc_feature: Ceres CLONE 261433-F
  misc_feature: Encodes the peptide sequence at SEQ ID NO. 2034
  misc_feature (113)..(113): n is a, c, t, g, unknown, or other
  misc_feature (167)..(167): n is a, c, t, g, unknown, or other
atccgcatttycccttccccgcaccgcaccgcacccaacccccgtcggagagagagatggcatcggtggcggagatgcagcccctcgcgccggcggggtaccgcggccggganatgaaggagaaggtggaggcgtcggtggtggacctggaggccgggaccgggganacgctttacccggggatctcgcgcgggggagagcgcc

SEQ ID NO: 2034 - protein, 49 aa, Zea mays
  misc_feature: Ceres CLONE 261433-F
  misc_feature (19)..(19): Xaa is any aa, unknown, or other
  misc_feature (37)..(37): Xaa is any aa, unknown, or other
MASVAEMQPLAPAGYRGRXMKEKVEASVVDLEAGTGXTLYPGISRGGER

SEQ ID NO: 2035 - DNA, 461 bp, Zea mays
  misc_feature: Ceres CLONE 261445-F
  misc_feature: Encodes the peptide sequence at SEQ ID NO. 2036
  misc_feature (59)..(59): n is a, c, t, g, unknown, or other
aacactcatcacgccgccactgatctgctctgttgctggtgactaggagcagtagcgangagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaactttctcacttctgtgtgactgtgatcaaaggacttgtgtatgatcaaaggagatccatcagttggtaccgaagtgtattttatgtcttgttggttacctggaatttaattaaaaccatcacttgtatccttttgagaatt

SEQ ID NO: 2036 - protein, 60 aa, Zea mays; identical to SEQ ID NO: 1569
  misc_feature: Ceres CLONE 261445-F
  misc_feature (3)..(42): Pfam Name: Ribosomal_L29e Pfam Description: Ribosomal L29e protein family

SEQ ID NO: 2037 - DNA, 261 bp, Zea mays
  misc_feature: Ceres CLONE 261448-F
  misc_feature (131)..(131): n is a, c, t, g, unknown, or other
agtcgtcaccgagaagcagaagcagcagctgctgctgctggtcgttcgttcgcctcgttctctccgcctccccccaccccccgcctcgcttcctcctccgcgcttccttcgccgaggcgtcasgtccasvngggcgtataaagcgctccccctccgcgcgcgtccgcacaatcgccaccgcctctccgctcctcgacaagaccaatggcggctgctgcgtcctccgctctgcacgccgttggsccgtcgcctccgccaagc

SEQ ID NO: 2038 - DNA, 509 bp, Zea mays
  misc_feature: Ceres CLONE 261467-F
  misc_feature: Encodes the peptide sequence at SEQ ID NO. 2039
gatctgcttctccagtctccacacaacacaacagagcagaaggkcagcacgggcgctgatgtcgatgggggaggcgctgcgggckgctgccgcaagagcatgttgtgttgtggtcgaatatctcgctggaggatcactgaagcagtatttaataaagaacaggcgaaggaagcttgcatacaaggttgttgttcagatagcactggatcttgccagaggattgaactatctacattcaagaaagatagtacatcgggatgtaaaaactgaaaatatgctgctcgatacacagcgaaaccttaagattgctgattttggtgttgctcgtgttgaggctcagaatccaaaggacatgacaggcgcgactgggacacttggctacatggccccagaggtgcttgaaggcaagccatacaacagaaagtgtgatgtctacagttttggcatatgcttatgggaaatatactgctgtgacatgccatatccagacctcagttttgcagacgtct

SEQ ID NO: 2039 - protein, 150 aa, Zea mays
  misc_feature: Ceres CLONE 261467-F
  misc_feature (2)..(150): Pfam Name: Pkinase_Tyr Pfam Description: Protein tyrosine kinase
  misc_feature: SWISSPROT Homolog: EC 2.7.11.1 Non-specific serine/threonine protein kinase
MSMGEALRAAAARACCVVVEYLAGGSLKQYLIKNRRRKLAYKVVVQIALDLARGLNYLHSRKIVHRDVKTENMLLDTQRNLKIADFGVARVEAQNPKDMTGATGTLGYMAPEVLEGKPYNRKCDVYSFGICLWEIYCCDMPYPDLSFADV

SEQ ID NO: 2040 - DNA, 446 bp, Zea mays
  misc_feature: Ceres CLONE 261514-F
  misc_feature: Translation starting site: 124
aagacagcacaagaacactcctagctagctgaagatctcgagtgcaacsaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggcaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaa

SEQ ID NO: 2041 - DNA, 214 bp, Zea mays
  misc_feature: Ceres CLONE 261545-F
  misc_feature (83)..(83): n is a, c, t, g, unknown, or other
gttcgcctcgttctctccgcctccccccaccccccgcctcgcttcctcctccgcgcttccttcgccgaggcgtcacgtcasvntgggcgtataaagcgctccccctccgcgcgcgtccgcacaatcgccaccgcctctccgctcctcgacaagaccaatggcggctgctgcgtcctccgctctgcacgccgttggsccgtcgcctccgccaagc

SEQ ID NO: 2042 - DNA, 453 bp, Zea mays
  misc_feature: Ceres CLONE 261557-F
  misc_feature: Encodes the peptide sequence at SEQ ID NO. 2043
accgagccgaccgatcgtcgctcatctttgtaggacacccgcaccctccgcgtcgaacacccgatccggacaccgctccaggctccacctctctcccatctcacgccaacgctcactggaccattcctccgtgcttgggagcggcggagagctatccacctcgtctcaggcaccctctggcgtccccctccccccgccgcgtgccggcgagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgttaacattggtgcggcaaatgccccatcccaggtcctggcaacgcttagtg

SEQ ID NO: 2043 - protein, 54 aa, Zea mays
  misc_feature: Ceres CLONE 261557-F
MSSKKIELDHKDMVHDSAIDYYGKRLATASSDFTVKIVNIGAANAPSQVLATLS

SEQ ID NO: 2044 - DNA, 484 bp, Zea mays
  misc_feature: Ceres CLONE 261646-F
  misc_feature: Encodes the peptide sequence at SEQ ID NO. 2045
  misc_feature (78)..(78): n is a, c, t, g, unknown, or other
  misc_feature (80)..(80): n is a, c, t, g, unknown, or other
aatccgacgccggacgccccatgatttcgctttcttcttcccgtcgagacccaaccataccagcggcgccgcacgkgnancgaggaggcggagtagagtggccggactacctcgacacctccactgcaaccatgggtatctcacgtgattcgatgcacaagcgccgtgccaccggtgaaaagcagaaggcgtggcgcaagaagcgaaagtatgagcttggccgtcagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattttacaagttgatgctgctccattcaagcagtggtacctcactcacta

SEQ ID NO: 2045 - protein, 117 aa, Zea mays
  misc_feature: Ceres CLONE 261646-F
  misc_feature (1)..(117): Pfam Name: Ribosomal_S8e Pfam Description: Ribosomal protein S8e
MGISRDSMHKRRATGEKQKAWRKKRKYELGRQPANTKLSSNKTVRRVRVRGGNVKWRALRLDTGNYSWGSEALTRKTRILDVVYNASNNELVRTQTLVKSAILQVDAAPFKQWYLTH

SEQ ID NO: 2046 - DNA, 440 bp, Zea mays
  misc_feature: Ceres CLONE 261714-F
  misc_feature: Pfam Name: Chitin_bind_1 Pfam Description: Chitin recognition protein
  misc_feature: SWISSPROT Homolog: EC 3.2.1.14 Chitinase
aaatcacctcacaacaagctgccccgcmgaacgaacacgaaccttggcagaacgaagctgaagtagttcgttgtgaacccagtatggcaaacgcgccgaggatcctggccctcggctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtkccgctcgggcgcggcggcggcggcggcggaggcggaggcagtggcggtgcgaacgtggctaacgtggtcagcgacgcgtttcttcaacggcatcaagaaccaggccgggagcgggtgcgagggcaagaacttctacacccggagcgcgttcctgagcgccgtcaacaagtacccgggcttcg

SEQ ID NO: 2047 - DNA, 491 bp, Zea mays
  misc_feature: Ceres CLONE 261725-F
  misc_feature: Encodes the peptide sequence at SEQ ID NO. 2048
ataggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtcaagaagcttatcaaggagaagaaggatgatgctggaatttctgaatatattgatatggagaaagagcttcaagaggagccatgcccagcaaggtagcatgaaaaggccgcttgcaacagaagatttgttttggggaatttagatttttgtaaccttgaaaggtgagaaggttaattatggcaatggtagggactgtccgagcaaccatattaataataatgaacaatatgtaaaaattcagtggcttcaaagttgtccattaccctttatcttgatttattgcagggttt

SEQ ID NO: 2048 - protein, 54 aa, Zea mays
  misc_feature: Ceres CLONE 261725-F
MEDLSVEELASNLSTYKEQLREVKKLIKEKKDDAGISEYIDMEKELQEEPCPAR

SEQ ID NO: 2049 - DNA, 183 bp, Zea mays
  misc_feature: Ceres CLONE 261762-F
aacgggcaagacgacgagggtttttgccgccgccatggattccctcgagcacgtctaactcgcctgctcctccactttcggcagccggggctccagattcctagcgcaacccttctctacctcttcctccgcacacggcctcttcccctctctgtggccaacgccgtccaccgccggcgcgtg

SEQ ID NO: 2050 - DNA, 488 bp, Zea mays
  misc_feature: Ceres CLONE 261773-F
  misc_feature: Encodes the peptide sequence at SEQ ID NO. 2051
  misc_feature (75)..(75): n is a, c, t, g, unknown, or other
  misc_feature (289)..(289): n is a, c, t, g, unknown, or other
atccgacgccggacgccccatgatttcgctttcttcttcccgtcgagacccaaccataccagcggcgccgcmkgnacgaggaggcggagtagagtggccggactacctcgacacctccactgcaaccatgggtatctcacgtgattcgatgcacaagcgccgtgccaccggtggaaagcagaaggcgtggcgcaagaagcgaaagtatgagcttggccgtcagcctgctaacaccaaactgtctagcaataagacagttaggagggtccgtgtccgtggaggcaacgtnaaktggagggctctccgattggatacaggtaactactcgtggggaattgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggagtgg

SEQ ID NO: 2051 - protein, 120 aa, Zea mays
  misc_feature: Ceres CLONE 261773-F
  misc_feature (1)..(120): Pfam Name: Ribosomal_S8e Pfam Description: Ribosomal protein S8e
  misc_feature (55)..(55): Xaa is any aa, unknown, or other
MGISRDSMHKRRATGGKQKAWRKKRKYELGRQPANTKLSSNKTVRRVRVRGGNVXWRALRLDTGNYSWGIEALTRKTRILDVVYNASNNELVRTQTLVKSAIVQVDAAPFKQWYLTHYGV

SEQ ID NO: 2052 - DNA, 908 bp, Zea mays
  misc_feature: Ceres CLONE 261814-R
  misc_feature (726)..(726): n is a, c, t, g, unknown, or other
tacaacctcactccgtcctcccccctatatttttaatatatcatatctcttcgattgggtaccgggccccccctcgaggtcgacggtatcgataagcttttttttttttttttttctttttttttttttttttttttttttttttttttttttttaagttcaacatgtaatttatggatgaatttcttctccatttgatgtttgcgtttaacaaacaggaaaaggctcaggctgaacaagcctcgccggcggcacaaaagtgattccctacctcgagagtacaagccgtcgcggcgccccctcggcgcctcaacatcctctgcaccgtcagttattctctctctaccatcaaccattggttttgccttgcctcccctgtcctgacgattgtaacaaccgtattgtgtgctggcaataaactttctgcattaactcaaaatttgtagcaccagtattgtgactatccttttgttattaaaagaaggtgccatccaccaacttgtcaaatcaccccacaatgctcactcacaatcttttccatctccaaaatctcaccgtacgtaccccaaccaacttaccgcactcttcaccgcccagacaactattataccccccctccaactaacactcactacttatatttataatatctctagctcactatatcctccccctcgtacatcctccacctccaacacccatccttccacctcttcctcatccacnctcacacccactcctttatccccacccttactcttaatatctctttctgctatatctacttccctccccccacgatctccaccaacctactctccaccccactctaccctacccacatcatcaccctttctccacactcactttcttcccaattccaatccctttctcatattctagccaac

SEQ ID NO: 2053 - DNA, 449 bp, Zea mays
  misc_feature: Ceres CLONE 261865-F
  misc_feature: Translation starting site: 177
  misc_feature: SWISSPROT Homolog: EC 3.6.3.14 H(+)-transporting two-sector ATPase
  misc_feature (27)..(27): n is a, c, t, g, unknown, or other
  misc_feature (99)..(99): n is a, c, t, g, unknown, or other
  misc_feature (295)..(295): n is a, c, t, g, unknown, or other
  misc_feature (296)..(296): n is a, c, t, g, unknown, or other
tccttcctcttcgccccagcgacgcgnccgcccggagaccktatckakgcaggcaactaaccaccgagaggcagggacaggaacaggaagccggacgangatgtcgtcggtgttcagcggcgatgagacggcccccttcttcggcttcctcggcgccgcsccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgwrctcnnatctacgggctcatcatcgccgtcatcattagcacggggatcaaccccaaggccaagccctactacctctttgatggctacgccacctttcgtccgggcttgcctgtggtctcgctgggcttgcagctggcatggccatcgggcattgtcggt

SEQ ID NO: 2054 - DNA, 407 bp, Zea mays
  misc_feature: Ceres CLONE 261890-F
  misc_feature: Encodes the peptide sequence at SEQ ID NO. 2055
  misc_feature (310)..(310): n is a, c, t, g, unknown, or other
gcaccaycgccgcgccgctccaaatcacagccaccgccgccatggccgcctccagccgccctctcgtctccgtgaaagccctggaggsgacatggtcacggacgcccccggcatcgcttgccgcccgtcttcggtgcgccgatccgcccggacgtggtccgcttcacccacaagctgctgtcctgcaacaagcgccascttacgcagtctcccgccgcgctggccaccagacgtcggccgagtcctggggtacgggccgcgctgtgtcccgtatcccccgcgtccccggcggcggcacccaccgcgccgnccagggagcattcggcaacatgtgccgcggcggacgcatgttcgcgcccaccaagatctggcgcaagtkgcaccgccgcgtcaacgtcaacctccgc

SEQ ID NO: 2055 - protein, 122 aa, Zea mays
  misc_feature: Ceres CLONE 261890-F
  misc_feature (16)..(16): Xaa is any aa, unknown, or other
  misc_feature (53)..(53): Xaa is any aa, unknown, or other
  misc_feature (90)..(90): Xaa is any aa, unknown, or other
  misc_feature (113)..(113): Xaa is any aa, unknown, or other
MAASSRPLVSVKALEXTWSRTPPASLAARLRCADPPGRGPLHPQAAVLQQAPXYAVSRRAGHQTSAESWGTGRAVSRIPRVPGGGTHRAXQGAFGNMCRGGRMFAPTKIWRKXHRRVNVNLR

SEQ ID NO: 2056 - DNA, 176 bp, Zea mays
  misc_feature: Ceres CLONE 261919-F
  misc_feature (126)..(126): n is a, c, t, g, unknown, or other
aagacgcgacsaacgccaagccaagaccaaattaccaaaccctaccccttcgccgcgaccgsattcccccacatcgttggcgatgagctcctcctccaacagcgggaagaagccggcgcccgccgnsccgcggggggcccaccatccgcacgctcgccgacataaaccgtggccct

SEQ ID NO: 2057 - DNA, 432 bp, Zea mays
  misc_feature: Ceres CLONE 261939-F
  misc_feature: Encodes the peptide sequence at SEQ ID NO. 2058
  misc_feature (355)..(355): n is a, c, t, g, unknown, or other
  misc_feature (414)..(414): n is a, c, t, g, unknown, or other
agatctggtacgtgccgcccctcgatttggcgcgctcgatccggcctcgtggtgctggtgatatgccagtccctaactcaaatctgggaggttccactgaagcgagattgtagtcgcgaatcgcgggcgccgagatgcaggcgcgtgtggcgtccatggaggacgtgaaggaggcgcggcaggcggccatggcggcggggcaggggagggtgcttccctcggggatgctcaaggtgttcctggggttcctgctgctggccgtggggctgtccgccgtcggcatgtacatggcgcggcacgttgtgcggcggccgcgccgcgctattccgcccgtgcctgagcggctcctccgcgnagaggaacccgaggggctggagcggtggacgcgcccccagcgcgcgtagacacgcgatnacggatcaggagctgctc

SEQ ID NO: 2058 - protein, 89 aa, Zea mays
  misc_feature: Ceres CLONE 261939-F
  misc_feature (74)..(74): Xaa is any aa, unknown, or other
MQARVASMEDVKEARQAAMAAGQGRVLPSGMLKVFLGFLLLAVGLSAVGMYMARHVVRRPRRAIPPVPERLLRXEEPEGLERWTRPQRA

SEQ ID NO: 2059 - DNA, 263 bp, Zea mays
  misc_feature: Ceres CLONE 261968-F
  misc_feature (228)..(228): n is a, c, t, g, unknown, or other
gaaacaaagaaagataaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagckcgcggcggcgtaagcccaacgccaagaactcccaggacgggctcaccccggagcagcgccgcganagggacaagaaagctctggaggagaaggcggccaa

SEQ ID NO: 2060 - DNA, 340 bp, Zea mays
  misc_feature: Ceres CLONE 261972-F
  misc_feature: Encodes the peptide sequence at SEQ ID NO. 2061
  misc_feature (117)..(117): n is a, c, t, g, unknown, or other
  misc_feature (176)..(176): n is a, c, t, g, unknown, or other
  misc_feature (177)..(177): n is a, c, t, g, unknown, or other
  misc_feature (179)..(179): n is a, c, t, g, unknown, or other
  misc_feature (232)..(232): n is a, c, t, g, unknown, or other
  misc_feature (282)..(282): n is a, c, t, g, unknown, or other
  misc_feature (292)..(292): n is a, c, t, g, unknown, or other
agaaacaaagaaagataaaatcgagaggacgccagggccgattctctgcgtgacttggggcgtcgtcgcgagttttctccggccgagggcggcgcgaccggacaaccagcgtgascngaccggcgacatgactcgcggcaaccagcgtgaccgcgaccgtgagckcgcggcggsgnnanagcccaacgccaagaactcccaggacgggctcaccccggagcagcgccgcgangagggacaagaaagctctggaggagaaggcggccaagaaggcgcmsaggncagcggccgncggcaccggtacctccacggacaacaacaagaacaaggcaggtggcaa

SEQ ID NO: 2061 - protein, 71 aa, Zea mays
  misc_feature: Ceres CLONE 261972-F
  misc_feature (13)..(13): Xaa is any aa, unknown, or other
  misc_feature (16)..(16): Xaa is any aa, unknown, or other
  misc_feature (17)..(17): Xaa is any aa, unknown, or other
  misc_feature (18)..(18): Xaa is any aa, unknown, or other
  misc_feature (35)..(35): Xaa is any aa, unknown, or other
  misc_feature (51)..(51): Xaa is any aa, unknown, or other
  misc_feature (52)..(52): Xaa is any aa, unknown, or other
MTRGNQRDRDREXAAXXXPNAKNSQDGLTPEQRRXEGQESSGGEGGQEGAXXSGRRHRYLHGQQQEQGRWQ

SEQ ID NO: 2062 - DNA, 724 bp, Zea mays
  misc_feature: Ceres CLONE 262079-R
  misc_feature: Encodes the peptide sequence at SEQ ID NO. 2063
acgattgggtaccgggccccccctcgaggtcgacggtatcgataagcttttttttttttttttttgctttttttttttttttttttttttttttttttttttttgggtgggtggaagttatccattgatctagcccgacatgggtatcccccattcagtctcaagcaattacaaaataatgaaatgttgtggtttctacaaaccaatggtctagctacaacggtaattctagtttcgccccaaccctgatacggaaaaaccgtaatgatatgtatatattctacatccaagcagcttgctcaaaactctcggattctgcgggagccaccgcaaaaacctcttcctcgccaaaacttggaaccttggggatcacgccaaggatcttgaacaacgcctggtccccatcaaaatcattgtttgcggtatgtgagaaatttctcccccgcaaagatggagttggcccccacgaggaaacacaacgcttgttctggcatcaagaaccttactcggcctgctgaaaccctcaccattgcctttggcatcgtgatcccagcaatggcgatcatgcggaacatttcccacatctctacaagcttctggtcctcaagaggtgtgccttttaccgccacccatgcattaataggaacgctctctgggtgtgtaggcaaggtatctagggtatgcaacaaccctacccggtcctcctctgcttcaccaagacaaa

SEQ ID NO: 2063 - protein, 82 aa, Zea mays
  misc_feature: Ceres CLONE 262079-R
MYIFYIQAACSKLSDSAGATAKTSSSPKLGTLGITPRILNNAWSPSKSLFAVCEKFLPRKDGVGPHEETQRLFWHQEPYSAC

SEQ ID NO: 2064 - DNA, 257 bp, Zea mays
  misc_feature: Ceres CLONE 262103-F
  misc_feature: Translation starting site: 119
  misc_feature (100)..(100): n is a, c, t, g, unknown, or other
  misc_feature (101)..(101): n is a, c, t, g, unknown, or other
  misc_feature (168)..(168): n is a, c, t, g, unknown, or other
ctgtgtctcgtaggtggacatattctccgcgtgacttcaggtgtcgtcgccgagttgtctccggccgagggcggcggcgcgaccggtaaccagcgtcaynngaagtgtgacaggcgacatgactcgcggcaaccagcgtgaccgcgatcgtgagcgcgcggcggcgtnaagcccaacggcaaggggccccaggacgggctcaccccggagcagcgccgtgagagggacaagaaagcgctggaggagaaggcggcgaa

SEQ ID NO: 2065 - DNA, 477 bp, Zea mays
  misc_feature: Ceres CLONE 262137-F
  misc_feature: Encodes the peptide sequence at SEQ ID NO. 2066
acaccaccacctttaccaccgaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgcgcgcaactggggastgtttcgtgaacatcgcggccgagaagggatccgggatggccaccttcgtgcaccgcaagtacagcgacaaggaggacagcgacatattcaggtgctacgacagctgctctgacgacgtggaggaggccgtcgcccacctcaacgggcctcgtccggggagcccaccggacgccaagttcctcgagctcaagtcgtggctctcctccacgtcggcagagctg

SEQ ID NO: 2066 - protein, 141 aa, Zea mays
  misc_feature: Ceres CLONE 262137-F
  misc_feature: SWISSPROT Homolog: EC 3.1.1.11 Pectinesterase
  misc_feature (67)..(67): Xaa is any aa, unknown, or other
MAAMARSVSLVVAPLLLLSLLVSAAASARTVGDTVQDACSKTQFPKICVDSLAAKPESQKATRATGXCFVNIAAEKGSGMATFVHRKYSDKEDSDIFRCYDSCSDDVEEAVAHLNGPRPGSPPDAKFLELKSWLSSTSAEL

SEQ ID NO: 2067 - DNA, 959 bp, Zea mays
  misc_feature: Ceres CLONE 262157
  misc_feature: Encodes the peptide sequence at SEQ ID NO. 2068
atcccatccccatccatagagctgcgggcggcctgcgctgcagccaacaagctcatcagctcaccgtacctaggaggacgaccgaccacctaaggtagtagctagctagccagtgatggcgggctacaaagcgcagggcggggcgctcggcgtcgtcctggctgtcgccacgctcctcgcggcggtggcggcgatggcggtggacgacgagcacatgtaccactggaagtgcttcaagtcgtgcacggggaactgccgcgacgaggacgcctttgacgacgtcgtcgcccgccactccgagggctcctcccacgtcgtcgctgccgtctccggcggcaagtgcaaggacaggtgcctcagcgagtgcttcgaggacctgccggccctctgctaccaccagtgcgtcgccaccaactgcctctgctacccaccctttagcaacgagaaagtgatgtgcctgaagagctgctgcaacaagtgcttccaccacggcccgcctgccccgaagccgaggccgccaatgcctggtcctccgaagccgcctgccccggcgaagcccaagccaccgccgacgccgacgccgaggccgccagcgccaaagccaccgacgcccaggccgccgccgccgccaaagaagccgtgtccctgcccccccggcagcgacgaggtcaaggccagcgaaaacaactgatacgtacgatggatcggccagtcgtcgttgtcgtcgtctcaaaataacttcatatactataccacttgacttcgcaagtgtacgtgtgtgggtacgtcgggcgtcggcacatcaagtaggccccactatacgacgcgacgcatatatgtacgcaatgggagtacgtgccacttttacgtacttaggtgctgtttggttcaagaaatgtaacgcaaaggttaatggtaatagtttacattcgattactgtcggcaaaaaaaaaaaaaaa

SEQ ID NO: 2068 - protein, 191 aa, Zea mays
  misc_feature: Ceres CLONE 262157
MAGYKAQGGALGVVLAVATLLAAVAAMAVDDEHMYHWKCFKSCTGNCRDEDAFDDVVARHSEGSSHVVAAVSGGKCKDRCLSECFEDLPALCYHQCVATNCLCYPPFSNEKVMCLKSCCNKCFHHGPPAPKPRPPMPGPPKPPAPAKPKPPPTPTPRPPAPKPPTPRPPPPPKKPCPCPPGSDEVKASENN

SEQ ID NO: 2069 - DNA, 118 bp, Zea mays
  misc_feature: Ceres CLONE 262192-F
acacgcacaccgcgacccagtccagagccagtacgtgcgamggcacgcacgctgctggtccgcgtacsagaacgacggtcaggtcggccggtgcttttcagtttggaataatgacggc

SEQ ID NO: 2070 - DNA, 421 bp, Zea mays
  misc_feature: Ceres CLONE 262211-F
  misc_feature: Encodes the peptide sequence at SEQ ID NO. 2071
  misc_feature (36)..(36): n is a, c, t, g, unknown, or other
  misc_feature (378)..(378): n is a, c, t, g, unknown, or other
  misc_feature (384)..(384): n is a, c, t, g, unknown, or other
gtcacagcgagtaccgagtaggagcaaccgcttgcntcagacgcacactgacggagagtgatcactgatttctggtcatggcaaccgtaactdaggaagttgctccggtcgtcaccgtctccgaggagccggcgccggaagcggcaaggaggtggtggagaagccggaggaggggaagaatcccgacgaggagggtacgagaggaagaaggccgaccccgcckccgtakaaggagaagaaggcgaggwagccgcggasaggaagcccaagtccgccgggctgcaccacccgccctatttcgagatgatcaaggaggcgatcctgtcgcaggacggcgggaaggtcggggcgagcccgtacgcgatcgccaagcacatngggganagcaccgggacgtgctcccgcccaattaccgcaagtg

SEQ ID NO: 2071 - protein, 39 aa, Zea mays
  misc_feature: Ceres CLONE 262211-F
  misc_feature (25)..(25): Xaa is any aa, unknown, or other
  misc_feature (27)..(27): Xaa is any aa, unknown, or other
MIKEAILSQDGGKVGASPYAIAKHXGXSTGTCSRPITAS

SEQ ID NO: 2072 - DNA, 332 bp, Zea mays
  misc_feature: Ceres CLONE 262214-F
  misc_feature: Encodes the peptide sequence at SEQ ID NO. 2073
gagtttcctcctccactccctcccccccgcctccactaccccactcccaggcgccgcacaggtacgtcgccggcgsattgacgacgcgcttcaagaagaaccgcaagaagcgcggccacgtgtccgccgggcacgccgcatcggcaagcacaggaagcatcccggagtcgcggtaacscggtggcatgcaccaccaccgcatcctcttcgacaagtaccatcccggctacttcggtaaggtcggcatgcgctacttccacaagctccgcaacaagttctacttgccccgcggtcaacatcgagcgcctctggtcgatggtgcccgccgaaaa

SEQ ID NO: 2073 - protein, 49 aa, Zea mays
  misc_feature: Ceres CLONE 262214-F
MHHHRILFDKYHPGYFGKVGMRYFHKLRNKFYLPRGQHRAPLVDGARRK

SEQ ID NO: 2074 - DNA, 178 bp, Zea mays
  misc_feature: Ceres CLONE 262235-F
  misc_feature (130)..(130): n is a, c, t, g, unknown, or other
  misc_feature (136)..(136): n is a, c, t, g, unknown, or other
atccaatccatcagtacccaaccttcccctacaccagaaaaatccccagttctttggtccgcgtcagakaggcggcggcgatgtctgggcgcggcaagggcggcaagggtctgggcaagggcggcgcgancggtanaggtgctccgcgacaacatccagggcatcaccaagccggcga

SEQ ID NO: 2075 - DNA, 433 bp, Zea mays
  misc_feature: Ceres CLONE 262248-F
  misc_feature: Translation starting site: 320
  misc_feature: Pfam Name: MRP-L47 Pfam Description: Mitochondrial 39-S ribosomal protein L47 (MRP-L47)
  misc_feature (82)..(82): n is a, c, t, g, unknown, or other
  misc_feature (186)..(186): n is a, c, t, g, unknown, or other
  misc_feature (187)..(187): n is a, c, t, g, unknown, or other
  misc_feature (323)..(323): n is a, c, t, g, unknown, or other
  misc_feature (336)..(336): n is a, c, t, g, unknown, or other
atcgcgtctaaacccttgtctccttcttatccccacctccctcgcggatcactcgccgccgccgccggcgcwgccatcgccntgatgctgtccctgtcgagggcgatcgggaggcggctcttctcgtcyagccgaggccgcrtcgacggctgcrgtgaggacggcgcagaacccgctcgaggagtnnttcgaggtcgagcggacaccgaggagggcaagcctcctccccactacggtcgcagctggaacttctgaacwgcgactaaaatcttgggatgaccttcagaaattgtggtatgttcttctaaaggaaaagaacatgnwaatgacacagcntcaaatgctgcatthagagagcwtdaggttcccaaatccagaacgaatttccaaggtaaagaaatcaatgtgccggataaagcatgtcttgactgag

SEQ ID NO: 2076 - DNA, 351 bp, Zea mays
  misc_feature: Ceres CLONE 262267-F
  misc_feature: Encodes the peptide sequence at SEQ ID NO. 2077
  misc_feature (283)..(283): n is a, c, t, g, unknown, or other
atcgttgtccaatatataaaaggccaaataatcaagcacaggcagcagccatacacacagcaagaaaagaatggacatggagaaggcctagcctagttctactggtatcagctgccatactcctaggcgcacaccagccgacgggcgctcaggtgttctgccgctcgcagttcaacctggccaacgaggcgtgcagcatgcggaatttcatcccggggccgggggtgaggcgcgggggcctgccgcggcagcagcagctcaacgagacgacgtcgtcgtcgancggccaccacagccagcgctgtcagtcaggtgctgcagtcccggagcgacgacgacgacgacagccac

SEQ ID NO: 2077 - protein, 116 aa, Zea mays
  misc_feature: Ceres CLONE 262267-F
  misc_feature (94)..(94): Xaa is any aa, unknown, or other
RCPIYKRPNNQAQAAAIHTARKEWTWRRPSLVLLVSAAILLGAHQPTGAQVFCRSQFNLANEACSMRNFIPGPGVRRGGLPRQQQLNETTSSSXGHHSQRCQSGAAVPERRRRRQP

SEQ ID NO: 2078 - DNA, 346 bp, Zea mays
  misc_feature: Ceres CLONE 262271-F
  misc_feature: Encodes the peptide sequence at SEQ ID NO. 2079
gatctgagatggacatcgatccaccgaggtttcttgtgcgtgccgccatggccatggcagtagctcaccttcttcctcagctctccgccgamrattgggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccasctcgccgccgctcgcgcgtcgggcttctacctgggcgccgtccgccacgtccagcatggmccggccgtcgtcggggacatggtcgggcacgttgtgggcgcgcacg

SEQ ID NO: 2079 - protein, 77 aa, Zea mays
  misc_feature: Ceres CLONE 262271-F
  misc_feature (42)..(42): Xaa is any aa, unknown, or other
  misc_feature (62)..(62): Xaa is any aa, unknown, or other
MAILLILQLFLLTALGVDGAASFIFTNACKHAVWVGALHGAXSPPLARRASTWAPSATSSMXRPSSGTWSGTLWART

SEQ ID NO: 2080 - DNA, 482 bp, Zea mays
  misc_feature: Ceres CLONE 262304-F
  misc_feature (373)..(373): n is a, c, t, g, unknown, or other
atccctttatcaaaaacccacaggccacaacaccaagaaaccagcatcttctgcagctctgaagaaaactcgatcaccatggacatgccttctcttgttctcctcctgctcgtcttcattgcaacaggcagccgcgccgcgggcaggtgttctgccgctcgcagttcaacctggccaacgaggcctgcagcctgcgcaccttctccgggcccaacccggcgcaaccgctgcagctgcacagcaatcagctcctcggcatcctacgagatacaggcggaccaccacgagcacgagcacagccacgagcacgagcacgagcacgagcatagccacgagcacgagcacgagcacagcyacgaacacgtagcgcgangagcacacgcacagccggcggcacggcttcgggcacggcggccgcgacccctacgacaccgcctgctgccgccgcctcatgggcatcgacaacgcctgcatctgccagg

SEQ ID NO: 2081 - DNA, 451 bp, Zea mays
  misc_feature: Ceres CLONE 262371-F
  misc_feature: Translation starting site: 113
acagtcgcctccttcctgcgccgccgccgccgccgccgctaccaccgcctcgcgccgcctgcbtccgcgtttccgcacggaagttggtgaaggtttcttgaggcktgagaacatggtgctgaagacggaactttgccgcttcagcgcagaaagatttatcctgggaaaggcattagatttatccgtgctgattctcaggtcttcctttttgccaactcggaaatgcaagcgctacttccacaaccgcctgaagcctgcaaagcttacctggacagcaatgtacaggaagcagcacaagaaggatatccatgctgaagcggtaaagaagaggcgccgcgccaccaagaagccatactccaggtcaattgtggggtgcttccttggaagtaatccagaagaagagagctgagaagccagaggtccgcgatgctgctagagaagctgctcttcg

SEQ ID NO: 2082 - DNA, 122 bp, Zea mays
  misc_feature: Ceres CLONE 262389-F
  misc_feature (66)..(66): n is a, c, t, g, unknown, or other
acgcacaccgcgacccagtccagagccagtacgtgcgamggcacgcacgctgctggtccgcgtacnagacgacggtcaggtcggccggtgcttttcagtttggaataatgacggcgacgacg

SEQ ID NO: 2083 - DNA, 479 bp, Zea mays
  misc_feature: Ceres CLONE 262398-F
  misc_feature: Encodes the peptide sequence at SEQ ID NO. 2084
agaaaccctaacactcatcacgccgccactgatctgctctgttgctggtgactaggagcagtagcragagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattggacaaa

SEQ ID NO: 2084 - protein, 60 aa, Zea mays; identical to SEQ ID NO: 1569
  misc_feature: Ceres CLONE 262398-F
  misc_feature (3)..(42): Pfam Name: Ribosomal_L29e Pfam Description: Ribosomal L29e protein family

SEQ ID NO: 2085 - DNA, 342 bp, Zea mays
  misc_feature: Ceres CLONE 262406-F
  misc_feature: Encodes the peptide sequence at SEQ ID NO. 2086
  misc_feature (165)..(165): n is a, c, t, g, unknown, or other
gcagtgcaaagcgtcaacgcaaacagaccaagatccagaagcaagaaagtgtttatagcctagccggtgcgcgcrwygakagggatagccgattatyatcaagcgtctgagctagcagagaagatgagcgcatcgtcgtccatgaccaagaaggcgtcgtcgttngtkgtggcggcgagcatgagcryggtggaggcgctcaaggaccaggcggggctgtacggtgggactacgcgctccgctccctctacaacckcgcggccgccgccaataaggtcgtcgccggccgcgcstcccgttgtcgttgtcgtcgtcccaaaccgcgggtggcagtggcagcgc

SEQ ID NO: 2086 - protein, 73 aa, Zea mays
  misc_feature: Ceres CLONE 262406-F
  misc_feature (14)..(14): Xaa is any aa, unknown, or other
  misc_feature (22)..(22): Xaa is any aa, unknown, or other
  misc_feature (45)..(45): Xaa is any aa, unknown, or other
  misc_feature (57)..(57): Xaa is any aa, unknown, or other
MSASSSMTKKASSXVVAASMSXVEALKDQAGLYGGTTRSAPSTTXRPPPIRSSPAAXPVVVVVVPNRGWQWQR

SEQ ID NO: 2087 - DNA, 126 bp, Zea mays
  misc_feature: Ceres CLONE 262415-F
acgcacaccgcgacccagtccagagccagtacgtgcgamaggcacgcacgctgctggtccgcgtacsagacgacggtcaggtcggccggtgcttttcagttgtggaataatgacggcgacgacgac

SEQ ID NO: 2088 - DNA, 360 bp, Zea mays
  misc_feature: Ceres CLONE 262450-F
  misc_feature: Pfam Name: Vps55 Pfam Description: Vacuolar protein sorting 55
  misc_feature (9)..(9): n is a, c, t, g, unknown, or other
  misc_feature (77)..(77): n is a, c, t, g, unknown, or other
  misc_feature (258)..(258): n is a, c, t, g, unknown, or other
  misc_feature (322)..(322): n is a, c, t, g, unknown, or other
aaaaaaaantyttgattcccccctctccttccccttcccaacgctctcgctgcagaggaaaggcgaagatggcgatnaccgtcgaaktgcttgctgcactcgcgttcatgttttccacgagtattctamstgcagatactggmatgcgctttgtamaamaactggtggcccatkttagcagctctcaatgtacgtccttgtaccaatsccatscctgttttttggtggtggatccacacacttcttgaccaagcaganaaggtggagggtggattaatgctgcaaaattcttractggtgcktcggccaatgggaacccttnctattccagcaattctaaggcmacgctggcttaatcga

SEQ ID NO: 2089 - DNA, 297 bp, Zea mays
  misc_feature: Ceres CLONE 262457-F
  misc_feature: Encodes the peptide sequence at SEQ ID NO. 2090
  misc_feature (93)..(93): n is a, c, t, g, unknown, or other
gatctgagatggacatcgatccaccgaggtttcttgtgcgtgccgccatggccatggcagtagctcaccttcttcctcagctctccgccgaanattggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccabtcgccgccgctcgcgcgtccgggcttctacctggcgccgtccgccacgtccagcatgg

SEQ ID NO: 2090 - protein, 61 aa, Zea mays
  misc_feature: Ceres CLONE 262457-F
  misc_feature (42)..(42): Xaa is any aa, unknown, or other
MAILLILQLFLLTALGVDGAASFIFTNACKHAVWVGALHGAXRRRSRVRASTWRRPPRPAW

SEQ ID NO: 2091 - DNA, 273 bp, Zea mays
  misc_feature: Ceres CLONE 262475-F
  misc_feature: Encodes the peptide sequence at SEQ ID NO. 2092
  misc_feature (69)..(69): n is a, c, t, g, unknown, or other
  misc_feature (106)..(106): n is a, c, t, g, unknown, or other
aacgccggcaagaaccgcccctcgcaagcaatcgcttstcgtcgcgctcgaatcccgcgcgttcgssancggccgaggaggaggatgagcatggccgggaagggangagggaaktcgctggtcgccgcgaagatagcggctggcatggacaaggacaagaagtcgccggtcaaccgctccgscgcgccggcctccatttccctgtggacgcatccaccgccacctgaaggatagcgcacaggccggcgagcgggtgggggcgacggcggccgt

SEQ ID NO: 2092 - protein, 47 aa, Zea mays
  misc_feature: Ceres CLONE 262475-F
  misc_feature (6)..(6): Xaa is any aa, unknown, or other
  misc_feature (8)..(8): Xaa is any aa, unknown, or other
  misc_feature (31)..(31): Xaa is any aa, unknown, or other
MAGKGXGXSLVAAKIAAGMDKDKKSPVNRSXAPASISLWTHPPPPEG

SEQ ID NO: 2093 - DNA, 435 bp, Zea mays
  misc_feature: Ceres CLONE 262549-F
  misc_feature: Pfam Name: Ribosomal_L22e Pfam Description: Ribosomal L22e protein family
agtgtctggaaaccctagccgccatatctcacgatccactcgakcaccaagccgagggaaggggaggagcgatggcgcgcggcgtggtgtcggckaakggcggcgcggtcgcggcaagaagaaggggtcggtttccttcacgatcgactgcaccaagccagtggaggacaagatcatggaggtcgcctcgctcgagaagttcctgcaggagcgcatcaaggtcgccggcggaaggctggcaacctcggcgactccgtcaccatctctcgcgagaagaccaaggtcaccgtcacctctgacggacccttctccaagaggtacctgaastacttgaccaagaagtacttgaagaagcacaacgtcgttgaattvgctacgcgtcgttgctgccaacaaggaccgawacgtctatgagctccgctacttcaacatttc

SEQ ID NO: 2094 - DNA, 260 bp, Zea mays
  misc_feature: Ceres CLONE 262585-F
aaagaaagaaaaaatcgagaggacgccagggccgattctctgcgtgacttggggcgtcgtcgcgagttttctccggccgagggcggcgcgaccggacaaccagcgtgabctgaccggcgacatgactcgcggcaaccagcgtgaccgcgaccgtgagctgcgcggcggcggaagcccaacgccaagaactcccaggacgggctcaccccggagcagcgccgcgagagggacaagaaagctctggaggagaaggcggccaa

SEQ ID NO: 2095 - DNA, 127 bp, Zea mays
  misc_feature: Ceres CLONE 262658-F
acacgcacaccgcgacccagtccagagccagtacgtgcgamggcacgcacgctgctggtccgcgtacsagacgacggtcaggtcggccggtgcttttcagtttgaaataatgacggcgacgacgacg

SEQ ID NO: 2096 - DNA, 448 bp, Zea mays
  misc_feature: Ceres CLONE 262669-F
  misc_feature: Encodes the peptide sequence at SEQ ID NO. 2097
  misc_feature (185)..(185): n is a, c, t, g, unknown, or other
  misc_feature (441)..(441): n is a, c, t, g, unknown, or other
acgcaacctcccactgcattctcgaattacgattcccaatccagcaaaccctaccagccttttgcaaactcagagagggacccgatggcacccaaggcggagaagaagccggcggcragaagcccgcagaggaggagcccgcggccccggcggagaaggcccccgctgggaagaagccgamgtangaagcggctcccggcgggaaaatccgccgcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggckagsgccaagctcgcccgctacaacaagaagcccaccatcacctcccggganatccaga

SEQ ID NO: 2097 - protein, 148 aa, Zea mays
  misc_feature: Ceres CLONE 262669-F
  misc_feature (85)..(144): Pfam Name: Histone Pfam Description: Core histone H2A/H2B/H3/H4
  misc_feature (39)..(39): Xaa is any aa, unknown, or other
  misc_feature (60)..(60): Xaa is any aa, unknown, or other
  misc_feature (61)..(61): Xaa is any aa, unknown, or other
  misc_feature (130)..(130): Xaa is any aa, unknown, or other
  misc_feature (131)..(131): Xaa is any aa, unknown, or other
  misc_feature (147)..(147): Xaa is any aa, unknown, or other
ATSHCILELRFPIQQTLPAFCKLREGPDGTQGGEEAGGXKPAEEEPAAPAEKAPAGKKPXXEAAPGGKIRRKEGGVDKKGRKKAKKSVETYKIYIFKVLKQVHPDIGISSKAMSIMNSFINDIFEKLAGXXQARPLQQEAHHHLPGXP

SEQ ID NO: 2098 - DNA, 127 bp, Zea mays
  misc_feature: Ceres CLONE 262739-F
acgcacaccgcgacccagtccagagccagtacgtgcgamggcacgcacgctgctggtccgcgtacsaggacgacggtcaggtcggccggtgcttttcagtttggaataatgacggcgacgacgacga

SEQ ID NO: 2099 - DNA, 414 bp, Zea mays
  misc_feature: Ceres CLONE 262789-F
  misc_feature: Encodes the peptide sequence at SEQ ID NO. 2100
  misc_feature (71)..(71): n is a, c, t, g, unknown, or other
  misc_feature (73)..(73): n is a, c, t, g, unknown, or other
  misc_feature (283)..(283): n is a, c, t, g, unknown, or other
agggttaggaaggcggcggcagcggcgagagcgcgagakgaggaggggtcggccatgacggggaaggcganangaagcacacagcgaaggagatcgccgcgaagatcgacgcggcacgacgaaccggggcggcggcaaggccgggcaggcggaccggctggggcaggacaagggcgggcacgcgaacstkgcgtgccccctctgccgcaccccggcgcccgacatcaagtccatgcagatccaccacgaggcgcgccaccccaagctccccttcgagccgganaagctcctcaacctgcactcctccgcccccgctgctgctgccgccgccgccgccactgccgaggccaccacctccaagcccaagcccggcgtccgcggcagcctcaagaagtaagcttgctggcttggttg

SEQ ID NO: 2100 - protein, 54 aa, Zea mays
  misc_feature: Ceres CLONE 262789-F
  misc_feature (17)..(17): Xaa is any aa, unknown, or other
MQIHHEARHPKLPFEPXKLLNLHSSAPAAAAAAAATAEATTSKPKPGVRGSLKK

SEQ ID NO: 2101 - DNA, 395 bp, Zea mays
  misc_feature: Ceres CLONE 262799-F
  misc_feature (65)..(65): n is a, c, t, g, unknown, or other
  misc_feature (230)..(230): n is a, c, t, g, unknown, or other
atcttgctctgaacgcattcctcccatctcccaagacctcctcagacccgagaagcgcmkgcggnccatggacgccaccggcactggagctggagggaaggcgaagaagggagcggccggtcgcaaggycgcgggcgaggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgct

SEQ ID NO: 2102 - DNA, 135 bp, Zea mays
  misc_feature: Ceres CLONE 262818-F
  misc_feature (66)..(66): n is a, c, t, g, unknown, or other
acgcacaccgcgacccagtccagagccagtacgtgcgamgacacgcacgctgctggtccgcgtacnagacgacggtcaggtcggccggtgcttttcagtttggaataatgacggcgacgacgacgacagccgccg

SEQ ID NO: 2103 - DNA, 431 bp, Zea mays
  misc_feature: Ceres CLONE 262848-F
  misc_feature: Encodes the peptide sequence at SEQ ID NO. 2104
  misc_feature (46)..(46): n is a, c, t, g, unknown, or other
  misc_feature (47)..(47): n is a, c, t, g, unknown, or other
  misc_feature (244)..(244): n is a, c, t, g, unknown, or other
agatagatagatagatagatagggtaaccgatcgaatccgccaacnnaacaatggcgtccgacggcagtggcgtggtgacggtgtacggcaacaacggcgcggcgctgctggagccgccgaagcagcccaagtcgtcgactttctccgtgaaggtgggcctggcgcagatgctccgcggcggtgtgatcatggacgtggtgaccccggagcaggcccgcctcgccgaggaggccggcgcctgcnctgaattggcstgggagcgtgtccccgccgacatcctcgcgcagggtggcgtggcgcgcatgtcggacccgggcctgatccgcgacatcaagcgcgccgtgaccatccccgtcatggccaaggcccgcatcgggcacttcgtggaggcgcagatcctggaggccgtgggcgtggactacgtggacga

SEQ ID NO: 2104 - protein, 126 aa, Zea mays
  misc_feature: Ceres CLONE 262848-F
  misc_feature (29)..(126): Pfam Name: SOR_SNZ Pfam Description: SOR/SNZ family
  misc_feature (65)..(65): Xaa is any aa, unknown, or other
MASDGSGVVTVYGNNGAALLEPPKQPKSSTFSVKVGLAQMLRGGVIMDVVTPEQARLAEEAGACXELAWERVPADILAQGGVARMSDPGLIRDIKRAVTIPVMAKARIGHFVEAQILEAVGVDYVD

SEQ ID NO: 2105 - DNA, 469 bp, Zea mays
  misc_feature: Ceres CLONE 263028-F
  misc_feature: Translation starting site: 234
  misc_feature: SWISSPROT Homolog: EC 2.7.10.2 Non-specific protein-tyrosine kinase
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgttggctcccgaggagcaccccgtcctcctcaccgagcgcccctgaaccccaaggctaacagggagaagatgacccagat

SEQ ID NO: 2106 - DNA, 467 bp, Zea mays
  misc_feature: Ceres CLONE 263039-F
  misc_feature: Encodes the peptide sequence at SEQ ID NO. 2107
  misc_feature (282)..(282): n is a, c, t, g, unknown, or other
  misc_feature (283)..(283): n is a, c, t, g, unknown, or other
aatccagcacattcccatgacgggccacgccagcctgctgctgctgctgctgccggcgctcgcgccgttccttctctgctgccccctcgcgcaatgcgggcagcagaactacacctccatgttcagcttcggcgactcgctcaccgacaccggcaacctgctcgtgtccagcccgctctccaaccacatcgtcggccgctacccctacggcatcacctacttccaccgccccaccggccgctgctccgacggccgcctcgtcgtcgacttcctagcgcaasnntcggcctgccgctgctgcagccgtacctgcagtcccgcggcaaggacctgcgccggggcgtcaacttcgccgtcgggcgccaccgcattggatccgcccttcttccaggagatcggcgcgtccgacaagctctggaccaacttgtcccctcagcgtccagctcggctcgttcgagcagctcaag

SEQ ID NO: 2107 - protein, 150 aa, Zea mays
  misc_feature: Ceres CLONE 263039-F
  misc_feature: SWISSPROT Homolog: EC 3.2.1.51 Alpha-L-fucosidase
  misc_feature (89)..(89): Xaa is any aa, unknown, or other
MTGHASLLLLLLPALAPFLLCCPLAQCGQQNYTSMFSFGDSLTDTGNLLVSSPLSNHIVGRYPYGITYFHRPTGRCSDGRLVVDFLAQXSACRCCSRTCSPAARTCAGASTSPSGATALDPPFFQEIGASDKLWTNLSPQRPARLVRAAQ

SEQ ID NO: 2108 - DNA, 462 bp, Zea mays
  misc_feature: Ceres CLONE 263087-F
  misc_feature: Encodes the peptide sequence at SEQ ID NO. 2109
  misc_feature (135)..(135): n is a, c, t, g, unknown, or other
  misc_feature (415)..(415): n is a, c, t, g, unknown, or other
  misc_feature (452)..(452): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcrbgtaggcacgggtgcccccgtctacctcgccgccgtcctggagtacctcgcggccgaggtgctcgagctcgccggcaacgcgcaagggacaacaagaagacgcgcatcattccgcgccacgtgctcctcgccatccgcaacgacgaggagctcggcaagctgctggccggcgtcaccatcgcccacgggncgtcctccccaacatccacactgtgctcctccccaanaaggtggccg

SEQ ID NO: 2109 - protein, 131 aa, Zea mays
  misc_feature: Ceres CLONE 263087-F
  misc_feature (6)..(6): Xaa is any aa, unknown, or other
  misc_feature (22)..(22): Xaa is any aa, unknown, or other
  misc_feature (53)..(53): Xaa is any aa, unknown, or other
  misc_feature (116)..(116): Xaa is any aa, unknown, or other
  misc_feature (128)..(128): Xaa is any aa, unknown, or other
MDVSGXAVRRRRARRGARPAGXRRSRCRGPPGPGCSSPSAASGVPQKGPVRAXRHGCPRLPRRRPGVPRGRGARARRQRARDNKKTRIIPRHVLLAIRNDEELGKLLAGVTIAHGXSSPTSTLCSSPXRWP

SEQ ID NO: 2110 - DNA, 100 bp, Zea mays
  misc_feature: Ceres CLONE 263096-F
accatttggacaccgatccatccatccatccatccagccccgtacgtgtctcgctggccgtccgtatatatagagagaggcatcggagattggccgccac

SEQ ID NO: 2111 - DNA, 487 bp, Zea mays
  misc_feature: Ceres CLONE 263196-F
  misc_feature: Encodes the peptide sequence at SEQ ID NO. 2112
ctcaatctctctcttctcctcgcctcgccttggtgttcacgccgtcgctagcgcctgcygcggcgaacgttctgtcctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagayattgaagttgacaacagtgtgagagaggatcgtgctctgctgaatggtgcacaaaagttgcttggtatcc

SEQ ID NO: 2112 - protein, 107 aa, Zea mays
  misc_feature: Ceres CLONE 263196-F
  misc_feature (101)..(101): Xaa is any aa, unknown, or other
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKXLKLTTV

SEQ ID NO: 2113 - DNA, 228 bp, Zea mays
  misc_feature: Ceres CLONE 263201-F
  misc_feature (46)..(46): n is a, c, t, g, unknown, or other
  misc_feature (48)..(48): n is a, c, t, g, unknown, or other
atccgaaattccgaaacccctgcggcatgggaatggaaatcgagangncgccgcagccaccgcctgtcgttgctccatggctgcggcggcasatttttccacggtgctcggcgacgacgaccttctgctgcgagatcctcgtacgcctcggcctccccaccagtctcctccgtgcygctctcgtctgccggcgctggctccgcacgctccgatccggccttcctccgc

SEQ ID NO: 2114 - DNA, 500 bp, Zea mays
  misc_feature: Ceres CLONE 263254-F
  misc_feature (35)..(35): n is a, c, t, g, unknown, or other
  misc_feature (74)..(74): n is a, c, t, g, unknown, or other
  misc_feature (189)..(189): n is a, c, t, g, unknown, or other
  misc_feature (319)..(319): n is a, c, t, g, unknown, or other
  misc_feature (464)..(464): n is a, c, t, g, unknown, or other
ctctctctctcttgcccwdccccccacctcggctngctcagctcagctcctaaaccggcacctacctctctgyntgctghcccggcccctgatcatgatttccccaatcgagagtccgagacccgagaggaggcacaggcacctgcgctastgcagctgcaaatcgtcttccccagatccggcgccgtnaagttcgctcctgctcgcgacascccagagccgtccgcgtgcgcccgcagagatcgtttcggggacagccgagcagagcagagctgactctgccgcttgttgcccgttcttggctgctgttgctggcganasgcgcaggaggagcggttgatttttgattctctctgtccctccctcccttgcttcgcttcgctcgcgcggggtgcgtgcacgtaccatgagaagatgatgcgcgccaggcccaaaggtacattcgccgacgcgatgagggaganctcccctcctcctcctccccctccccctccggctcc

SEQ ID NO: 2115 - DNA, 411 bp, Zea mays
  misc_feature: Ceres CLONE 263263-F
  misc_feature: Encodes the peptide sequence at SEQ ID NO. 2116
  misc_feature (93)..(93): n is a, c, t, g, unknown, or other
  misc_feature (113)..(113): n is a, c, t, g, unknown, or other
  misc_feature (144)..(144): n is a, c, t, g, unknown, or other
  misc_feature (199)..(199): n is a, c, t, g, unknown, or other
  misc_feature (210)..(210): n is a, c, t, g, unknown, or other
  misc_feature (260)..(260): n is a, c, t, g, unknown, or other
aagagagagagagagagaggagtgggagacccgcgagakgctgccgtgtagggaccgtagactcagcgactgcgaaggagggataaggggatngccgggatcggaccgatcangcaggacttggagccggwcgttktgcggaanaaggcacccaccgcccgccaagaaggatgagaaggccgtcaacgccgcgcgccgncggttgcgganatcgataccatgaagaagtacaacgctggtacgaacaaggcggcatccancggtacatccctcaacaccaagcgcctcgacgacgacaccgraaacctcgsccatgagsgagttccaagtgatctgaagaagaatctcatgcaagcaaggctcgataagaagctgacacaggcacaacttgctcagatgataaatgagaag

SEQ ID NO: 2116 - protein, 64 aa, Zea mays
  misc_feature: Ceres CLONE 263263-F
  misc_feature: The sequence is a functional homolog of SEQ ID NO 1 in US patent 7238857
  misc_feature (14)..(14): Xaa is any aa, unknown, or other
  misc_feature (28)..(28): Xaa is any aa, unknown, or other
  misc_feature (31)..(31): Xaa is any aa, unknown, or other
  misc_feature (34)..(34): Xaa is any aa, unknown, or other
MKKYNAGTNKAASXGTSLNTKRLDDDTXNLXHEXVPSDLKKNLMQARLDKKLTQAQLAQMINEK

SEQ ID NO: 2117 - DNA, 422 bp, Zea mays
  misc_feature: Ceres CLONE 263290-F
  misc_feature: Encodes the peptide sequence at SEQ ID NO. 2118
  misc_feature (279)..(279): n is a, c, t, g, unknown, or other
  misc_feature (347)..(347): n is a, c, t, g, unknown, or other
tctccatccccatccatagagctgcaggcgtcctgcgctgcagccaacaagctcatcagctcaccgtacctaggaggacgaccgagcagctaaggtagtagtagctagctagccagtgatggcgggctacaaagcgcagggcggggcgctcggcgtcgtcctggctgtcgccgcgctcttcgcsgccasgatgggcgatggcggtggacgacgagcacatgtaccactggaagtgcttcaagtcgtgcacggggaactgccgcgacgaggacgcctttnacgacgtcgtsccccgccactccgagggctcctcccacgtcgtcgtcgctgccgtctccggcggcaanktgcaaggacaggtcctcagcgagtgcttcgaggacctgccgggccctctgctaccaccagtgcgtcgccaccaa

SEQ ID NO: 2118 - protein, 75 aa, Zea mays
  misc_feature: Ceres CLONE 263290-F
  misc_feature (28)..(28): Xaa is any aa, unknown, or other
  misc_feature (50)..(50): Xaa is any aa, unknown, or other
  misc_feature (51)..(51): Xaa is any aa, unknown, or other
MAVDDEHMYHWKCFKSCTGNCRDEDAFXDVVPRHSEGSSHVVVAAVSGGXXQGQVLSECFEDLPGPLLPPVRRHQ

SEQ ID NO: 2119 - DNA, 497 bp, Zea mays
  misc_feature: Ceres CLONE 263336-F
  misc_feature: Translation starting site: 304
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcag

SEQ ID NO: 2120 - DNA, 432 bp, Zea mays
  misc_feature: Ceres CLONE 263367-F
  misc_feature: SWISSPROT Homolog: EC 3.2.1.14 Chitinase
  misc_feature (376)..(376): n is a, c, t, g, unknown, or other
aaatcacctcacaacaagctgccccgcmgaacgaacacgaaccttggcagaacgaagctgaagtagttcgttgtgaacccagtatggcaaacgcgccgaggatcctggccctcggctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgtatcttcaacggcatcaagaaccaggccgggagcgggtncgagggcaagaacttctacacccggagcgcgttcctgagcgccgtcaacaagtacc

SEQ ID NO: 2121 - DNA, 490 bp, Zea mays
  misc_feature: Ceres CLONE 263426-F
  misc_feature: Encodes the peptide sequence at SEQ ID NO. 2122
aacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaattgatgtgtcgttttctgttc

SEQ ID NO: 2122 - protein, 60 aa, Zea mays; identical to SEQ ID NO: 1569
  misc_feature: Ceres CLONE 263426-F
  misc_feature (3)..(42): Pfam Name: Ribosomal_L29e Pfam Description: Ribosomal L29e protein family

SEQ ID NO: 2123 - DNA, 497 bp, Zea mays
  misc_feature: Ceres CLONE 263443-F
  misc_feature: Encodes the peptide sequence at SEQ ID NO. 2124
  misc_feature (182)..(182): n is a, c, t, g, unknown, or other
  misc_feature (186)..(186): n is a, c, t, g, unknown, or other
  misc_feature (433)..(433): n is a, c, t, g, unknown, or other
  misc_feature (462)..(462): n is a, c, t, g, unknown, or other
actttcgatcgacacagaaaattccccaccaaaatctcctccccctgaagtcccgaagctcgcggaasccgagatgtaccatcccacgagaggcggcgtccgcggcggcagagatcaattcaaatgggacgatgtgaaggttgacaagcatcgggagaattaccttggtcatagtgttaagnctyngttkgtagatggcagaaaggaaaggatctttactggtatactcgggataagaaatccgacacgggagatgctcttaaggaagaaatcaggagagtgaaggaagaggaggaacaggctatgcgtgaggctcttggcttagctcctaagcgcmsaatcgaactcagggtaatcgcttggataagcatgaatatgctgagctgattaagagaggatcaactgcggaggacttgggaagcaggacacgctnaagcagcacaagtgcagggtctaggattntacaaggcccctcgcgatgagggtggatcaagttc

SEQ ID NO: 2124 - protein, 69 aa, Zea mays
  misc_feature: Ceres CLONE 263443-F
  misc_feature (37)..(37): Xaa is any aa, unknown, or other
  misc_feature (38)..(38): Xaa is any aa, unknown, or other
  misc_feature (39)..(39): Xaa is any aa, unknown, or other
MYHPTRGGVRGGRDQFKWDDVKVDKHRENYLGHSVKXXXVDGRKERIFTGILGIRNPTREMLLRKKSGE

SEQ ID NO: 2125 - DNA, 90 bp, Zea mays
  misc_feature: Ceres CLONE 263461-F
  misc_feature: Encodes the peptide sequence at SEQ ID NO. 2126
aaagtttcgtccaccatttcgctctcgcaagtbgccaagccaccgatttgtttacaggcgccggagctcccgacgacgactgagccatgt

SEQ ID NO: 2126 - protein, 30 aa, Zea mays
  misc_feature: Ceres CLONE 263461-F
KVSSTISLSQVAKPPICLQAPELPTTTEPC

SEQ ID NO: 2127 - DNA, 413 bp, Zea mays
  misc_feature: Ceres CLONE 263523-F
  misc_feature: SWISSPROT Homolog: EC 1.1.1.219 Dihydrokaempferol 4-reductase
  misc_feature (205)..(205): n is a, c, t, g, unknown, or other
  misc_feature (207)..(207): n is a, c, t, g, unknown, or other
  misc_feature (220)..(220): n is a, c, t, g, unknown, or other
  misc_feature (252)..(252): n is a, c, t, g, unknown, or other
  misc_feature (373)..(373): n is a, c, t, g, unknown, or other
  misc_feature (381)..(381): n is a, c, t, g, unknown, or other
acctcgagtctgagagaatggctaacactgctaagggtaaggtctgtgtcactggggcgtctggtttcatcgcctcctggctcgtcaagcggcttcttgagtctgggtacatgtcctgggaacagtcagagacccagggaatggcaagaaagtagggcactctggggcctggaaskcaaaggaaaggctgcagctcgtgagmkantnctcttggaggaanggagcttcgacgacgctgtgatggcttgckanggcgtcttccacaccgcatcgcccgtcgtcaccggatctaattccaaggaggakatgcttgattcagcaataaacggcasatgaacgtstacgctcgtkcaagaagaacccatcgctcaanagggtttnttctgacatcctcgtcgtcgacagtgaggatc

SEQ ID NO: 2128 - DNA, 446 bp, Zea mays
  misc_feature: Ceres CLONE 263570-F
  misc_feature: SWISSPROT Homolog: EC 3.1.2.15 Ubiquitin thiolesterase
  misc_feature (280)..(280): n is a, c, t, g, unknown, or other
gtacctttcgttgctctcgcgcactcggatcgacccctctagggtttcgcatcggcctcccgccagctcctatccctcccctctccctccgccgcgcgcccgsgggagccaccaaaccctaggacggcaaatccggtgcgatcgcccacggtggaggcctcgtcggcggccgagaggagccgctcagggctcgggtcagggttccggtacctcgccggcgccgcctctggctggtgggaccggtggatggtcatgggagccagcggctcaaagycttganaaggccctcggagaccagttcccggaagcgagcgctacttcggcctcgagaacttcggcaacacctactgcaacagtgtccttcaggcactttattttggcattccattcargggagcakttactggaatattatgcaaataacaaaactccaggagacgctgagg

SEQ ID NO: 2129 - DNA, 514 bp, Zea mays
  misc_feature: Ceres CLONE 263572-F
  misc_feature: Encodes the peptide sequence at SEQ ID NO. 2130
  misc_feature (120)..(120): n is a, c, t, g, unknown, or other
  misc_feature (153)..(153): n is a, c, t, g, unknown, or other
  misc_feature (180)..(180): n is a, c, t, g, unknown, or other
acactagtcaaattttacgtaacttgcgtggttctcttcctgcgacggaagcaaacactgcccgagacatagacagcgggacgtcgagatggccgacggggaggacgccgccgccgcgcncygccgggccgccatcacagactaccgcaagangctgctcaactgcagggagctagagtngcgcgtcggcaccgtgagagaaagccttaawactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagatccaggaatgtcagttactctggctgta

SEQ ID NO: 2130 - protein, 142 aa, Zea mays
  misc_feature: Ceres CLONE 263572-F
  misc_feature (11)..(11): Xaa is any aa, unknown, or other
  misc_feature (12)..(12): Xaa is any aa, unknown, or other
  misc_feature (22)..(22): Xaa is any aa, unknown, or other
  misc_feature (31)..(31): Xaa is any aa, unknown, or other
  misc_feature (41)..(41): Xaa is any aa, unknown, or other
MADGEDAAAAXXRAAITDYRKXLLNCRELEXRVGTVRESLXTAKKDFTKTEDDLKSLQSVGQIIGEVLRPLDNERFIVKASSGPRYVVGCRSKVDKEKLTSGTRVVLDMTTLTIMRTLPREVDPVVYNMLHEDPGMSVTLAV

SEQ ID NO: 2131 - DNA, 486 bp, Zea mays
  misc_feature: Ceres CLONE 263582-F
  misc_feature: Translation starting site: 269
  misc_feature: Pfam Name: WD40 Pfam Description: WD domain, G-beta repeat
aatctttgtaggacacccgcaccctccgcgtcgaacacccgatccggacaccgctccaggctccacctctctcccatctcacgccaacgctcactggaccattcctccgtgcttgggagcggcggagagctatccacctcgtctcaggcaccctctggcgtccccctccccccgccgcgtgccggcgagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgttaacattggtgcggcaaatgcccatcccaggtcctggcaacgcttagtggccamtatggtcctgtgtggcgtgtttgcttgggcccatccaaagtattgtgcaat

SEQ ID NO: 2132 - DNA, 498 bp, Zea mays
  misc_feature: Ceres CLONE 263589-F
  misc_feature: Encodes the peptide sequence at SEQ ID NO. 2133
  misc_feature (118)..(118): n is a, c, t, g, unknown, or other
  misc_feature (151)..(151): n is a, c, t, g, unknown, or other
actagtcaaattttacgtaacttgcgtggttctcttcctgcgacggaagcaaacactgcccgagacatagacagcgggacgtcgagatggccgacggggaggacgccgccgccgcgyncygccgggccgccatcacagactaccgcaagangctgctcaactgcagggagctagagthgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagatccaggaaatgtca

SEQ ID NO: 2133 - protein, 137 aa, Zea mays
  misc_feature: Ceres CLONE 263589-F
  misc_feature (11)..(11): Xaa is any aa, unknown, or other
  misc_feature (12)..(12): Xaa is any aa, unknown, or other
  misc_feature (22)..(22): Xaa is any aa, unknown, or other
  misc_feature (31)..(31): Xaa is any aa, unknown, or other
MADGEDAAAAXXRAAITDYRKXLLNCRELEXRVGTVRESLKTAKKDFTKTEDDLKSLQSVGQIIGEVLRPLDNERFIVKASSGPRYVVGCRSKVDKEKLTSGTRVVLDMTTLTIMRTLPREVDPVVYNMLHEDPGNV

SEQ ID NO: 2134 - DNA, 279 bp, Zea mays
  misc_feature: Ceres CLONE 263612-F
  misc_feature (138)..(138): n is a, c, t, g, unknown, or other
  misc_feature (232)..(232): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctgcagttccccgtcagccgcgtcgggcgtacctcaaaaagggccggtacgcgcattanggcacgggtgcccccgtctacctcgccgccgtcctggagtacctcgc

SEQ ID NO: 2135 - DNA, 472 bp, Zea mays
  misc_feature: Ceres CLONE 263713-F
  misc_feature: Encodes the peptide sequence at SEQ ID NO. 2136
  misc_feature (243)..(243): n is a, c, t, g, unknown, or other
  misc_feature (245)..(245): n is a, c, t, g, unknown, or other
atcacaattcactccactcatcttttcgcgtttagaacctctaaaatttcccccactcgccagtcgcagcagcacctgtagccatggacgccagcggascggtagcaaggggaagaagggtgckgccgggcgcaaggtcaggckgccccaggaagaagtcggtgatcgcggtccgttcaaggccgggctgcagttccccgttcggccggatcgggcgctacctgaagawagggccggtacgcncncgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgccca

SEQ ID NO: 2136 - protein, 157 aa, Zea mays
  misc_feature: Ceres CLONE 263713-F
  misc_feature (33)..(33): Xaa is any aa, unknown, or other
  misc_feature (48)..(48): Xaa is any aa, unknown, or other
  misc_feature (76)..(76): Xaa is any aa, unknown, or other
  misc_feature (81)..(81): Xaa is any aa, unknown, or other
  misc_feature (82)..(82): Xaa is any aa, unknown, or other
SQFTPLIFSRLEPLKFPPLASRSSTCSHGRQRXGSKGKKGAAGRKVRXPQEEVGDRGPFKAGLQFPVRPDRALPEXRAGTXXWALAPPSTSPPSWSTSPPRFWSWQGTRRKTTRRRASSRATCSWRSATTRSSGSCWQASPSRTAASSPTSTPCSCP

SEQ ID NO: 2137 - DNA, 472 bp, Zea mays; identical to SEQ ID NO: 2135
  misc_feature: Ceres CLONE 263713-F2
  misc_feature (243)..(243): n is a, c, t, g, unknown, or other
  misc_feature (245)..(245): n is a, c, t, g, unknown, or other

SEQ ID NO: 2138 - DNA, 448 bp, Zea mays
  misc_feature: Ceres CLONE 263757-F
  misc_feature: Encodes the peptide sequence at SEQ ID NO. 2139
  misc_feature (36)..(36): n is a, c, t, g, unknown, or other
  misc_feature (277)..(277): n is a, c, t, g, unknown, or other
  misc_feature (343)..(343): n is a, c, t, g, unknown, or other
  misc_feature (394)..(394): n is a, c, t, g, unknown, or other
  misc_feature (397)..(397): n is a, c, t, g, unknown, or other
  misc_feature (399)..(399): n is a, c, t, g, unknown, or other
agcggtacgatggccgcttcgagaatggcgctcgtntcttgcgcccgccgcctcccgtccttaccctctccgctcaccctctcgaggccccgcgccggcgccgtctcatttctggctgcccaaccgtcgccggcgacgcaccgagatccggcaggaatcttgctctcttctgttctttatcaccgacgtcgccatcgctaactgaggccgccgtagcactgccgccaccgaagctgcggtggaagagacgaagccccctgtgccgaccggggacganaagggggaaccgaccgtggaggagctagcgggcctgctggacgtccgggtgggccgagtggtgaangcgtggaggcacccggagcggacaccctctacgttgatgaggtggacgtangtnangcggacccggaccatctgcagcggcctcgtcaacttcctccccatcgaa

SEQ ID NO: 2139 - protein, 100 aa, Zea mays
  misc_feature: Ceres CLONE 263757-F
  misc_feature (12)..(12): Xaa is any aa, unknown, or other
  misc_feature (92)..(92): Xaa is any aa, unknown, or other
RYDGRFENGARXLRPPPPVLTLSAHPLEAPRRRRLISGCPTVAGDAPRSGRNLALFCSLSPTSPSLTEAAVALPPPKLRWKRRSPLCRPGTXRGNRPWRS

SEQ ID NO: 2140 - DNA, 434 bp, Zea mays
  misc_feature: Ceres CLONE 263782-F
  misc_feature: Encodes the peptide sequence at SEQ ID NO. 2141
  misc_feature (215)..(215): n is a, c, t, g, unknown, or other
  misc_feature (284)..(284): n is a, c, t, g, unknown, or other
  misc_feature (291)..(291): n is a, c, t, g, unknown, or other
aaggaagaagggcctcctgtatcctctcacttccctcagtcctcgtccgtctgctccctcctctctctacctagctctagctagccttcctgtagcgcggcagagatggctgcccctgcctccaccacggcggcggcggcggcasgctgctbtgctgctcctcctgtcgctcgccgcggcggcggacatgtcgatcgtgtcctacggggagcgcngatggaggcgcggcggatgtacgcggagtggatggcggcgcacggccggacctacaacgccgtcggcanggaggancggcggtaccaggtgttccgggacaacctccgctacatcgacgcgcacaacgccgccgccgacgcgggcgtccaytccttccgcctcggcctcaaccgcttcgccgacctcaccaacgacgagtaccgcgccacctacctcgg

SEQ ID NO: 2141 - protein, 109 aa, Zea mays
  misc_feature: Ceres CLONE 263782-F
  misc_feature (44)..(104): Pfam Name: Inhibitor_I29 Pfam Description: Cathepsin propeptide inhibitor domain (I29)
  misc_feature: SWISSPROT Homolog: EC 3.4.22.14 Actinidain
  misc_feature (14)..(14): Xaa is any aa, unknown, or other
  misc_feature (16)..(16): Xaa is any aa, unknown, or other
  misc_feature (37)..(37): Xaa is any aa, unknown, or other
  misc_feature (60)..(60): Xaa is any aa, unknown, or other
  misc_feature (62)..(62): Xaa is any aa, unknown, or other
MAAPASTTAAAAAXCXAAPPVARRGGGHVDRVLRGAXMEARRMYAEWMAAHGRTYNAVGXEXRRYQVFRDNLRYIDAHNAAADAGVHSFRLGLNRFADLTNDEYRATYL

SEQ ID NO: 2142 - DNA, 346 bp, Zea mays
  misc_feature: Ceres CLONE 263788-F
  misc_feature: Encodes the peptide sequence at SEQ ID NO. 2143
  misc_feature (63)..(63): n is a, c, t, g, unknown, or other
  misc_feature (110)..(110): n is a, c, t, g, unknown, or other
  misc_feature (339)..(339): n is a, c, t, g, unknown, or other
atcttgagtgttcgacagcgagccatggagaagacgtccgagaacgccatcccgccggcggdnccccgctgatgctgttcgggtcgtgggcgagctcgtacacgcaccgncaggctggcgctsggctcaagggcctggagtacgactacgtggaggaggacctggggaacaagagcgacgagctgctgcgccacaaccccgtccacaagaaggtgcccgtgctcgtccacggcggccgcgydmtcccggagtccgtcattatcctccagtaccttgacgacgcctggccggagacccgcccgctgctccccgccgacgccttcgaccgcgcgctcsttncttggtt

SEQ ID NO: 2143 - protein, 91 aa, Zea mays
  misc_feature: Ceres CLONE 263788-F
  misc_feature (2)..(70): Pfam Name: GST_N Pfam Description: Glutathione S-transferase, N-terminal domain
  misc_feature: SWISSPROT Homolog: EC 2.5.1.18 Glutathione transferase
  misc_feature (18)..(18): Xaa is any aa, unknown, or other
  misc_feature (57)..(57): Xaa is any aa, unknown, or other
  misc_feature (58)..(58): Xaa is any aa, unknown, or other
  misc_feature (89)..(89): Xaa is any aa, unknown, or other
  misc_feature (90)..(90): Xaa is any aa, unknown, or other
MLFGSWASSYTHRQAGAXLKGLEYDYVEEDLGNKSDELLRHNPVHKKVPVLVHGGRXXPESVIILQYLDDAWPETRPLLPADAFDRALXXW

SEQ ID NO: 2144 - DNA, 490 bp, Zea mays
  misc_feature: Ceres CLONE 263795-F
  misc_feature: Translation starting site: 203
  misc_feature: Pfam Name: Sugar_tr Pfam Description: Sugar (and other) transporter
  misc_feature: Pfam Name: MFS_1 Pfam Description: Major Facilitator Superfamily
gttttcgctagggttattcgcccacccaccgcgtcgccgcagctccatctctcgcagccatcggtgaaggttcctctcctgcccccatcgcgggcgcgcgcatctcgtcttcgcaggttccagtctatatatcagagataacaccaaagaatcttagaggaggtttcgcaactgtaaaccagcttccttatttacgcagtttatgatatgttgtggggcatcacttgcttatgttctgggaacttttatctcctggcggactttggcaatcatcggagtggcaccatgtttgctgcaactggttggccttcttgttactcctgagtccccaagatggctggctaggtttggccacccaggtgcatttgaggcagcattgcagaagctaaggggaaagggaactgatatctctgacgaagcaaaaggaatcaaatcatggtattcaggattttacagaaaagcttcagcaattaccaaagtcgaagatgtt

SEQ ID NO: 2145 - DNA, 192 bp, Zea mays
  misc_feature: Ceres CLONE 263856-F
  misc_feature: Encodes the peptide sequence at SEQ ID NO. 2146
  misc_feature (76)..(76): n is a, c, t, g, unknown, or other
  misc_feature (82)..(82): n is a, c, t, g, unknown, or other
ccacacaaaaacccagcatcagtcaagctcgctcacacgaccatggccgcggcgatgaccggcagtactcgcgccnsscggnctccttcctcgtgcttcthwttgtcgtgttggccggtgtcgtcgacgtcgcgtccgctgccaccactgcggcgagtgctactgttgccactaacagcggtgacagcaacg

SEQ ID NO: 2146 - protein, 63 aa, Zea mays
  misc_feature: Ceres CLONE 263856-F
  misc_feature (25)..(25): Xaa is any aa, unknown, or other
  misc_feature (26)..(26): Xaa is any aa, unknown, or other
  misc_feature (27)..(27): Xaa is any aa, unknown, or other
  misc_feature (34)..(34): Xaa is any aa, unknown, or other
TQKPSISQARSHDHGRGDDRQYSRXXXSFLVLLXVVLAGVVDVASAATTAASATVATNSGDSN

SEQ ID NO: 2147 - DNA, 484 bp, Zea mays
  misc_feature: Ceres CLONE 263933-F
  misc_feature: Encodes the peptide sequence at SEQ ID NO. 2148
aacacgccgccgtcttctgcggttctgccgtttactcctccactttggcctcctcacttgcaagccatgggtaaggagaagtctcacatcaacattgtggttattggccacgtcgactctggcaagtygacaaccaccggccacctgatctacaagcttggaggcattgacaagcgtgtgatcgagaggtttgagaaggaggccgctgaaatgaacaagcggtcctttaagtatgcttgggtgcttgacaagctcaaggctgagcgtgagaggggtatcaccattgatattgctctgtggaagtttgagaccaccaagtactattgcaccgttattgatgcccctggacaccgtgactttatcaagaacatgatcactggtacctcccaggctgactgtgctgtccttatcattgactccaccactggtgttttgaggctggtatctccaaggatggccaracacgtgagcatgctctccttgc

SEQ ID NO: 2148 - protein, 139 aa, Zea mays
  misc_feature: Ceres CLONE 263933-F
  misc_feature (5)..(139): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (21)..(21): Xaa is any aa, unknown, or other
  misc_feature (132)..(132): Xaa is any aa, unknown, or other
MGKEKSHINIVVIGHVDSGKXTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGVLRLVSPRMAXHVSMLSL

SEQ ID NO: 2149 - DNA, 483 bp, Zea mays
  misc_feature: Ceres CLONE 263960-F
  misc_feature: Encodes the peptide sequence at SEQ ID NO. 2150
  misc_feature (188)..(188): n is a, c, t, g, unknown, or other
attttttttcgcccgccgcccccagtcccgatccgaagctgtgcctcgtaccatttcgatccaatggcgccgacgtcgaagctgtcgacgggcatcaagcgcgcttcggtcgcacgcgtaccatcgccgtgggctgtgggccatcaaggccaagawcggcggcgcttccccaaggccgacaaggcgcncgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggcctttcaagatcaatggagtaccgatccgccgtgtgaaccagacctatgtcattgctacatcaaccaaagttgacatctcaggtgttgatgtcgccaag

SEQ ID NO: 2150 - protein, 140 aa, Zea mays
  misc_feature: Ceres CLONE 263960-F
  misc_feature (31)..(31): Xaa is any aa, unknown, or other
  misc_feature (42)..(42): Xaa is any aa, unknown, or other
MAPTSKLSTGIKRASVARVPSPWAVGHQGQXRRRFPKADKAXAAVEPKFYPADDVKPRVPSTRKPKPTKLRSSITPGTVLILLAGRFMGKRVVFLKQLKSGLLLISGPFKINGVPIRRVNQTYVIATSTKVDISGVDVAK

SEQ ID NO: 2151 - DNA, 468 bp, Zea mays
  misc_feature: Ceres CLONE 263974-F
  misc_feature: Translation starting site: 79
  misc_feature: Pfam Name: Ribosomal_L11_N Pfam Description: Ribosomal protein L11, N-terminal domain
  misc_feature: Pfam Name: Ribosomal_L11 Pfam Description: Ribosomal protein L11, RNA binding domain
ctacggccgccgccagcatcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagaggacaggaagaaggtcaagaacatcaagcacagcggcaacatcagcctcgacgacgtcatcgagatcgccaagaccatgcggaacaggtccatggccaaggagttggcgggaccgtcaa

SEQ ID NO: 2152 - DNA, 244 bp, Zea mays
  misc_feature: Ceres CLONE 263998-F
  misc_feature (72)..(72): n is a, c, t, g, unknown, or other
  misc_feature (118)..(118): n is a, c, t, g, unknown, or other
acagtacacacacggaacggaatccgggcatccgggaaagcagccctaatctcaaggccgcggctgcgagcnctgcttcccacctcccaactccggaactcctccccagtcgccgcyngccgcgcgcacacccaccgagagctcgggctttctttctccgttcctccctcgcgcgctcagggtttcacgatggaggccgaggcggcggccaagagggcgcgggagggcggggaggacgccaccg

SEQ ID NO: 2153 - DNA, 770 bp, Zea mays
  misc_feature: Ceres CLONE 264004-R
  misc_feature: Encodes the peptide sequence at SEQ ID NO. 2154
gggttcgacctgagcgttgagattaacataacatcggttccagaaacaaccaaagcgcaacagggtattgcagttcctatcccgcagcagcagcagctgctactactaatgctgattaatgatagaaacgaaacaaacccacgacagatgattaccgacctactactacgacgacgacgaaaagcagcaaatgattagtttttcatgactgacggtgactgaatgtgaagcagactattctagtcctggagatctccctcctcctcgtcctcgtactcgccctcctcgtcggcggtggcgtcctggtactgctggtactcggacacgaggtcgttcatgttgctctcggcctcggtgaactccatctcgtccatgccctcccccgtgtaccagtgcaagaaggccttcctgcggaacatggcggtgaactgctcgctcacgcgccggaacatctcctggatggaggtagagttgccgatgaaggtggacgccatcttcagccccgtgggcgggatgtcgcacaccgtcgacttgacgttgttggggatccactccacgaagtaggaggagttcttgttctgcacgttcagcatctgctcgtccacctccttggtgctcatcttgccgcggaacatggcggacgccgtcaggtaccggccgtggcgcgggtccgcggcgcacatcatgttcttggcgtcccacatctgctgggtaagctccggcaccgtcagggcgcggtactgctgggagcccctggaggtgagcggcgc

SEQ ID NO: 2154 - protein, 75 aa, Zea mays
  misc_feature: Ceres CLONE 264004-R
MLLSASVNSISSMPSPVYQCKKAFLRNMAVNCSLTRRNISWMEVELPMKVDAIFSPVGGMSHTVDLTLLGIHSTK

SEQ ID NO: 2155 - DNA, 463 bp, Zea mays
  misc_feature: Ceres CLONE 264073-F
  misc_feature: Encodes the peptide sequence at SEQ ID NO. 2156
tccaggcaacaaaggactgtgtggcaaaaacattgaagaggttagaggagaagataaatggacgagtgttgaaacacttgctttatttgatgcgagtaggagagaaatctgtgcaaaggcgtgttgctctagctcttgcacacctttgtgcccctgaagatcaaagttcagtttttattgataataatggtctcgacttgcttcttgatcttcttatttccatgagctcaaaacatcaacaagatggctcagcagcattatacaaattggccaacaaagctgcagcactttctcccatggatgctgcccctccatctccaacacctcaggtttatcttggtgagcaatacgtgaatagttcaacactttcagacgttactttcttggtagaaggaaagcgattttatgcacacagaattgctttgcttgcttcttctgatgcatttcgtgcaatgtttgatgg

SEQ ID NO: 2156 - protein, 153 aa, Zea mays
  misc_feature: Ceres CLONE 264073-F
QATKDCVAKTLKRLEEKINGRVLKHLLYLMRVGEKSVQRRVALALAHLCAPEDQSSVFIDNNGLDLLLDLLISMSSKHQQDGSAALYKLANKAAALSPMDAAPPSPTPQVYLGEQYVNSSTLSDVTFLVEGKRFYAHRIALLASSDAFRAMFD

SEQ ID NO: 2157 - DNA, 452 bp, Zea mays
  misc_feature: Ceres CLONE 264155-F
  misc_feature: Encodes the peptide sequence at SEQ ID NO. 2158
ctagccgccgccagaccattcgtttctcgcgagccatcgcttctgtaattctcaggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaagttatgttttgaagttcatgctaccttttaaagtacggattaccttgtgcctatgttcattatttttgcctttgsag

SEQ ID NO: 2158 - protein, 60 aa, Zea mays
  misc_feature: Ceres CLONE 264155-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKKSGEAEAEE

SEQ ID NO: 2159 - DNA, 448 bp, Zea mays
  misc_feature: Ceres CLONE 264186-F
  misc_feature: Encodes the peptide sequence at SEQ ID NO. 2160
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagvktgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgt

SEQ ID NO: 2160 - protein, 120 aa, Zea mays
  misc_feature: Ceres CLONE 264186-F
  misc_feature (10)..(120): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (38)..(38): Xaa is any aa, unknown, or other
MVSSSMDTTSDKRASSMLAPNPGKATILALGHAFPQQXVMQDYVVDGFMKNTNCDDPELKEKLTRLCKTTTVRTRYVVMSDEILKNYPELAQEGLPTMNQRLDISNAAVTRWRRRRPCRA

SEQ ID NO: 2161 - DNA, 593 bp, Zea mays
  misc_feature: Ceres CLONE 264252
  misc_feature: Encodes the peptide sequence at SEQ ID NO. 2162
gtctctccactccactcgatcatcccacgatcgctcatcatctcataagctctgctagcttggtgcgcgcggttgacgccgcgcacgatagctaagctatctcttgaaccatcgtagtagcaaacaaaagatggttcagcggccggctgcagccggcgatcgggcaggcgcaggatggagccgggtggcggaccagccggccgcagcgggaggcaccagcggggggcggcggcgggatcgtcgccatcatcatcatcagcagcaggagctggtgcttcgtcggctgctgccgatcaacaaggccaaggcgtgccggttcaagcgcagctgcttcagcgaggaggacgacgccgcctcctccgccatgcttctgctcgcctgcgtcgtctgcgccccctcccctttgatggtgataaaaatacttttgtttactttggccgcctgcttgtaactaatcaacatgtggatcaccatgccgcatgcatgtcagtctgtcgcatcggaaacgttcgctatgtaatggggtactggtcgttgattcgtctctctgaatgagtgtttggcagcaatttctttcaaaaaaaaaaaaaaaa

SEQ ID NO: 2162 - protein, 106 aa, Zea mays
  misc_feature: Ceres CLONE 264252
MVQRPAAAGDRAGAGWSRVADQPAAAGGTSGGRRRDRRHHHHQQQELVLRRLLPINKAKACRFKRSCFSEEDDAASSAMLLLACVVCAPSPLMVIKILLFTLAACL

SEQ ID NO: 2163 - DNA, 180 bp, Zea mays
  misc_feature: Ceres CLONE 264291-F
acaattcacagcgctcaagttctcgcgcccacagccaaatttttctccactcaatcgcggcataagctgcactgcmscatggacgccagcggascggtagcaaggcgaagaagggggcggctgggcgcaaggytggcggccccaggtaagaagtcggtgttcgcggtccgttcaaggccg

SEQ ID NO: 2164 - DNA, 398 bp, Zea mays
  misc_feature: Ceres CLONE 264300-F
  misc_feature: Encodes the peptide sequence at SEQ ID NO. 2165
aaaaatccaaacaaatcggctcgcaattytccccgtcccttccccctctcatcgctcgccgctcgctcctctccctgtccgcgccgcccgctctcgaatcgaaatccctctccgccatgccgaaggcgccaagaagcgcgccaaactcaagaagcagcagcagcagggtcaccccgacgatggcggcaacacaaacgccagcagcggcaatggtaacggcagcgataacaacaacaacgcctcgagcggccgcgacggcgacccccacctgtgcatcctaccaaaagtttctcgcgtggatgcgagcgaggactccatggagagctccgaagagatggtgacccccagggccgccgcgtcggagccggacgaggaggagaggaaggcccccgcggccg

SEQ ID NO: 2165 - protein, 132 aa, Zea mays
  misc_feature: Ceres CLONE 264300-F
  misc_feature (10)..(10): Xaa is any aa, unknown, or other
KIQTNRLAIXPVPSPSHRSPLAPLPVRAARSRIEIPLRHAEGAKKRAKLKKQQQQGHPDDGGNTNASSGNGNGSDNNNNASSGRDGDPHLCILPKVSRVDASEDSMESSEEMVTPRAAASEPDEEERKAPAA

SEQ ID NO: 2166 - DNA, 393 bp, Zea mays
  misc_feature: Ceres CLONE 264331-F
  misc_feature: Encodes the peptide sequence at SEQ ID NO. 2167
  misc_feature (74)..(74): n is a, c, t, g, unknown, or other
  misc_feature (192)..(192): n is a, c, t, g, unknown, or other
  misc_feature (199)..(199): n is a, c, t, g, unknown, or other
  misc_feature (289)..(289): n is a, c, t, g, unknown, or other
ctctctccgtatctcgcttcgccacmgccggcgagagctagggtttcgtgcgccaccgtcacttccgcccgccntggccgagacctccacgtatcagattctggtgcgtctcctcgacgggcgtaccagatgtctccgcttctccacgcccaccgtttccggcgccgtgctcctcgacgccgtcgcgtsatnctctcgngttcccgccgccgctctccgcctcgtcaccggcggcatcgacgtatcgccctcttccgtcctcgcctcagcagctgatggccagttcccnyatgcgtcasctcctccgccttcgaggaggcaagggtggattcggctccctcctcagaggggctgcctccaaagcgggtcagaagaagaccagcaactttgacg

SEQ ID NO: 2167 - protein, 129 aa, Zea mays
  misc_feature: Ceres CLONE 264331-F
  misc_feature (9)..(9): Xaa is any aa, unknown, or other
  misc_feature (25)..(25): Xaa is any aa, unknown, or other
  misc_feature (63)..(63): Xaa is any aa, unknown, or other
  misc_feature (64)..(64): Xaa is any aa, unknown, or other
  misc_feature (97)..(97): Xaa is any aa, unknown, or other
  misc_feature (100)..(100): Xaa is any aa, unknown, or other
SLRISLRHXRRELGFRAPPSLPPAXAETSTYQILVRLLDGRTRCLRFSTPTVSGAVLLDAVAXXSRVPAAALRLVTGGIDVSPSSVLASAADGQFPXASXPPPSRRQGWIRLPPQRGCLQSGSEEDQQL

SEQ ID NO: 2168 - DNA, 614 bp, Zea mays
  misc_feature: Ceres CLONE 264391-R
atgctttaatgttgcatttccagcaatatacccattacagatacatttaaatgataaaagatattacgacaagcatctgaagatgaaatatacccatgacatatacaataatatgtattcttcaccttatattataatataatgtcctccagaaactgatccggctagctgacatcgcagcaagaagttgcatcgcctttaatttgggtccttcagaaactactctgtcgcagacatttgcatgataaaactcttgccaaagtgccacaccatgcttcaattcttgagcacaggacagaagcatattgtaccatgcaccgacataagcaccctgttcctctttggatgctagtttcaatagatctagggtggaaacactgagcttgtaaagttcaactgcaatatctgtgtcctccattgccttctcatctagttcatggatgaaactttatgtagggctgagtactcttccaaaaggtagagggaattctatacctccccacctgcacaattgataagagtaaatccaacaatgacaacaagaaatggtatccctgggaaatctgattcacttcttgaagtttttgaaggctgttgtgccatctagctctcct

SEQ ID NO: 2169 - DNA, 308 bp, Zea mays
  misc_feature: Ceres CLONE 264393-F
  misc_feature (275)..(275): n is a, c, t, g, unknown, or other
accgatccgccaccacgccacgaaatcatctcctactccagcagttccgctcctcgcgccgccaccgccaccgccacgatgccggaagacgtgcagatgaacgactcggagccccagtctgcggccccagctcccgccgccgccgcgscgggscttctccacactacaccatctgaaggagatcgcgtccgtgatcgaggctggttctctgtccaaggaggtcctccggatctcccgcgccttccgcctcaccgttcgcgyttccgccgcccttnccgcacgggacktctccgccttcctcgccttcg

SEQ ID NO: 2170 - DNA, 147 bp, Zea mays
  misc_feature: Ceres CLONE 264395-F
gacacacgccgctgctccaagaaaccaccgccgagcccaaccgcacaagcgcgcgaggyaggagakakagagagaggcggggagcaaaacaatggaggggaaagaggaggacgtgcgcctgggcscaaacaagttctcggagcgcca

SEQ ID NO: 2171 - DNA, 456 bp, Zea mays
  misc_feature: Ceres CLONE 264399-F
  misc_feature: Encodes the peptide sequence at SEQ ID NO. 2172
accctagadgcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgcatcaccgccgagaagatcgccaccatcgtgaaggcggagaccgaggtcgtcgccgctaaggagccggtgtcggccgaggtcgagactgagtccaaggaggtcgaggtcgaggccgaggcgtagctgaggctgagccgaccgaggcagagccaaggaagcagagcccgaggccgccgcgccgcagcagagacggaggctgctgctgccccggtcgaggctgctgagccgagatagccgccgagaccaaggaggcggcggctktggaggctaacgaggaggagggggaggcatckct

SEQ ID NO: 2172 - protein, 30 aa, Zea mays
  misc_feature: Ceres CLONE 264399-F
MASGELACTYAALILSDDGIASPPRRSPPS

SEQ ID NO: 2173 - DNA, 160 bp, Zea mays
  misc_feature: Ceres CLONE 264433-F
aactggtaccgtgccgtgccgtctcctctcctctctcctctctcatccccaggtctcagcccacctagcaatgttctcctcctccccttccacatgaccagcgccgcgccgcgcagcagccatccttgttctgtcccgggtacgccgccacacacatcgc

SEQ ID NO: 2174 - DNA, 487 bp, Zea mays
  misc_feature: Ceres CLONE 264478-F
  misc_feature: Encodes the peptide sequence at SEQ ID NO. 2175
accccactcttggtgctcttgcttgaatatagtccccctcctctctctctcacacacctgttcttcgatctcggcctagctagctagctagcgagcaagctatagcttagctcggctagccgggtgtgtcgccggtcggctaggcaacgcgctagcgatcgcaaaatggcagatgcgggggaggggcggcgggtgtgcggcatgccggagaaggcgcmstgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgsgtcatcacggcgaaccaagggttttactcctgggcctggacaacacgtcg

SEQ ID NO: 2175 - protein, 85 aa, Zea mays
  misc_feature: Ceres CLONE 264478-F
  misc_feature (69)..(69): Xaa is any aa, unknown, or other
MLALQFGYAGFHVVSRLALNMGISKLVFPVYRNIIALCLLVPFAYFLEKKDRPQLTLNFVVQFFFLALXVITANQGFYSWAWTTR

SEQ ID NO: 2176 - DNA, 96 bp, Zea mays
  misc_feature: Ceres CLONE 264486-F
aycctctctgatcgaccacccttcccccggctctacctcctccgcgccggcccgtttgatggccggcgggaagaggacgacggcgcgccaccaacg

SEQ ID NO: 2177 - DNA, 272 bp, Zea mays
  misc_feature: Ceres CLONE 264538-F
  misc_feature (109)..(109): n is a, c, t, g, unknown, or other
acaacaccagaatccgcgaatcacagacgcgtctatctcagcttgctgcactgcactaccctgccctgccatcatatcgtacgtgagcccggccgagcgagasmgggangaggcatggctgctccgaagctcgcgacgctggcgctggccgtgctcctggcggcgaccgtggtggctcccccggccgcggtgcgcgcggattgtcgtgctccaccgtgtacagcacgctgatgccgtgcctgccgttcgtccagatgggcggggccatgcgc

SEQ ID NO: 2178 - DNA, 508 bp, Zea mays
  misc_feature: Ceres CLONE 264560-F
  misc_feature: Translation starting site: 207
  misc_feature: SWISSPROT Homolog: EC 2.3.1.74 Naringenin-chalcone synthase
  misc_feature: SWISSPROT Homolog: EC 2.3.1.156 Phloroisovalerophenone synthase
  misc_feature (201)..(201): n is a, c, t, g, unknown, or other
  misc_feature (202)..(202): n is a, c, t, g, unknown, or other
atcttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcg

SEQ ID NO: 2179 - DNA, 372 bp, Zea mays
  misc_feature: Ceres CLONE 264564-F
  misc_feature: Encodes the peptide sequence at SEQ ID NO. 2180
  misc_feature (198)..(198): n is a, c, t, g, unknown, or other
  misc_feature (233)..(233): n is a, c, t, g, unknown, or other
  misc_feature (248)..(248): n is a, c, t, g, unknown, or other
  misc_feature (272)..(272): n is a, c, t, g, unknown, or other
  misc_feature (301)..(301): n is a, c, t, g, unknown, or other
  misc_feature (353)..(353): n is a, c, t, g, unknown, or other
accgctaccgccgccgcgtctaaacsctccaccgccgcggtgcgtcagaggcagaggcagagaggcagaggcagaggcagccatggggagccgcctcgggcccgcgtgatccactttgccaacctcccgctgaaggtcatgctgccccccgcgccgctctcctccgtgcaggagttcgccgtgcggaccgtccmctcngcttccaattggacatccggcgctgcctcgagtcnatgtacggtttttcngtcgccgaggtccgcacgcttaanatggagggcaagawgctccgccggggccnctttctctccgctaagcccgactacaagaaggcctacgtcacgctccgsccncgcttgckttctcgcgcga

SEQ ID NO: 2180 - protein, 46 aa, Zea mays
  misc_feature: Ceres CLONE 264564-F
  misc_feature (13)..(13): Xaa is any aa, unknown, or other
  misc_feature (18)..(18): Xaa is any aa, unknown, or other
  misc_feature (23)..(23): Xaa is any aa, unknown, or other
  misc_feature (43)..(43): Xaa is any aa, unknown, or other
MYGFSVAEVRTLXMEGKXLRRGXFLSAKPDYKKAYVTLRPRLXSRA

SEQ ID NO: 2181 - DNA, 231 bp, Zea mays
  misc_feature: Ceres CLONE 264572-F
  misc_feature (66)..(66): n is a, c, t, g, unknown, or other
  misc_feature (115)..(115): n is a, c, t, g, unknown, or other
aacacacacggaasgaatccgggcatccggaaagcagccctaatctcaaggccgcggctgcgagcnctgcttcccacctcccaactccggaactcctccccagtcgccgccagcngcgcgcacacccaccgagagctcgggctttctttctccgttcctccctcgcgcgctcagggtttcacgatggaggccgaggcggcggcaagagggcgcgggagggcggggaggacg

SEQ ID NO: 2182 - DNA, 461 bp, Zea mays
  misc_feature: Ceres CLONE 264581-F
  misc_feature: Translation starting site: 105
  misc_feature: SWISSPROT Homolog: EC 2.7.7.6 DNA-directed RNA polymerase
  misc_feature (240)..(240): n is a, c, t, g, unknown, or other
  misc_feature (272)..(272): n is a, c, t, g, unknown, or other
  misc_feature (273)..(273): n is a, c, t, g, unknown, or other
  misc_feature (371)..(371): n is a, c, t, g, unknown, or other
  misc_feature (403)..(403): n is a, c, t, g, unknown, or other
gtgaccccgtttcctccagtttcctaccttcctctcgtcccagcagccgcaagcyaaaaccctagcaagcaaaccaccggagcagcggcgctcgckgggcggasatggcgtacgacgattacaacgaaatcgacatgggctatgaggatgagcctccagaacctgagattgaggaaggggccgaagaagagcttgagaacaacgaagatgcccctgatgatgtcataggtggagagggtnaagataaggaacaggaaaagaccaagcgtgannataaayaacaaaatatatgacgaatattgaacgtgcgcgcattcttggtacacgagccttgcagataagcatgaatgctccagtcatggttgagcttnagggataaactgaccctcttgagattgcgatnaaggagcttagagcgcgcaagatacccttcacgatcagacggtacctacctgatggaa

SEQ ID NO: 2183 - DNA, 394 bp, Zea mays
  misc_feature: Ceres CLONE 264587-F
  misc_feature (198)..(198): n is a, c, t, g, unknown, or other
  misc_feature (310)..(310): n is a, c, t, g, unknown, or other
  misc_feature (331)..(331): n is a, c, t, g, unknown, or other
aaccttgcttcgccacacggcaccaaaagcacggccgcgctctcatccccctccacacgtttccgcctcccgatccatagccgccgtgagccgccgccgacatagctcctccctctcgcagctctccagctctcggaggcccgcggctcatcaacccgcgcttcttcattctcgacatctcacccggcggcgcggacnagtgcacatcacgagccgcacggacagcsctcttgttttccttcgtgggttgcggttcgacgcggccacbkgatggcggcgagcgctcgggacagcgctgatgcggcggasnagtcgtggatgaccacgagtnctgggcgtcggacggcgatatgggcatggagatggatgtggaaggcgagttccacgaccgcga

SEQ ID NO: 2184 - DNA, 415 bp, Zea mays
  misc_feature: Ceres CLONE 264602-F
  misc_feature: Encodes the peptide sequence at SEQ ID NO. 2185
  misc_feature (377)..(377): n is a, c, t, g, unknown, or other
atggccttcgccgcctccccttccctctccgcactcgcttcctcctcgtcgtccaccgccgccgcccccacgccttcttccaaccctttgcacgagccgaggcttctccacctctcgctcaagcccgtcttacccctccccaagccgcatgckctctcctgctccgcgccgcacatcccccgcgccgccgctggggacggatcgggcgtcgggaatggaggcaaggatggaggcggcggcgggggtggcgaggatgaagacgactgcgacgatgcggacttcggcccgctgctcggcttccacgaggtgctgcacctcgccgcggcgcgcgstttggcgctcccgggcgacatgctggaggcggccaaggacgcggncatccgggaagtcctcttgctccgctacttcgatctgc

SEQ ID NO: 2185 - protein, 138 aa, Zea mays
  misc_feature: Ceres CLONE 264602-F
  misc_feature (111)..(111): Xaa is any aa, unknown, or other
  misc_feature (126)..(126): Xaa is any aa, unknown, or other
MAFAASPSLSALASSSSSTAAAPTPSSNPLHEPRLLHLSLKPVLPLPKPHALSCSAPHIPRAAAGDGSGVGNGGKDGGGGGGGEDEDDCDDADFGPLLGFHEVLHLAAARXLALPGDMLEAAKDAXIREVLLLRYFDL

SEQ ID NO: 2186 - DNA, 472 bp, Zea mays
  misc_feature: Ceres CLONE 264620-F
  misc_feature: Encodes the peptide sequence at SEQ ID NO. 2187
  misc_feature (51)..(51): n is a, c, t, g, unknown, or other
  misc_feature (135)..(135): n is a, c, t, g, unknown, or other
  misc_feature (303)..(303): n is a, c, t, g, unknown, or other
ctcgccgcccccgtctcctctcctctcctctcccccgcatccacggccgsnrgccagccactcgacgatctagtcgtctctytctccccgctctgccgccttcgctgccgcggctttcccgtcggctggaggatnaaggtcacggtcktttcccggagcggccgggagktcttcaagggcggcatcgacctcaaggactcggccaaggtcgcggacctgcaggaggccatccatgccaggactaagaagtattatccttctaggcagcggctcaccctcccccttcaacctggaaaaggcggnaaccatttgtcctcagtccgaagccagcytgctagaatactgcgagaagggttctgggtcactgacagtggtcttcaaagatttagggccacaggtctactacagcacactgttcttcttcgagtacctgggtcctctcatcatctaccccattttcwactatctgcct

SEQ ID NO: 2187 - protein, 80 aa, Zea mays
  misc_feature: Ceres CLONE 264620-F
  misc_feature: SWISSPROT Homolog: EC 1.3.1.38 Trans-2-enoyl-CoA reductase (NADPH)
  misc_feature (24)..(24): Xaa is any aa, unknown, or other
  misc_feature (77)..(77): Xaa is any aa, unknown, or other
MPGLRSIILLGSGSPSPFNLEKAXTICPQSEASLLEYCEKGSGSLTVVFKDLGPQVYYSTLFFFEYLGPLIIYPIFXYLP

SEQ ID NO: 2188 - DNA, 308 bp, Zea mays
  misc_feature: Ceres CLONE 264710-F
  misc_feature: Encodes the peptide sequence at SEQ ID NO. 2189
  misc_feature (138)..(138): n is a, c, t, g, unknown, or other
  misc_feature (229)..(229): n is a, c, t, g, unknown, or other
  misc_feature (233)..(233): n is a, c, t, g, unknown, or other
actcatacatttcgactctcaactcccaaggtcccttttttttctcgatctggaagckccgcagtagcagccatggacgtgagcggacaggcggtaaggcgaagaagggcgcggcggggcgcaaggccggcgggcgancgaagaagtcggtatcgcggtcctccagggccgggctgcagttccccgtcagccgcgtcgggcgtacctcaaaaagggccggtacgcgcanttanggcacgggtgccccgtctacctcgccgccgtcctggagtacctcgcggccgaggtgctcgagctcgccggcaacg

SEQ ID NO: 2189 - protein, 102 aa, Zea mays
  misc_feature: Ceres CLONE 264710-F
  misc_feature (19)..(19): Xaa is any aa, unknown, or other
  misc_feature (46)..(46): Xaa is any aa, unknown, or other
  misc_feature (76)..(76): Xaa is any aa, unknown, or other
  misc_feature (77)..(77): Xaa is any aa, unknown, or other
SYISTLNSQGPFFFSIWKXRSSSHGRERTGGKAKKGAAGRKAGGRXKKSVSRSSRAGLQFPVSRVGRTSKRAGTRXXGTGAPSTSPPSWSTSRPRCSSSPAT

SEQ ID NO: 2190 - DNA, 136 bp, Zea mays
  misc_feature: Ceres CLONE 264712-F
acacgcacaccgcgacccagtccagagccagtacgtgcgamggccacgcacgctgctggtccgcgtacsagacgacggtcaggtcggccggtgcttttcagtttggaataatgacggcgacgacgacgacagccgc

SEQ ID NO: 2191 - DNA, 475 bp, Zea mays
  misc_feature: Ceres CLONE 264736-F
  misc_feature: Encodes the peptide sequence at SEQ ID NO. 2192
  misc_feature (318)..(318): n is a, c, t, g, unknown, or other
  misc_feature (367)..(367): n is a, c, t, g, unknown, or other
acaataaccgttccactttggtccataggagcgcatagcacagcacaaggagaggccgagaagcgctttagccgtagccgtagcgataagagtgagctagctggtgcacaccggcatggcggccacggcgtactccgtggcgctcctcggcggcgcgcgctccccgccgctccgsgctccgcyctcctccctcggcgcasgtctgcyagcttcgcttccaagatgcaccgaggctctccctgctccgtgcgaaggccgcttccgaggacacatcggcctccggcggacgagttgatcgaggacctcaaagcgaagtgngacgccgttgaggacaagcccaccgtcctcttgtacggcggcggcgctncgttcgccctatggctgacgtccgtggtcgtgggcgccatcaacgcccgtgccgctgctccccaagatccctggagctcgttggggctcggctacaccggctggttcg

SEQ ID NO: 2192 - protein, 158 aa, Zea mays
  misc_feature: Ceres CLONE 264736-F
  misc_feature (59)..(59): Xaa is any aa, unknown, or other
  misc_feature (67)..(67): Xaa is any aa, unknown, or other
  misc_feature (106)..(106): Xaa is any aa, unknown, or other
  misc_feature (123)..(123): Xaa is any aa, unknown, or other
TITVPLWSIGAHSTAQGEAEKRFSRSRSDKSELAGAHRHGGHGVLRGAPRRRALPAAPXSALLPRRXSASFASKMHRGSPCSVRRPLPRTHRPPADELIEDLKAKXDAVEDKPTVLLYGGGAXFALWLTSVVVGAINARAAAPQDPWSSLGLGYTGWF

SEQ ID NO: 2193 - DNA, 135 bp, Zea mays
  misc_feature: Ceres CLONE 264772-F
acgcacaccgcgacccagtccagagccagtacgtgcgamgtcacgcacgctgctggtccgcgtacsagacgacggtcaggtcggccggtgcttttcattttggaataatgacggcgacgacgacgacagccgccg

SEQ ID NO: 2194 - DNA, 450 bp, Zea mays
  misc_feature: Ceres CLONE 264800-F
  misc_feature (127)..(127): n is a, c, t, g, unknown, or other
  misc_feature (242)..(242): n is a, c, t, g, unknown, or other
  misc_feature (314)..(314): n is a, c, t, g, unknown, or other
  misc_feature (341)..(341): n is a, c, t, g, unknown, or other
atcacaattcactccactcatcttttctcgtttagaacctctaaaatttcccccactcgccagtcgcagcagcacctgtagcagtcatggacgccagcggascggtagcaaggggaagaagggggcngccggkcgcaaggyaggckgccccagawagawgtcggtgaygcggtccgtcaaggccgggctgcagtttccccgtyggccggatcgggcgctacctcaagawgggccggtacgcncvcgtgggcactggcgcccccgtctacctcgccgccgtcctggagtacctcgccgccgaggttctggagttngcagggaacgcggcgaaagacaacaanaagacgcgcatcatcccgcgccacgtgctcctggcgatccgcaacgacgaggagctcgggaagctgctggccggcgtcaccatcgcgcacggsgcgtcctccccaacat

SEQ ID NO: 2195 - DNA, 348 bp, Zea mays
  misc_feature: Ceres CLONE 264903-F
accaagaacaaaccattgttggacgcgttcccctcctgcacgcaacctcatctcgtcctccagatccaggatggccgtcctccttgagaccttgcctccccgagtgctctcgtgagctactttgtttcgatttatcaggaaatccgtttgcttcatgttgtgcaggctcatatctgattgctggattcggcaaacccgcgttggatcctgtatcggttagtccttgcctgcaagttcttgttgttttgttttggtggtcgakcatcgcatgttctgcttctggatccagatctggagaaatcgcgaagtcgtcgtcgttcggttcggagcggatccagaagcagaaca

SEQ ID NO: 2196 - DNA, 437 bp, Zea mays
  misc_feature: Ceres CLONE 264910-F
  misc_feature: Encodes the peptide sequence at SEQ ID NO. 2197
  misc_feature (195)..(195): n is a, c, t, g, unknown, or other
  misc_feature (196)..(196): n is a, c, t, g, unknown, or other
  misc_feature (413)..(413): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcycgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggagygggctgccgacgatgaatcagcgtctggacatctcgaacgcggcggtgacnagatggcgacggaggcgtccctgt

SEQ ID NO: 2197 - protein, 38 aa, Zea mays; identical to SEQ ID NO: 1913
  misc_feature: Ceres CLONE 264910-F

SEQ ID NO: 2198 - DNA, 317 bp, Zea mays
  misc_feature: Ceres CLONE 264944-F
  misc_feature: Encodes the peptide sequence at SEQ ID NO. 2199
  misc_feature (18)..(18): n is a, c, t, g, unknown, or other
  misc_feature (19)..(19): n is a, c, t, g, unknown, or other
ctcacabaaccaagctcnntcgatctcactctcagctggtcgctcactcttgcagctccacccttaatcactcagtcttagggtctdagctctaggctctagctagccgcgccactccttcgtgtagccatcagccttctcatcgybaccaatggccactgccgaggtccagaccccgaccgtcgtggcggccgaggaagcgcccgtggtggagaccccgccgccggccgtcgtgcccgaggagtctgcccccgccgaggccgaggctgaggctgaggctgaggctgctgctcctgctgctcccgaggacttccggc

SEQ ID NO: 2199 - protein, 55 aa, Zea mays
  misc_feature: Ceres CLONE 264944-F
MATAEVQTPTVVAAEEAPVVETPPPAVVPEESAPAEAEAEAEAEAAAPAAPEDFR

SEQ ID NO: 2200 - DNA, 415 bp, Zea mays
  misc_feature: Ceres CLONE 264958-F
  misc_feature: Encodes the peptide sequence at SEQ ID NO. 2201
  misc_feature (262)..(262): n is a, c, t, g, unknown, or other
  misc_feature (367)..(367): n is a, c, t, g, unknown, or other
aattcggcctatcacaaccacttactctcgtgcgctctccgtgggagcgaggactcgcgtccggcggcasggcaggtttctcctagatctccggcatcatcagtaacaaatggctgacggtgaggacattcagccccttgtttgtgacaatggaactggcatggtcaaggctggttttgctggtgacgatgcgccaagggctgttttcccaagcattgtcggacgcccccgtcacactggtgtgatggttggcatggggcanaaggatgcgtatgttggtgacgaggcccagtccaagaggggtatcctgactttgaagtaccccatcgaacatggtattggttagcaattggggattgacatgganaagatctggcaccacacctttctataatgaactccgtgtggcgcctga

SEQ ID NO: 2201 - protein, 78 aa, Zea mays
  misc_feature: Ceres CLONE 264958-F
  misc_feature: SWISSPROT Homolog: EC 2.7.10.2 Non-specific protein-tyrosine kinase
  misc_feature (51)..(51): Xaa is any aa, unknown, or other
MADGEDIQPLVCDNGTGMVKAGFAGDDAPRAVFPSIVGRPRHTGVMVGMGXKDAYVGDEAQSKRGILTLKYPIEHGIG

SEQ ID NO: 2202 - DNA, 381 bp, Zea mays
  misc_feature: Ceres CLONE 265022-F
  misc_feature: Pfam Name: Aa_trans Pfam Description: Transmembrane amino acid transporter protein
  misc_feature (293)..(293): n is a, c, t, g, unknown, or other
  misc_feature (340)..(340): n is a, c, t, g, unknown, or other
acatcacaagakagccaagggctagccgatcaacaacaccacactagcctctcctatcctagctagctagcttccaccggccgggagaaaaaaaaatggtggcgagcaaggccgccccgttcgacgaggtgtcctcggtggaggcgggggcctacgggggccgcgacgacgacgggcggccgcgcggacgggcacggtgtggacggccagcgcccacattatcacggccgtcatcggctccggggtgctctcgctggcgtgggccatcgcgcactgggctgggccgcgggccnccgtcatgctgctcttcgccgtcgtcatctactayacctccacgcwnctcgccgagtgctaccgctccggcgacccagtggcggggaa

SEQ ID NO: 2203 - DNA, 456 bp, Zea mays
  misc_feature: Ceres CLONE 265034-F
  misc_feature: Encodes the peptide sequence at SEQ ID NO. 2204
  misc_feature (456)..(456): n is a, c, t, g, unknown, or other
atcgcctccaccgttctctcttcctctgctcttctctgcctgccttgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctkaaccccaaggctaacagggan

SEQ ID NO: 2204 - protein, 73 aa, Zea mays
  misc_feature: Ceres CLONE 265034-F
  misc_feature: SWISSPROT Homolog: EC 2.7.10.2 Non-specific protein-tyrosine kinase
MVGMGQKDAYVGDEAQSKRGILTLKYPIEHGIVSNWDDMEKIWHHTFYNELRVAPEEHPVLLTEAPLNPKANR

SEQ ID NO: 2205 - DNA, 434 bp, Zea mays
  misc_feature: Ceres CLONE 265036-F
  misc_feature: Translation starting site: 162
  misc_feature: Pfam Name: RALF Pfam Description: Rapid ALkalinization Factor (RALF)
  misc_feature (251)..(251): n is a, c, t, g, unknown, or other
actaaaactcggatagatctcagtgcagtgcttccctgttccttccatcaagaaamaagaaaagatccagtgcrgagagagagagagagagaaagccccatggcactctgaacaagaaaagaaaagagagagatctcagtcagccagtctctcacaacacaatgccggcaaccaccaagccgttcttgctcccaagggcgtgggcagcagcgccactcctcctcctcctgctgctcgtcctgcacgggarnggaggccactgcgtcggcatggaggcggcggactgggagatggactcggaggcgcaccggcggctgctgtgggaggcgaccacggggcggaggtacatcagctacgacgcccttgcggggcaacgttggtgccgtgctccaggaccggggtgccctactacaactgccggatctcgaccaccg

SEQ ID NO: 2206 - DNA, 406 bp, Zea mays
  misc_feature: Ceres CLONE 265041-F
  misc_feature: Encodes the peptide sequence at SEQ ID NO. 2207
akacgcaatacacatacagcccctcttgcccacaccacctcgctgaaccggaagacccgcacacacacgccacttgtagaccatggcgccccgggtggcggacaagtcgcctctaccgccggcyaccggcttggggctgggcgttggcggaggagtcggaggcgtgggcatgggccgcactacagaggcgtgaggaagcgtccatggggastacgccgccgagatccgcgaccctgccaagaaaagccgtgtgtggctcggcacgtacgacacggccgaggaggsccaaggsgttacgattccgccgcccgcgagttccgaggcggccaaggccaagacgaacttcccggttcccctcccagtgctccgtcgcctccggtgcttgccggtagcgccagtagcaaca

SEQ ID NO: 2207 - protein, 36 aa, Zea mays
  misc_feature: Ceres CLONE 265041-F
MAPRVADKSPLPPATGLGLGVGGGVGGVGMGRTTEA

SEQ ID NO: 2208 - DNA, 157 bp, Zea mays
  misc_feature: Ceres CLONE 265046-F
aacaactcacaattcacatcgaggtctcagcttcaggaaagggaaggaagcatgttcggggcamcaccaccaccacggccacggcgggcaccaccaggcccccgcaccgcacgagcagacgctgttcaggatcttctgccgcgccgacgagstactg

SEQ ID NO: 2209 - DNA, 411 bp, Zea mays
  misc_feature: Ceres CLONE 265049-F
  misc_feature: Encodes the peptide sequence at SEQ ID NO. 2210
  misc_feature (259)..(259): n is a, c, t, g, unknown, or other
  misc_feature (266)..(266): n is a, c, t, g, unknown, or other
acctacttccaccatttcggcaaccccgcagaaaaaaaaaagggcgaaacgaggccaccagctcaccgccgagcgaasbtcgccgagcaaccaacccctctcctcgtccgccgccgtytccccggaccatgtcatggccgcttcctcccggctgctctgggcgtcccgcgcgccgcctacctcaagatctccaccttccccaagggccttctccaccgtgctgaaggatctgaagtatgctgacactcatgaatgggtnaaagttnagggtgattcagcaaccgtggggattactgaccatgcccaggatcatttgggtgatgtbgtttttgtgggagctaccagaagttggcatcagtgtatcccagggaaagaactttggtgctgttgagagtgttaaggcaaccagcg

SEQ ID NO: 2210 - protein, 85 aa, Zea mays
  misc_feature: Ceres CLONE 265049-F
  misc_feature (45)..(45): Xaa is any aa, unknown, or other
MAASSRLLWASRAPPTSRSPPSPRAFSTVLKDLKYADTHEWVKVXGDSATVGITDHAQDHLGDVVFVGATRSWHQCIPGKELWCC

SEQ ID NO: 2211 - DNA, 715 bp, Zea mays
  misc_feature: Ceres CLONE 265054-R
  misc_feature: Translation starting site: 263
  misc_feature (637)..(637): n is a, c, t, g, unknown, or other
accgggccccccctcgaggtcgacggtatcgataagcttttttttttttttttttcatggaagtactcagcatcatccaactctagttctattgtaaacaaaacccacaaaattcagtaaagcaatacccccacaaacataaggtttgttgtcccctgaacatagtagcacaaacagctggaatggaaggactaatgtgcttgatatttgatgttgaatatcaaatttgtgaacacatttagttggtctgcatcgcatcagcatgatacttctccaagtcagcgtcgagttcttcagccgactttggcttgctgcgctccttgccacgacgaccacccccagatccaccactacgcctcccaggcgggtgatgaggtcttcgctgcggcacacctgctggggcagcacccctcggtgcactcctcacagcattcctagcatggccaccattggagactggaagagcagcagatgcagttggagtattggtccccaatatctctatcttcatgggctttaaatcaagttggaaattggttatttttctttccccccccccttcagagattaaaaaaggccttgggaaattaaaaaattcagcttgtgtccccttaaaacctccccacttttcgatcanattatttaaccgaaaaaaaagaccttctcaaattaaaccctgggcgttaaaagaaaacaaatctccctttgaaataat

SEQ ID NO: 2212 - DNA, 154 bp, Zea mays
  misc_feature: Ceres CLONE 265091-F
  misc_feature (96)..(96): n is a, c, t, g, unknown, or other
aactaaaaaaaaaatggaggcatgagctccgcctcctcctcgtctctcgccgatctccccaaaccctagccccgacctgaccgccggcgggcccgncgggagaaggaktcgctcccacccacccaacttctgcggcggaaggggatcgggcggc

SEQ ID NO: 2213 - DNA, 1073 bp, Zea mays
  misc_feature: Ceres CLONE 265096
  misc_feature: Encodes the peptide sequence at SEQ ID NO. 2214
accgacgggtgacacctgctgtgtccaccaaccgtgagccagaaggcgaccgacgacgccagcttagactaggaaccaacaatggcctcgcgccacctgctcctcctcctgctcgccgcgctgctcccggcggcggccacggcggacccggacgcggtgcaggactactgcgtgccggacacgggcggcgggcgcgggcgggccgtggatctagcgctgctcccgtcctacccgtgcaggagccccgccaacctgacggcggcggacttcgccttcgcgggcgtgcgcgccgcgggcaacttctccgcggacacggggttcgcgggggtgtccgtgacccccgcgcagttcccggcgctgcacaccctcggcgtgtccttcgcgcgcgccgacctgtccgcggcgggcggggtcaacccgccgcactaccacccgcgcgccaccgagacggcgctggtcctggccggccgcgtctacgcgggattcgtcgactcgggcggccgcgtcttcgccaaggtgctcgagaaaggggaggtcatggtgttcccgcgcgccatggtgcacttccagatgaacgtcggcgacgagccggccaccgtgtacggcaccttcaacagcgagaaccccggcatcgtgcgcatcccggcgaccgtgttcgggtccgggatcaaggacgccgtcctcgagagggcgttcggcctcgagccggaggagctccgccggctccagaagaggttcgggcctcctcccaagaccaagacggcggagatggacgattgatcggaagatcaggcactcgcgatcaagggggacatgattaattgattagttatattaagagcagcagactttgtgatctctggaatatatctccttccatttgttaatgtctgtatgaattatttggcggtggacggtggttatcatggaccgataatgccggtacgtacagatgggatgggcatgtggggttaggtgtcacattcaagtgtctacgagatgtttatgggtttatatatattgttaataaagcaggccgactttatttgctctggacaaaaaaaaaaaaaaaa

SEQ ID NO: 2214 - protein, 232 aa, Zea mays
  misc_feature: Ceres CLONE 265096
  misc_feature (66)..(213): Pfam Name: Cupin_1 Pfam Description: Cupin
  misc_feature: SWISSPROT Homolog: EC 1.2.3.4 Oxalate oxidase
MASRHLLLLLLAALLPAAATADPDAVQDYCVPDTGGGRGRAVDLALLPSYPCRSPANLTAADFAFAGVRAAGNFSADTGFAGVSVTPAQFPALHTLGVSFARADLSAAGGVNPPHYHPRATETALVLAGRVYAGFVDSGGRVFAKVLEKGEVMVFPRAMVHFQMNVGDEPATVYGTFNSENPGIVRIPATVFGSGIKDAVLERAFGLEPEELRRLQKRFGPPPKTKTAEMDD

SEQ ID NO: 2215 - DNA, 219 bp, Zea mays
  misc_feature: Ceres CLONE 265104-F
  misc_feature: Encodes the peptide sequence at SEQ ID NO. 2216
  misc_feature (136)..(136): n is a, c, t, g, unknown, or other
  misc_feature (174)..(174): n is a, c, t, g, unknown, or other
atacatttcgactctcaactcccaaggtccctttttttttctcgatctggaagcgccgcagtagcagccatggacgtgagcggacagggcggtaaggcgaagaagggcgcggcggggcgcaakgycggcgggcgancgaagaagtcggtgtcgcggtcctccacggccgggctncagttccccgtcagccgcgtcgggcgtgacctcaaaaagggccgg

SEQ ID NO: 2216 - protein, 50 aa, Zea mays
  misc_feature: Ceres CLONE 265104-F
  misc_feature (18)..(18): Xaa is any aa, unknown, or other
  misc_feature (19)..(19): Xaa is any aa, unknown, or other
  misc_feature (23)..(23): Xaa is any aa, unknown, or other
MDVSGQGGKAKKGAAGRXXGGRXKKSVSRSSTAGLQFPVSRVGRDLKKGR

SEQ ID NO: 2217 - DNA, 226 bp, Zea mays
  misc_feature: Ceres CLONE 265173-F
  misc_feature (82)..(82): n is a, c, t, g, unknown, or other
  misc_feature (83)..(83): n is a, c, t, g, unknown, or other
  misc_feature (100)..(100): n is a, c, t, g, unknown, or other
gaacacgcgatcccattcccattctcttgctcaatacaacctccggcttcagcaagccgcagcgccaagcctagaagcggannggaacacatgaggccangaagaggaggtgctgccgtccccgcgccgccgctgtgggagtgcggggaatggggcggcacggcgtggaccagatcggcgctgtggcagcgttcgtctgggtcaccctccttcccttgctgcttgt

SEQ ID NO: 2218 - DNA, 637 bp, Zea mays
  misc_feature: Ceres CLONE 265189-R
  misc_feature (1)..(1): n is a, c, t, g, unknown, or other
ncgattgggtaccgggccccccctcgaggtcgacggtatcgatattttttttttttttttttcagcaactgcgaagtgtttataactcatagcagatacaacaagagcacaagattcatgtcgttggccctgatggccacatacattcactccaccagaaaagttgcgtagagcccaaagaactgcttattctagaacaagtcatgactatcatcatagcaactaatctctctaccaacgtagctgtgaactagtctatttcctccatctgcacagaggcactgcaatgtgcaatctcaaatacctgaacatggcaacaaaaatatgaaacaaaaaagaaggcgtgatgtctagatgatcatctatcattcactccatcacagcaacaccgccagctgcctttatctttgctatgatcgcttccgcttcctcctttgtgagcgattgcttcagaacgactggggccttctccaccagctccttggcctccttcagccccagatccgtaaacgtcctgatctccttgatgatcttgatcttcgcagcagcgtcgaacttctccaacctgacgtcgaagactgtcttctcggctttcttctcagcctttccagaacctgccccagagccgacctgggca

SEQ ID NO: 2219 - DNA, 242 bp, Zea mays
  misc_feature: Ceres CLONE 265218-F
  misc_feature (114)..(114): n is a, c, t, g, unknown, or other
aaccagctgcggagggaggaaccctagcggaacactgtgcaggtgacggcggcgcgctaccggtgacggggatacggcggcatcgtcccctcctccatccccggcgcggcggcnagcagcggccctgcagggacgtctccagtctccagaatccagattcagagcttgtccctgttttctggtgtgctctgttgtactgtagcctgtagccagggcaaattaaagctacaatgcaggcttct

SEQ ID NO: 2220 - DNA, 393 bp, Zea mays
  misc_feature: Ceres CLONE 265250-F
  misc_feature: Translation starting site: 71
  misc_feature (226)..(226): n is a, c, t, g, unknown, or other
atccgtgcatacatgctcattgctcaccaagggcaagggaggaggagaggacacacagcagtagcgcgaaatggcggcgatgatgatggatagtaccgcggagaaagacctcgccggcgacgttgcggtgagcgggcacgggcaggacttggagcggtcttgccatgaccaggagcccgccgctgcagatggtgcgagcagcagaggcctagccatcgggcgtttncgtacgggagctgatggtggagggcktggcgtcgttcctgctggtgttctgggtccgcggtggcgcgctgatgcaggagatgcacggcacgctgacgttccccatgggtgtgcctcgtcgtcgcgctcaccgtcgtcttcgtgctctgctggctcggcccgcgcact

SEQ ID NO: 2221 - DNA, 185 bp, Zea mays
  misc_feature: Ceres CLONE 265268-F
  misc_feature (81)..(81): n is a, c, t, g, unknown, or other
aytgtaggccgctgctgctcctctcctcccatctcaccacacaccgyagccccakcaagatcgcgcggaggccatggcgancaagtccttcctccgccggcgccaagcatccgcgcctgcccgccggttacagtgcwctcggcgctggtcacytayacckccatkctcgcgctcctgttccctct

SEQ ID NO: 2222 - DNA, 494 bp, Zea mays
  misc_feature: Ceres CLONE 265272-F
  misc_feature: Encodes the peptide sequence at SEQ ID NO. 2223
  misc_feature (224)..(224): n is a, c, t, g, unknown, or other
  misc_feature (228)..(228): n is a, c, t, g, unknown, or other
  misc_feature (369)..(369): n is a, c, t, g, unknown, or other
  misc_feature (433)..(433): n is a, c, t, g, unknown, or other
atcccttgataaaaaacccacaggccacaacaccaagaaactagcatcttctgcagctctgaagaaaactcgatcaccatggacatgccttctcttgttctcctcctgctcgtcttcattacagcaggcagccgcgccgcgggcaggtgttctgccgctcgcagttcaacctggccaacgaggcctgcagcctgcgcaccttctccgggcccaacccggcgcrnhtgncagctgcacatcaacggctcctcggcgtcctacgagacacaggcggaccaccacgagcacgagcacagccacgagcacgagcacgagcacgagcacagccacgaacacgagcacgagcacagccacgaacacgagcgcgangagcacacgcacagccggcggacggtttcgggcacggcggccgcgacccctacgacaccgcctnctgccgccgcctcatgggcatcgacaacgcctgcatctgccaggccatgtcttcctccccg

SEQ ID NO: 2223 - protein, 138 aa, Zea mays
  misc_feature: Ceres CLONE 265272-F
  misc_feature (49)..(49): Xaa is any aa, unknown, or other
  misc_feature (50)..(50): Xaa is any aa, unknown, or other
  misc_feature (97)..(97): Xaa is any aa, unknown, or other
  misc_feature (119)..(119): Xaa is any aa, unknown, or other
MDMPSLVLLLLVFITAGSRAAGRCSAARSSTWPTRPAACAPSPGPTRRXXQLHINGSSASYETQADHHEHEHSHEHEHEHEHSHEHEHEHSHEHERXEHTHSRRTVSGTAAATPTTPPXAAASWASTTPASARPCLPP

SEQ ID NO: 2224 - DNA, 111 bp, Zea mays
  misc_feature: Ceres CLONE 265328-F
acacgcacaccgcgacccagtccagagccagtacgtgcgamgcacgcacgctgctggtccgcgtacsagaacgacggtcaggtcggccggtgcttttcagtttggaataat

SEQ ID NO: 2225 - DNA, 435 bp, Zea mays
  misc_feature: Ceres CLONE 265361-F
  misc_feature: Translation starting site: 105
  misc_feature (64)..(64): n is a, c, t, g, unknown, or other
  misc_feature (65)..(65): n is a, c, t, g, unknown, or other
  misc_feature (264)..(264): n is a, c, t, g, unknown, or other
tytcgcgccgccacttccctcccgacccactatcccaaaaccgtagcgccctcgcctgctcgcnnycgccgtcgttgcgagctccccatcttcctccgtcaaccatggcgacccagatcagcaagaagaagaagttcgtcagcgacggcgtgttctacgcsaggctcaatgagatgctgacgcgggagctcgcggaggacggctactccggcgtggaggtgcgcgtcacaccgatgcgcacggagatcatcatccgcgccacgnacgcagaacgtgctcggcgagaagggccgcagattcaggggagctcacgtctgtcgtccagaagaggttcaacttccccgagaacggcgtcgagctctacgccgagaaggtcgtcaaccgcggcctctgcgccatcgcsrgactgagtccctccgctacaagctcctcgga

SEQ ID NO: 2226 - DNA, 136 bp, Zea mays
  misc_feature: Ceres CLONE 265376-F
acgcacaccgcgacccagtccagagccagtacgtgcgamggcacgcacgctgctggtccgcgtacsagaacgacggtcaggtcggccggtgcttttcagtttggaataatgacggcgacgacgacgacagccgccg

SEQ ID NO: 2227 - DNA, 258 bp, Zea mays
  misc_feature: Ceres CLONE 265407-F
  misc_feature: Encodes the peptide sequence at SEQ ID NO. 2228
cacggatcgagacgtcccaatcgagctaatctcacaccgccagtgccagtgccagctgcactctaatccgtgccgtgttccagcagcgatgggagtggagtcggagtgcgacaggataaagggcccctggagccccgaggaggacgaggcgctgcggcgtctcgtggagcgccacggcscggttaactggacggcgatcgggcgcggcatcccggggcggtcggggaagtcgtgccggctgcggtggtgcaacagctg

SEQ ID NO: 2228 - protein, 56 aa, Zea mays
  misc_feature: Ceres CLONE 265407-F
  misc_feature (11)..(55): Pfam Name: Myb_DNA-binding Pfam Description: Myb-like DNA-binding domain
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 132 in the 10/412,699 US patent application
  misc_feature: The sequence is a functional homolog of SEQ ID NO 1968 in the 10/374,780 US patent application
  misc_feature: The sequence is a functional homolog of SEQ ID NO 309 in the 11/479,226 US patent application
  misc_feature: The sequence is a functional homolog of SEQ ID NO 582 in the 11/435,388 US patent application
  misc_feature: The sequence is a functional homolog of SEQ ID NO 2262 in the 10/374,780 US patent application
  misc_feature: The sequence is a functional homolog of SEQ ID NO 774 in the 10/225,066 US patent application
  misc_feature: The sequence is a functional homolog of SEQ ID NO 1942 in the 10/374,780 US patent application
  misc_feature: The sequence is a functional homolog of SEQ ID NO 454 in the 10/374,780 US patent application
  misc_feature: The sequence is a functional homolog of SEQ ID NO 568 in the 11/435,388 US patent application
  misc_feature: The sequence is a functional homolog of SEQ ID NO 90 in the 10/225,068 US patent application
  misc_feature: The sequence is a functional homolog of SEQ ID NO 1664 in the 11/479,226 US patent application
  misc_feature: The sequence is a functional homolog of SEQ ID NO 2578 in the 10/374,780 US patent application
  misc_feature: The sequence is a functional homolog of SEQ ID NO 62 in the 10/225,066 US patent application
  misc_feature: The sequence is a functional homolog of SEQ ID NO 132 in the 10/286,264 US patent application
  misc_feature: The sequence is a functional homolog of SEQ ID NO 2576 in the 10/374,780 US patent application
  misc_feature: The sequence is a functional homolog of SEQ ID NO 280 in the 10/225,066 US patent application
  misc_feature: The sequence is a functional homolog of SEQ ID NO 1676 in the 11/479,226 US patent application
  misc_feature: The sequence is a functional homolog of SEQ ID NO 2580 in the 10/374,780 US patent application
  misc_feature: The sequence is a functional homolog of SEQ ID NO 64 in the 10/225,066 US patent application
  misc_feature: The sequence is a functional homolog of SEQ ID NO 850 in the 10/412,699 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 1687 in the 10/374,780 US patent application
  misc_feature: The sequence is a functional homolog of SEQ ID NO 1695 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1060 in the 10/225,066 US patent application
  misc_feature: The sequence is a functional homolog of SEQ ID NO 2392 in the 10/374,780 US patent application
  misc_feature: The sequence is a functional homolog of SEQ ID NO 506 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 146 in the 10/225,066 US patent application
  misc_feature: The sequence is a functional homolog of SEQ ID NO 312 in the 10/374,780 US patent application
  misc_feature: The sequence is a functional homolog of SEQ ID NO 32 in the 10/225,068 US patent application
  misc_feature: The sequence is a functional homolog of SEQ ID NO 930 in the 10/412,699 US patent application
  misc_feature: The sequence is a functional homolog of SEQ ID NO 2722 in the 10/374,780 US patent application
  misc_feature: The sequence is a functional homolog of SEQ ID NO 362 in the 10/225,066 US patent application
  misc_feature: Functional homolog of the protein sequence given in SEQ ID NO 96862
  misc_feature: Useful for making plants with modulated low light sensitivity
  misc_feature: The sequence is a functional homolog of SEQ ID NO 126 in the 10/412,699 US patent application
  misc_feature: The sequence is a functional homolog of SEQ ID NO 1692 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1572 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 186 in the 10/412,699 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature (31)..(31): Xaa is any aa, unknown, or other
MGVESECDRIKGPWSPEEDEALRRLVERHGXVNWTAIGRGIPGRSGKSCRLRWCNS

SEQ ID NO: 2229 - DNA, 1362 bp, Zea mays
  misc_feature: Ceres CLONE 265427
  misc_feature: Encodes the peptide sequence at SEQ ID NO. 2230
agatagatagagtagtagtaggttgttagctgaggggaggcatcgatggctggagccaagagaggaatcctgctcgtcctgtgcctggccgtcgtcttggtggcgctcgggagtggcggcgtggaggcgaggaagcgagggaagcagtccctggggttctacgagctgcgtcggggcgagttctccatggtcgtcaccaactggggcgccaccatcctctccgtcaggctccccgataagaacgggcacatcgacgacgtcgttcttggctacaagaacatcggatcgtacgtcaacgacacgacctacttcggcgcgctggtggggcgcgtggcgaaccgcatcgccggcgggcggttcaccatcagggaccacgcctaccacacgtatcggaacgacggcaacaacacgctccacggcggccaccgcgggttcaaccaggtgttctggtccgtccgggagcgcgtcacgggggagttcccgcacatcaccttcgcctaccgcagctacgacggcgagcaagggttcccgggcaacctggacgtgctggtcacctacaagatcgacggcgactgctcgtacagcgtcaccatgtacgcgcggccgctggacaagcccacccccgtgaacctggcgcagcacacgtactggaacctccgcggccacggcaacggcaccgtcctgcgccacgccgtccagatcttcgcgtccgcggtcacgcccgtgggccgcggcctcatcccgacgggcgcggtcaccccmgtcgccggcactccgttysasttccgcgccmsgtcggcgcccggcgcgcacatcgccgaggtcgagggtgggtacgacatcaacwacgtgctggacggcgagacggacgggcaaggcgtgcgcaaggtggccgtggtcagcgaggcggactccgggcgcgtcatggagctktgggccgaccagccgggcctgcagttctacactggcaacatgcttaagggcgacgagggcaagggcggcgccgtctaccccaaatacgctgggatgtgcctggagacgcaagactacccggacgccgtgcacgagccggccttcccggccgaggtgtaccgccctggccaactctacaagcactacatgctctacaagttctcaatcagcaagtaggaacttctagtacctctcgtgcctgatgcctcatagtttcggtaggtttgcaacctgttgcgactagtaataagggttctgagtctttttttttagaaaaaattgcaacagaaatgtatggttcgagttcgtccaaactttgtctagtcaacattttctgccatttgaatgccatcttaatagtctaaaaaaaaaacaaaaaaaaaaaaaaaa

SEQ ID NO: 2230 - protein, 367 aa, Zea mays
  misc_feature: Ceres CLONE 265427
  misc_feature (37)..(362): Pfam Name: Aldose_epim Pfam Description: Aldose 1-epimerase
  misc_feature: SWISSPROT Homolog: EC 5.1.3.3 Aldose 1-epimerase
  misc_feature: Functional homolog of the protein sequence given in SEQ ID NO 96863
  misc_feature: Useful for making plants with altered oil content
  misc_feature (239)..(239): Xaa is any aa, unknown, or other
  misc_feature (245)..(245): Xaa is any aa, unknown, or other
  misc_feature (246)..(246): Xaa is any aa, unknown, or other
  misc_feature (250)..(250): Xaa is any aa, unknown, or other
  misc_feature (268)..(268): Xaa is any aa, unknown, or other
  misc_feature (296)..(296): Xaa is any aa, unknown, or other
MAGAKRGILLVLCLAVVLVALGSGGVEARKRGKQSLGFYELRRGEFSMVVTNWGATILSVRLPDKNGHIDDVVLGYKNIGSYVNDTTYFGALVGRVANRIAGGRFTIRDHAYHTYRNDGNNTLHGGHRGFNQVFWSVRERVTGEFPHITFAYRSYDGEQGFPGNLDVLVTYKIDGDCSYSVTMYARPLDKPTPVNLAQHTYWNLRGHGNGTVLRHAVQIFASAVTPVGRGLIPTGAVTXVAGTPXXFRAXSAPGAHIAEVEGGYDINXVLDGETDGQGVRKVAVVSEADSGRVMEXWADQPGLQFYTGNMLKGDEGKGGAVYPKYAGMCLETQDYPDAVHEPAFPAEVYRPGQLYKHYMLYKFSISK

SEQ ID NO: 2231 - DNA, 227 bp, Zea mays
  misc_feature: Ceres CLONE 265433-F
  misc_feature: Pfam Name: DUF1969 Pfam Description: Domain of unknown function (DUF1969)
  misc_feature (86)..(86): n is a, c, t, g, unknown, or other
acggcggggttgttgtcgcttgttggccagccgccagcaccagcacaaggcgatcgagagtggtgaccaccagtaaactgcaaakngcaaaccaaacaccacccacgagaaagcggaggagggagcaatggcgacgkagccagcagctgcggtcgttcgtggaggtgccggcgggctcccacttccccatccagaacctgcccttcgggtcttccgccggcgggggg

SEQ ID NO: 2232 - DNA, 271 bp, Zea mays
  misc_feature: Ceres CLONE 265560-F
  misc_feature: Encodes the peptide sequence at SEQ ID NO. 2233
  misc_feature (105)..(105): n is a, c, t, g, unknown, or other
  misc_feature (221)..(221): n is a, c, t, g, unknown, or other
ayttttctcctccgccttccactcatccttgcccctgcctgccgtcgtgcatcatcatctccggccagggccagggcattcgtttccgcctccggtccggcctbntccactccgcgccccccagacgcgtcgctgcgtmststggccgccatggcaccgtcatggccgcggcgtctcgtccttcccgtcctcctcggccgtcgtcgccaaggcgtcgcggncgtccccctgtgccgccccgcacttccgcccgagggccgtgcgggccgct

SEQ ID NO: 2233 - protein, 89 aa, Zea mays
  misc_feature: Ceres CLONE 265560-F
  misc_feature (34)..(34): Xaa is any aa, unknown, or other
  misc_feature (46)..(46): Xaa is any aa, unknown, or other
  misc_feature (73)..(73): Xaa is any aa, unknown, or other
FSSAFHSSLPLPAVVHHHLRPGPGHSFPPPVRPXPLRAPQTRRCVXWPPWHRHGRGVSSFPSSSAVVAKASRXSPCAAPHFRPRAVRAA

SEQ ID NO: 2234 - DNA, 487 bp, Zea mays
  misc_feature: Ceres CLONE 265565-F
  misc_feature: Encodes the peptide sequence at SEQ ID NO. 2235
  misc_feature (97)..(97): n is a, c, t, g, unknown, or other
gaaggaacaacgcagacaaaccgaactcgcacctcgcacctcgcatcgtcttgtcgacacacctccagctccgaaaccctactccgccggcgattgncgtcatccggcgccccggccccggcggcggcaatggccgttgacgacgcggaggacgaccagctcgcctccatgtcyacggaggatatcatccgggcctcccgccttcttgacaacgagatccgtgtcctcaaggacgagttgcagcggacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaagaaaatgtgttgttctgaagacctccacaagacaaattcaagagcttgtagaggcaattgtactgcc

SEQ ID NO: 2235 - protein, 102 aa, Zea mays
  misc_feature: Ceres CLONE 265565-F
MAVDDAEDDQLASMSTEDIIRASRLLDNEIRVLKDELQRTNLELESFKEKIKENQEKIKLNKQLPYLVGNIVEILEMNPEDEAEEDGANIDLDSQRKENVLF

SEQ ID NO: 2236 - DNA, 445 bp, Zea mays
  misc_feature: Ceres CLONE 265584-F
  misc_feature: Encodes the peptide sequence at SEQ ID NO. 2237
  misc_feature (2)..(2): n is a, c, t, g, unknown, or other
antggtgacccaacaacctccctcatcccctccccttctttcttattgccaccactccacgtctccaccaaacaaggcaacaatgtggagaagtagatctgcatctgcgtagaggaggcagcgggggtggtgatgatggagagccagccgctgcaggccccgacggccacggctccgcccccggatctgcggaccagccggagccccgccggccgtcacccccggcaaggagttcacgcgcacctgcaaggcctcgtcgtcgtgctcatcggaggatacgtgctgctccagctcctcccttcgtcgctcaactacctcgccatcatcccatccaagacaatcccctatgtatggaccgttttcactgctggttacatcgagcaagtcctcccaggggccattggcagttctcttggtcttctcttttgtggaaaggacattgaac

SEQ ID NO: 2237 - protein, 104 aa, Zea mays
  misc_feature: Ceres CLONE 265584-F
MMESQPLQAPTATAPPPDLRTSRSPAGRHPRQGVHAHLQGLVVVLIGGYVLLQLLPSSLNYLAIIPSKTIPYVWTVFTAGYIEQVLPGAIGSSLGLLFCGKDIE

SEQ ID NO: 2238 - DNA, 261 bp, Zea mays
  misc_feature: Ceres CLONE 265596-F
  misc_feature: Encodes the peptide sequence at SEQ ID NO. 2239
accccaacgccggcacgccgcccaaaaacccttgckgcgtcgcactcacactagcgaccaacccccaaccccagaccttcctctccggcggcggscgcgcgcgcbaagggagatggaccgcccttccggcacatcgtaccagcgcttcccccgcgttcggatccgcgagctcaaggacgactacgccaagttcgaactccgcgacaccgacgctagcatggccaacgccctccgccgcgtcatgatcgccgaagtcccaac

SEQ ID NO: 2239 - protein, 49 aa, Zea mays
  misc_feature: Ceres CLONE 265596-F
  misc_feature: SWISSPROT Homolog: EC 2.7.7.6 DNA-directed RNA polymerase
MDRPSGTSYQRFPRVRIRELKDDYAKFELRDTDASMANALRRVMIAEVP

SEQ ID NO: 2240 - DNA, 240 bp, Zea mays
  misc_feature: Ceres CLONE 265603-F
  misc_feature: Encodes the peptide sequence at SEQ ID NO. 2241
  misc_feature (90)..(90): n is a, c, t, g, unknown, or other
  misc_feature (152)..(152): n is a, c, t, g, unknown, or other
aggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagckcgcggcggcgtanatgcccaacgccaagaactcccaggacgggctcaccccggagcaggccgcgagagggacaagaaagctctggaggagaaggcggccaa

SEQ ID NO: 2241 - protein, 46 aa, Zea mays
  misc_feature: Ceres CLONE 265603-F
  misc_feature (13)..(13): Xaa is any aa, unknown, or other
  misc_feature (17)..(17): Xaa is any aa, unknown, or other
MTRGNQRDRDREXAAAXMPNAKNSQDGLTPEQAARGTRKLWRRRRP

SEQ ID NO: 2242 - DNA, 154 bp, Zea mays
  misc_feature: Ceres CLONE 265667-F
  misc_feature (126)..(126): n is a, c, t, g, unknown, or other
ctcaaacaaaaaccctagccgccgcgccgccccgctccctagtggtgctccctcccccaccactgcagctccgtcccggcggccccaagagttgcggcgaggatgaacgtgaagggcggcacgganttccggtacccccgccggccagcgcgct

SEQ ID NO: 2243 - DNA, 430 bp, Zea mays
  misc_feature: Ceres CLONE 265714-F
  misc_feature: SWISSPROT Homolog: EC 3.2.1.14 Chitinase
  misc_feature (380)..(380): n is a, c, t, g, unknown, or other
  misc_feature (390)..(390): n is a, c, t, g, unknown, or other
aaatcacctcacaacaagctgccccgcmgaacgaacacgaaccttggcagaacgaagctgaagtagttcgttgtgaacccagtatggcaaacgcgccgaggatcctggccctcggctgctagckctcctgtgcgctgccgccggcccggccgccgcgcagaactgcggctgccagcctaacttctgctgcagcaagttcggctactgcggcacgaccgacgcctactgcggcgacgggtgccagtygggcccgtkccgctcgggcgsggcggcggcggcggcggcggcggaggcggcggaggcagtggcggtgcgaacgtggctaatgtggtcaccgacgcgttcttcaacggcatcaagaaccaggccgggagcgggtncgagggcaanaacttctacacccgggagcgcgttcctgagcgccgtcaac

SEQ ID NO: 2244 - DNA, 447 bp, Zea mays
  misc_feature: Ceres CLONE 265760-F
  misc_feature: Pfam Name: adh_short Pfam Description: short chain dehydrogenase
aaagaacagacctatcgctacacagtccgccgtggctctctgcaattaatggctgcctccacagcgtcgtcgtcatactctgccggtgtaagckccgcctgctgtgtgtctccgcgccatggcagcagcttcgtcaagccgcagcgctctggacggccggcggcggcggcggcgaccctacctgcgtcaggcggcgaccagcsaacctatcgttagactgctgtcgtaggagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagcatagctgtagcacttggcggacagggtgcaaggtggttgtgaactatgccaagtcaggcgtggaggccgaa

SEQ ID NO: 2245 - DNA, 430 bp, Zea mays
  misc_feature: Ceres CLONE 265882-F
  misc_feature (297)..(297): n is a, c, t, g, unknown, or other
ctagagccgcaccagcacactcccgcagcagtagccgccgccgccgccgccgcagcccagccgtagaaacaggaggaagatgccggcggggcacgggcttcggtcgcggacccgscatgtttcgcgcggccgttccgcaagaagggttacatcccgctcaccacgtacctgcgcacctacaagatcggcgactacgtcgastcaaaggtgaacggcgccgtgcacaagggcatgccgcacaagttctaccacggccgcaccgtcgcgtctggaacgtcaccaagcgcgccatcgstntgagatcaacaagcaggttaatggccgcatcatcaggaagcgtatccatgtccgtgtggagcatgtgcagccctcccgttgcacagaggagttccgcttgaggaaagccaagaacgatcagctcaaggttgat

SEQ ID NO: 2246 - DNA, 478 bp, Zea mays
  misc_feature: Ceres CLONE 265890-F
  misc_feature: Encodes the peptide sequence at SEQ ID NO. 2247
aactacttcctgcagtcctgcgctgcgcccctcctttccgcctccacggctccacgctgccgacgtccaccacacagcacggtcgagtcacccgatccctccatggcggcggcagtggcggcggtcgcggctgccacgacggcggaggacgaggcgcgcctgctgcgtctggaggagcaggcggacacggcgccggcggcgcttgggactacctctgcctcgcccgccggctccgcgcccgccgccccgcccacgtcctccgcgtcggcctcgctctcctcaacaacgcctccgctcgctccggtctcgcctcagaacagtggacgctctacgagcaggtggccacggcggccatggattgccagcgtctcgatgtggcaaaggactgtattggagtcctttcaaagcaatttcctggcagcacccgggttgcccgctagaagctcttctgtttgaagcgaaaagtgaatgggctgaa

SEQ ID NO: 2247 - protein, 145 aa, Zea mays
  misc_feature: Ceres CLONE 265890-F
LLPAVLRCAPPFRLHGSTLPTSTTQHGRVTRSLHGGGSGGGRGCHDGGGRGAPAASGGAGGHGAGGAWDYLCLARRLRARRPAHVLRVGLALLNNASARSGLASEQWTLYEQVATAAMDCQRLDVAKDCIGVLSKQFPGSTRVAR

SEQ ID NO: 2248 - DNA, 278 bp, Zea mays
  misc_feature: Ceres CLONE 265958-F
  misc_feature: Encodes the peptide sequence at SEQ ID NO. 2249
  misc_feature (211)..(211): n is a, c, t, g, unknown, or other
  misc_feature (237)..(237): n is a, c, t, g, unknown, or other
aaaaactgtgagcgagaagcagggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgngggctccaactccaaggcggcggcangttccctcctcgtctttcctgcagctgccgctttcgacggc

SEQ ID NO: 2249 - protein, 39 aa, Zea mays
  misc_feature: Ceres CLONE 265958-F
  misc_feature (17)..(17): Xaa is any aa, unknown, or other
  misc_feature (26)..(26): Xaa is any aa, unknown, or other
MDQSFGNLGAGAGSSSXGSNSKAAAXSLLVFPAAAAFDG

SEQ ID NO: 2250 - DNA, 483 bp, Zea mays
  misc_feature: Ceres CLONE 266052-F
  misc_feature: Encodes the peptide sequence at SEQ ID NO. 2251
acggacccttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtkggtcaa

SEQ ID NO: 2251 - protein, 140 aa, Zea mays
  misc_feature: Ceres CLONE 266052-F
  misc_feature (24)..(140): Pfam Name: Calreticulin Pfam Description: Calreticulin family
  misc_feature (139)..(139): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCXS

SEQ ID NO: 2252 - DNA, 460 bp, Zea mays
  misc_feature: Ceres CLONE 266059-F
  misc_feature: Translation starting site: 345
  misc_feature: Pfam Name: GFO_IDH_MocA Pfam Description: Oxidoreductase family, NAD-binding Rossmann fold
aatagcagcgttggtcttcggggtgagaagtcagcgaaggcaaatctcaagcctgcttgattgcttgagtcagatctgatccagtcttgcggcaccgagaaccgaggaggggaacatggcgggtgacggcaacggccgcgcggasttccccggatcgcggtgatcggcgccggcatctttgcgcgcactcagtacatcccaaggctccgcgagatcgcgcacctcgtcgtcctcaaggccatctggagccgcacccaggaatctgcaaaggcggccgcggacttgctcgtgacttcgcgcctgacatcgagtgcagatggggtgatgcggggctggaggagatcatgggagatagttcaatcattggcgttgctgttgttctcgctgggcaagtccaggttgagctttccctaaagatgctcaaggctggaaaacacgttattcaagagaacctgcttct

SEQ ID NO: 2253 - DNA, 514 bp, Zea mays
  misc_feature: Ceres CLONE 266078-F
  misc_feature: Encodes the peptide sequence at SEQ ID NO. 2254
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcgaggcgcgcttc

SEQ ID NO: 2254 - protein, 104 aa, Zea mays
  misc_feature: Ceres CLONE 266078-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRWRRRRPCRASARGAARSRPSPTSCTSRRARRA

SEQ ID NO: 2255 - DNA, 135 bp, Zea mays
  misc_feature: Ceres CLONE 266089-F
gcgtcagayagagaaagccgagattagcggcggcgcgatggcactcccggcgtcaactccggcctcttccgcttcgtctccccccgcagtcgtccccagtccaccgacatcgtggccgctgctcctggggagtct

SEQ ID NO: 2256 - DNA, 119 bp, Zea mays
  misc_feature: Ceres CLONE 266098-F
  misc_feature (70)..(70): n is a, c, t, g, unknown, or other
acacgcacaccgcgacccagtccagagccagtacgtgcgamaggccacgcacgctgctggtccgcgtacnagacgacggtcaggtcggccggtgcttttcagtttggaataatgacggc

SEQ ID NO: 2257 - DNA, 427 bp, Zea mays
  misc_feature: Ceres CLONE 266135-F
  misc_feature: Encodes the peptide sequence at SEQ ID NO. 2258
  misc_feature (117)..(117): n is a, c, t, g, unknown, or other
  misc_feature (123)..(123): n is a, c, t, g, unknown, or other
  misc_feature (249)..(249): n is a, c, t, g, unknown, or other
  misc_feature (252)..(252): n is a, c, t, g, unknown, or other
atcaactcgcaattccgcattcgttccaactcctgagcactttctcctcgtcccagacaagccaatcgaagccgagatacgaccatggactccaccggcaccggagcagggggtaangggaanaagggagcggccgggcgcaaggtcggcgggccaaggaagaagtcggtgtcgaggtccgtgaaggccggtctccagttccccgtcggccgcatcgggcgctacttgaagaagggccgctacgcgcangtncgggcaccggcgcccccgtctacctcgccgctgttcctcgaatacctcgccgctgaggttctggagctcgccggtaatgctgccagtggacaacaagaagactcgcatttattccgcgccacgtgcttctggcgatccgggaackacgaggagcttgggaagctgttgggcggcg

SEQ ID NO: 2258 - protein, 114 aa, Zea mays
  misc_feature: Ceres CLONE 266135-F
  misc_feature (11)..(11): Xaa is any aa, unknown, or other
  misc_feature (13)..(13): Xaa is any aa, unknown, or other
  misc_feature (55)..(55): Xaa is any aa, unknown, or other
  misc_feature (105)..(105): Xaa is any aa, unknown, or other
MDSTGTGAGGXGXKGAAGRKVGGPRKKSVSRSVKAGLQFPVGRIGRYLKKGRYAXVRAPAPPSTSPLFLEYLAAEVLELAGNAASGQQEDSHLFRATCFWRSGNXEELGKLLGG

SEQ ID NO: 2259 - DNA, 202 bp, Zea mays
  misc_feature: Ceres CLONE 266166-F
  misc_feature: Pfam Name: Auxin_repressed Pfam Description: Dormancy/auxin associated protein
gtgcccgckgtgctagtgacggttgctctagatccgttcatcctggtggttttgtgaggtcgaaagckgcgagcgaattagaagatgctggacaagctgtgggacgacgtggtggccgggcctcgccgaaggacggcctcgagaagctccgcaaggccaccaccgcccgcccgctcgtcatcaacaaagacgcggacggcgg

SEQ ID NO: 2260 - DNA, 524 bp, Zea mays
  misc_feature: Ceres CLONE 266198-F
  misc_feature: Encodes the peptide sequence at SEQ ID NO. 2261
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakndtgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagattggcgacggaggcgtccctgtcgtgcgtccgctcgtggggcggcgcgctctcgtccatcacccacctcgtgtacgtctcgtcgagcgaggcgcgctttcccggggc

SEQ ID NO: 2261 - protein, 146 aa, Zea mays
  misc_feature: Ceres CLONE 266198-F
  misc_feature (10)..(146): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLDISNAAVTRLATEASLSCVRSWGGALSSITHLVYVSSSEARFPG

SEQ ID NO: 2262 - DNA, 700 bp, Zea mays
  misc_feature: Ceres CLONE 272103-R
  misc_feature: Pfam Name: AdoHcyase Pfam Description: S-adenosyl-L-homocysteine hydrolase
  misc_feature: SWISSPROT Homolog: EC 3.3.1.1 Adenosylhomocysteinase
cgattgggtaccgggccccccctcgaggtcgacggtatcgataagcttttttttttttttttttatctaaaggggttattggtaagagactaataacttgagctaatcgcttacgagtgaagatcaaataagtggagtcaacaagacaaaactgtgtctggagacaaatgtcgactcaccccagtcgactacttcattattctacggccaaagcaaacggctccttccctccccctcagctcaagcgataaccataaggaaacctgctacgcgactgcgtatatgataatgtatatgcctgcaaaagataactgacatgccagtgtagcgaacttcatagcacacaacggcccgagtgagctgcaagccgtgtgctggctgcctacaaccggtaatgggcaggcttgtagggaccctccatcggcacgctgatgtagaccgcctgagacttggtgagcttggtcagcttggcacctagcttgcccaagtggagagcagcaaccttctcatcaaggtgcttggggagcacatacaacttcttctcatacttgccagagctcttctccttccacagttcaagatgggcaatgacctggttagtgaatgagcaggacatgactcagctaggatggccagtagcacacccaaggttcatcatgcgaccctcaccaaggacaatgatgccagagttggtctcggg

SEQ ID NO: 2263 - DNA, 477 bp, Zea mays
  misc_feature: Ceres CLONE 272145-F
  misc_feature: Encodes the peptide sequence at SEQ ID NO. 2264
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggttctctggaggatttgtacaatggcacatcgaag

SEQ ID NO: 2264 - protein, 138 aa, Zea mays
  misc_feature: Ceres CLONE 272145-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVLWRICTMAHR

SEQ ID NO: 2265 - DNA, 138 bp, Zea mays
  misc_feature: Ceres CLONE 272230-F
acacgcacaccgcgacccagtccagagccagtacgtgcgamrgcacgcacgctgctggtccgcgtacsagaacgacggtcaggtcggccggtgcttttcagtttggaataatgacggcgacgacgacgacagccgccg

SEQ ID NO: 2266 - DNA, 505 bp, Zea mays
  misc_feature: Ceres CLONE 272264-F
  misc_feature: Encodes the peptide sequence at SEQ ID NO. 2267
ctcttccatagcatagcagagcaggcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactaggatgatatggagaaaatctggcaccacaccttctacaatgaactgcgtgttgctc

SEQ ID NO: 2267 - protein, 80 aa, Zea mays
  misc_feature: Ceres CLONE 272264-F
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVNN

SEQ ID NO: 2268 - DNA, 416 bp, Zea mays
  misc_feature: Ceres CLONE 272265-F
  misc_feature: Encodes the peptide sequence at SEQ ID NO. 2269
atttttaagactagctaactagcgtgaaagagctcctccgacgactactagctctcgcttgctccgacgacccctgccggccgcctctggtacaacgtacgagaggaagagagacgatcgatggccggcgccaccgtgaccgtggacgaggtgaggaagggccagcgcgcgaccggccccgccaccgtgctggccatcgggacggcgacgcccgccaactgcgtgtaccaggccgactacccggactactacttccggatcaccaagagcgaccacctcaccgacctcaaggagaagttcaagaggatgtgcgacaagtcgatgatccggaagcggtacatgcacctgacggaggagttcctgtcggagaacccgagcatgtgcgcgtacatggcgccgtcgctggacgcgcggca

SEQ ID NO: 2269 - protein, 98 aa, Zea mays
  misc_feature: Ceres CLONE 272265-F
  misc_feature (6)..(98): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MAGATVTVDEVRKGQRATGPATVLAIGTATPANCVYQADYPDYYFRITKSDHLTDLKEKFKRMCDKSMIRKRYMHLTEEFLSENPSMCAYMAPSLDAR

SEQ ID NO: 2270 - DNA, 451 bp, Zea mays
  misc_feature: Ceres CLONE 272316-F
  misc_feature: Encodes the peptide sequence at SEQ ID NO. 2271
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgcgacgatgaatcagcgtctggacatctcgaacgcggcggtkacccagatggcgacggaggcgtccctgtcgtgcgtccgctc

SEQ ID NO: 2271 - protein, 97 aa, Zea mays
  misc_feature: Ceres CLONE 272316-F
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLRR

SEQ ID NO: 2272 - DNA, 429 bp, Zea mays
  misc_feature: Ceres CLONE 272330-F
  misc_feature: Translation starting site: 59
gcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctg

SEQ ID NO: 2273 - DNA, 685 bp, Zea mays
  misc_feature: Ceres CLONE 272339-R
  misc_feature (341)..(341): n is a, c, t, g, unknown, or other
ccaattgggtaccgggccccccctcgaggtcgacggtatcgatattttttttttttttttttccatcactcaagtcgaattatgttagcgaaacatctgttcgactccacagaagcaagcaacaatgacataagagttgtccctaattgcctcaaatcataaagctcctacaagcccacacgtgctgctgaacgtgtggatccttcttaactctctatgggaaagttgaaatgcgaggatatgacgaaaagccaggcagaactcagcgcacggtaactaaagcggcagaagatcttcacttcttcctcttctttgggggctggagcgagtcttcatcatcnatcttcctcctcatcctcgtcctggtcatcgtcttctcatctacccctcctcatcgtcatccccatgtcgtcgtctcgtcatccccgtctcatcatcgtcatcgcgtcatcatcgtcgtcgacatgggtgactgggccccctggtgatcccgacggtgctgttcgtgctgctcacgcggggcctgctgtttcagtttgccgggcacggcccaattctccggtttggggaccatgcaaacaaaggggattcccttcttggtcccaagccgttctcttattttggggttataaccaattttctcaaagcgcattgggggcccaatattaaccccgggtaaaattag

SEQ ID NO: 2274 - DNA, 459 bp, Zea mays
  misc_feature: Ceres CLONE 272370-F
  misc_feature: Encodes the peptide sequence at SEQ ID NO. 2275
aaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgcgcgacttcctccccgaaaactgcggctgcaagatccactagagactcatccaatcaaccatggccacagccgatggacccttcttccatatgcatgctctcctccgtccgtccgcctagcttgctacaagcaggcgctaataagctagc

SEQ ID NO: 2275 - protein, 125 aa, Zea mays
  misc_feature: Ceres CLONE 272370-F
MKSRSSTLLVILVLQALLLSAAVAKGPAGPKKQCWCGECTSWSGVWTCDDLLTKCAATCKNCVPVSTDKGATKYRCATSSPKTAAARSTRDSSNQPWPQPMDPSSICMLSSVRPPSLLQAGANKL

SEQ ID NO: 2276 - DNA, 393 bp, Zea mays
  misc_feature: Ceres CLONE 272387-F
  misc_feature: Encodes the peptide sequence at SEQ ID NO. 2277
  misc_feature (193)..(193): n is a, c, t, g, unknown, or other
aaaaatcgaagggtcgacaatggttacgacgatcggtagtccatagcagcggcgggcgcaacttcgacccggttttcttcccatatatctgtcaaatccttctccggttgccctccatcggcaacaatttccgccatagataccggcgatcgagggcctcggacaacccaatcgacggagcagcgcggcggcnggagagggcaaacccttttcttctcagtactctacttgtctgcgcctggatcccctccgcaggaagactaagacatgggtcaagcactcggcttgattcaagtggatcaatcgacagtagccatcaaggaaacttttgggaagtttgacgaggtcctagagcctggatgccacttcttgccatggtgcatagggtagcaa

SEQ ID NO: 2277 - protein, 40 aa, Zea mays
  misc_feature: Ceres CLONE 272387-F
MGQALGLIQVDQSTVAIKETFGKFDEVLEPGCHFLPWCIG

SEQ ID NO: 2278 - DNA, 412 bp, Zea mays
  misc_feature: Ceres CLONE 272428-F
  misc_feature: Encodes the peptide sequence at SEQ ID NO. 2279
agattagtgggggaactgggcgtaaccgtaatattcaccctgcgcccctccctcttgttctccggttccccgcggcatactctttcctgcgctctctctctcggttctgccgtgtccctcgcgtgcgctctgtctccggtggcgccgctccgccgcctccgtcgccctgcgccagatcagattcgtggatatggctgataatgagaaagaagtgggggagggaaccaccccccgaggggcggactgggaagttgtgactctcacagcatctgcctatgaagcggcgcaggacctgtcaggacagaagtaaagcctgttaatgaaaatcaagagcatagttcatccaatgcactgctcatgtctgaccactttgtgttttccgccgagtgagcacgagaaacctgcaatacaa

SEQ ID NO: 2279 - protein, 39 aa, Zea mays
  misc_feature: Ceres CLONE 272428-F
MADNEKEVGEGTTPRGADWEVVTLTASAYEAAQDLSGQK

SEQ ID NO: 2280 - DNA, 136 bp, Zea mays
  misc_feature: Ceres CLONE 272550-F
actttccggcctccgcttcccaccccgatcatcctgccgcagtgccgctccttccctccctctacccgtcgccgctgctgccatggacgaabgtccagccagattttggagaagcaagtgctgtctgccgcgaagg

SEQ ID NO: 2281 - DNA, 97 bp, Zea mays
  misc_feature: Ceres CLONE 272551-F
tgcaaaccctagtgcttcccaccgatccatttcagccgccgccgcgcgttasaagcaggagcagcaaggatgccggctggccacgggctgcgctcgc

SEQ ID NO: 2282 - DNA, 112 bp, Zea mays
  misc_feature: Ceres CLONE 272578-F
  misc_feature (68)..(68): n is a, c, t, g, unknown, or other
acacgcacaccgcgacccagtccagagccagtacgtgcgamrgcacgcacgctgctggtccgcgtacnagacgacggtcaggtcggccggtgcttttcagtttggaataatg

SEQ ID NO: 2283 - DNA, 129 bp, Zea mays
  misc_feature: Ceres CLONE 272594-F
  misc_feature (65)..(65): n is a, c, t, g, unknown, or other
acgcacaccgcgacccagtccagagccagtacgtgcgamgcacgcacgctgctggtccgcgtacnagacgacggtcaggtcggccggtgcttttcagtttggaataatgacggcgacgacgacgacagc

SEQ ID NO: 2284 - DNA, 660 bp, Zea mays
  misc_feature: Ceres CLONE 272618-R
  misc_feature: SWISSPROT Homolog: EC 1.15.1.1 Superoxide dismutase
ccaattgggtaccgggccccccctcgaggtcgacggtatcgataagcttttttttttttttttttgctgctggtagtactcgatagtacacctccagtagtgtcttcttaagcatttgttggaacagacacttaagcaggtgcgcaacattgttcatatacaaaatgacatgaatagtgctctctgatcatggatcaggcgcttatttggagtactcaaattgtgttgccaatacaggggaaatggaacagcaacttcctgaggtgctcgcttcgaccttctatggtgtttgcctcggaggttaaccgctttagccttggagcccaatgataccacaggcaacacgtccgccagcatttccggtgctcttgctaagctcatgtccacctttgccaaggtcatccggatcagcatggacaacaacagctcggccaatgatcgagtggggtccagcaagaggtatctgcagttcaaatatgtgttccatgtcaggcattgttcggttatcatggatcggaaatgattgtaaaaaattatgaatgattttgacttgatatggaattaatctcacttaaacccctccaatttaccttgttcggttattcccattgcacatggattggatgagattggaaaaaaaataagaagaaatttgacttg

SEQ ID NO: 2285 - DNA, 332 bp, Zea mays
  misc_feature: Ceres CLONE 272677-F
  misc_feature: Encodes the peptide sequence at SEQ ID NO. 2286
acacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggcgaggttgtctgctcctgctgatcccgaggagcttcccgcggccgagcagcaggcagccgccg

SEQ ID NO: 2286 - protein, 61 aa, Zea mays
  misc_feature: Ceres CLONE 272677-F
MATAEVQTPTVVAAEEAPVVETPPPAVVPEESAPAEAEAEARLSAPADPEELPAAEQQAAA

SEQ ID NO: 2287 - DNA, 383 bp, Zea mays
  misc_feature: Ceres CLONE 272691-F
  misc_feature: Encodes the peptide sequence at SEQ ID NO. 2288
  misc_feature (131)..(131): n is a, c, t, g, unknown, or other
  misc_feature (306)..(306): n is a, c, t, g, unknown, or other
acatagtactagaaaaatggccatggcagccgcaccgcgaatgccatcttgctcttggctctcttcttcgccggcgctcacgcgaatgtcccatgcatactccccgtatgcaagacggtgggtggcggganggttcttcgacgtgcagttctgcctggcggcactcggctccgatggccggagcgtcgaccactgcctcgactaccaggtctactccgccattgccgctgacctcctcgcggccaacctcaccgctacggcgccaagatcaacggcctgctccggaagakcggcggctccgcacanggccacgacgcgctgtctccggtcctgtcaagcgttgtacggcgacatggaacggaggcagactggctgcgcggctg

SEQ ID NO: 2288 - protein, 122 aa, Zea mays
  misc_feature: Ceres CLONE 272691-F
  misc_feature (39)..(39): Xaa is any aa, unknown, or other
  misc_feature (92)..(92): Xaa is any aa, unknown, or other
  misc_feature (97)..(97): Xaa is any aa, unknown, or other
MAMAAAPRMPSCSWLSSSPALTRMSHAYSPYARRWVAGXFFDVQFCLAALGSDGRSVDHCLDYQVYSAIAADLLAANLTATAPRSTACSGRXAAPHXATTRCLRSCQALYGDMERRQTGCAA

SEQ ID NO: 2289 - DNA, 135 bp, Zea mays
  misc_feature: Ceres CLONE 272706-F
aacacgcacaccgcgacccagtccagagccagtacgtgcgamrgcacgcacgctgctggtccgcgtacsagacgacggtcaggtcggccggtgcttttctagtttggaataatgacggcgacgacgacgacagcc

SEQ ID NO: 2290 - DNA, 373 bp, Zea mays
  misc_feature: Ceres CLONE 272718-F
  misc_feature: Encodes the peptide sequence at SEQ ID NO. 2291
  misc_feature (242)..(242): n is a, c, t, g, unknown, or other
  misc_feature (267)..(267): n is a, c, t, g, unknown, or other
  misc_feature (285)..(285): n is a, c, t, g, unknown, or other
  misc_feature (327)..(327): n is a, c, t, g, unknown, or other
aygatcacacaccactccacagcagtagcaagagggatagagcaaggccacacacacacacacaccactaggctaggttagccttttaatcgtcgtcgagaagcaagaagggcgcgcacsaagcaggcaagcaagaagagagccgatcgaccgagagctagcacgcgatggcgaggtcttccaagatgatggtggcggcastctgctggccttggcctggccgtgtcgaccgccgaggcgangaacatcaagaccacgacgacgganaagaaggacgacgcggtngtgcascgcagaccttcccgcccttcgaccgcctcggcgcgncgcgtccccggcgttcggcggcctccccggcggcacattcctggca

SEQ ID NO: 2291 - protein, 68 aa, Zea mays
  misc_feature: Ceres CLONE 272718-F
  misc_feature (12)..(12): Xaa is any aa, unknown, or other
  misc_feature (25)..(25): Xaa is any aa, unknown, or other
  misc_feature (34)..(34): Xaa is any aa, unknown, or other
  misc_feature (40)..(40): Xaa is any aa, unknown, or other
  misc_feature (42)..(42): Xaa is any aa, unknown, or other
  misc_feature (54)..(54): Xaa is any aa, unknown, or other
MARSSKMMVAAXCWPWPGRVDRRGXEHQDHDDGXEGRRGXAXQTFPPFDRLGAXRPRRSAASPAAHSW

SEQ ID NO: 2292 - DNA, 493 bp, Zea mays
  misc_feature: Ceres CLONE 272719-F
  misc_feature: Encodes the peptide sequence at SEQ ID NO. 2293
ccctgggggaccagctgggagagcccccccgtcagccccctcctcctcctggtctcctctcttctatccgagctcggcattcagggctactacacctgcttacatccatcgttcatgcatggtgcatacaatggtatgcgcatatgcactgcattgttcgttcaaaataaataagtagaccatgcaactgctacatacacagtggaaaggtttttgatcgagaggcaacgcaattgcaatggtgatcaggatacaagcagggtgtgctcgaggtcgatcgtgcatcatggccgcatgcatgcatgggagatgcagcaggcgttggcgtcgtctgtcgccacagcttggatagcggaaccaaaaataagggtcatgtggctagcagcttctgtttattttcactttcttcgttcatcgcatgctcttgttgttcactgttgtactatctagtagttctctttatctggtgcttccaatctaactagaataagtg

SEQ ID NO: 2293 - protein, 60 aa, Zea mays
  misc_feature: Ceres CLONE 272719-F
MGDAAGVGVVCRHSLDSGTKNKGHVASSFCLFSLSSFIACSCCSLLYYLVVLFIWCFQSN

SEQ ID NO: 2294 - DNA, 179 bp, Zea mays
  misc_feature: Ceres CLONE 272733-F
  misc_feature (96)..(96): n is a, c, t, g, unknown, or other
aacaccaagaaagaatcacacaacagcagctcaaaaacctaacacacctcaacaagcagagcaaagaccgggattcgccggcgcggtavagagcrngagatggacgggaggatgttcggtctcgagacccccctgatggtggcgctgcagcaccttctggacgtgcccgacggcgacgc

SEQ ID NO: 2295 - DNA, 616 bp, Zea mays
  misc_feature: Ceres CLONE 272738-R
ccaattgggtaccgggccccccctcgaggtcgacggtatcgataagcttttttttttttttttttgcgactctgacaagcctgcgtgaatgttcatggtgcgtacgatcctccaaggcaaagtacagagttcttgcggccggaactagctattaactcacacggctacatgccctcatgacgttactgctacaaaatcctgatttcgaaatatatagcacaggtgctagacgcatacattcaggggattaccacggtgacgataatgcccccgacgttatttaggttacatgatccgatgctggtccctacccgggagcgtgatcttcgccgacgaccgcaagggaaataaaatattcaacccttaacccaaaaatcttcctgatcgcaaaactaaacgacgcgcttaatctgatcctgatgagcgatgacggcctgtctgttaagcacgtcggggcactatgcgcgtgctcacggggacgatgctatgtgtatcttcactgatgcgacagactcgtgaaacgtaaaccgctgccgactgcgatgtcggacccctggccaacgtaaaaccccaacccccccggtggaattccccccgcggaaaaaaaaacaaaaat

SEQ ID NO: 2296 - DNA, 172 bp, Zea mays
  misc_feature: Ceres CLONE 272748-F
atacaagttcatcctagaagcaagcacaagcactgcaccgaacgagcagcgagcgtgttgaggcaggcagtcagtggcagtgggagtaggagacaaggctaccgagatgaagggcctcttgttgctcgtcctcgccctggtcgcgtccgctgcatgcctggtgaccgtccgc

SEQ ID NO: 2297 - DNA, 410 bp, Zea mays
  misc_feature: Ceres CLONE 272782-F
  misc_feature: Encodes the peptide sequence at SEQ ID NO. 2298
  misc_feature (26)..(26): n is a, c, t, g, unknown, or other
  misc_feature (78)..(78): n is a, c, t, g, unknown, or other
  misc_feature (79)..(79): n is a, c, t, g, unknown, or other
catttccactttcgagcgcagaaacngagggcaggagcagccgcagtcccggcgatcccgccgccggtcgccctcatnnttcctcgtcactgccttcgtttcwctttccaacaatcaagatgagccdtggcgyatacgcgggtggtggtcaaagttctctgggttacctctttggaagcggtgagccccccaaaccagcagtggcaccagctgtaagtgctccacctgctgctgcagtctcccacctstgagaaaccacctgctgcaaasctgatggcaccagtcagattgctggctggggttaccagccaaaccaataactaccacagggccgacggtcagaacaccggcaacttccttacgggaccgcccttcgaccaaggtccacgctgctcctggcggtggctctt

SEQ ID NO: 2298 - protein, 43 aa, Zea mays
  misc_feature: Ceres CLONE 272782-F
  misc_feature (3)..(3): Xaa is any aa, unknown, or other
  misc_feature (5)..(5): Xaa is any aa, unknown, or other
MSXGXYAGGGQSSLGYLFGSGEPPKPAVAPAVSAPPAAAVSHL

SEQ ID NO: 2299 - DNA, 275 bp, Zea mays
  misc_feature: Ceres CLONE 272786-F
  misc_feature: Encodes the peptide sequence at SEQ ID NO. 2300
  misc_feature (48)..(48): n is a, c, t, g, unknown, or other
  misc_feature (219)..(219): n is a, c, t, g, unknown, or other
aatccgtatcatcatcttggcctcgtcaatccaccaccaccgtcgtynctgagctcctcctccggcttcgcttcgcttcgctgtcttgcctcctcctcggtcgaagaagaagaagaaaacatgtgtccgggatccgtggagtcgtcgtcggcggcggcggcgggcaagagcgtgtgcgtgatggacgccgcggggccgctgggccacgcytccgttggnaccgcctcctccggcgcgggtacacagtccacgccgccacgtacgcctcgcgacgg

SEQ ID NO: 2300 - protein, 51 aa, Zea mays
  misc_feature: Ceres CLONE 272786-F
MCPGSVESSSAAAAGKSVCVMDAAGPLGHASVGTASSGAGTQSTPPRTPRD

SEQ ID NO: 2301 - DNA, 175 bp, Zea mays
  misc_feature: Ceres CLONE 272791-F
  misc_feature (107)..(107): n is a, c, t, g, unknown, or other
gaggctttatttatcgtttatccacggaacttccggtgccggcggcgaccacttgtgcgatccatccctcaccatgtcgtcggagaaggaggcggcgctcgcgcggnccttcgatgacagcccaaccatatttgacaagatcatcaaaaagggaaataccttctactgtggttta

SEQ ID NO: 2302 - DNA, 196 bp, Zea mays
  misc_feature: Ceres CLONE 272805-F
  misc_feature (44)..(44): n is a, c, t, g, unknown, or other
attcattcatcactcaccagtcaccaccactgccgcgaccgtanagagtcagagagagcaggcggcgggcaatggctggcgctggggacgagtactactacggcgggccgggccagcgcggcgcscccacggcctgctgctggcggtggtggtgggcctcgtggtggcgggcccgctgttcctgggcggcggcggc

SEQ ID NO: 2303 - DNA, 501 bp, Zea mays
  misc_feature: Ceres CLONE 272806-F
  misc_feature: Pfam Name: PsbR Pfam Description: Photosystem II 10 kDa polypeptide PsbR
atattggctagcttttggctcggcagctaacgacctgcagccaaccatctaccagcgactcagcgagcgagasagcacacacgcagctagctaggagcagcagcagagcagcgcgatggcggcctccatgatctcctcgtcagctctggcgggtggcgcctcagggcctgccgcccctcggccgccgcgcctcctccttcgccgtcgtctgctccaagaagaacatcaagaccgacaagccctacggattgggggtggcctgaccgtcgacgtcgasccaacgggagaaatggcaagggcaagggcgtgtaccagttcgtcgacaagtacggcgcgaacgtcgacggatacagcccaatctacaacgaggatgactggtctcccaccggcgacgtctacgtsgttggaacactgggcttctgatctgggccgtcaccctcgctgggatcctcggcggcggcgcctcctcgtyttacaacaccagcgccctctccggctaaa

SEQ ID NO: 2304 - DNA, 243 bp, Zea mays
  misc_feature: Ceres CLONE 272829-F
  misc_feature: Encodes the peptide sequence at SEQ ID NO. 2305
  misc_feature (95)..(95): n is a, c, t, g, unknown, or other
accaagaaagaatcacacaacagcagctcaaaaacctaacacacctcaacaagcagagcaaagacccgggattcgccggcgcggtasagagcgangagatggacgggaggatgttcggtctcgagacccccctgatggtggcgctccagcaccttctggacgtgcccgacggcgacgcgccgggkcggcacaaggcgagtggtgccgcggcgggcgcgggcccacgcgcacctacgtccgcga

SEQ ID NO: 2305 - protein, 48 aa, Zea mays
  misc_feature: Ceres CLONE 272829-F
MDGRMFGLETPLMVALQHLLDVPDGDAPGRHKASGAAAGAGPRAPTSA

SEQ ID NO: 2306 - DNA, 210 bp, Zea mays
  misc_feature: Ceres CLONE 272846-F
  misc_feature: Encodes the peptide sequence at SEQ ID NO. 2307
  misc_feature (139)..(139): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcgtggcgcaaggccggcgggcgancgaagaagtcggtgtcgcggtcctccagggccgggctgcagttccccgtcagccgcgtcgggcgtacctca

SEQ ID NO: 2307 - protein, 70 aa, Zea mays
  misc_feature: Ceres CLONE 272846-F
  misc_feature (47)..(47): Xaa is any aa, unknown, or other
THTFRLSTPKVPFFFSIWKRRSSSHGRERTGGKAKKGAAWRKAGGRXKKSVSRSSRAGLQFPVSRVGRTS

SEQ ID NO: 2308 - DNA, 219 bp, Zea mays
  misc_feature: Ceres CLONE 272860-F
  misc_feature: Encodes the peptide sequence at SEQ ID NO. 2309
accaagaaagaatcacacaacagcagctcaaaaacctaacacacctcaacaagcagagcaaagacccgggattcgccggcgcggtasagagcgagagatggacgggaggatgttcggtctcgagacccccctgatggtggcgctgcagcaccttctggacgtgcccgacggcgacgcsgccgggcggcgacaaggcgagtggtgccgcggcgggcgcgg

SEQ ID NO: 2309 - protein, 40 aa, Zea mays
  misc_feature: Ceres CLONE 272860-F
MDGRMFGLETPLMVALQHLLDVPDGDAAGRRQGEWCRGGR

SEQ ID NO: 2310 - DNA, 316 bp, Zea mays
  misc_feature: Ceres CLONE 272905-F
  misc_feature: Encodes the peptide sequence at SEQ ID NO. 2311
aakatcagaaccaaactcggctcgagagagatcgcatacgcctgcytgcccacccacctccccttttccttcctcttcgccccagckacgcggccgcccggagaccgagcgaggcaggcaactaaccaccgagagcagggacaggaacaggaagccggavdaagatgtcgtcggtgttcagcggcgatgagacggcccccttcttcggcttcctcggcgccgcsccgccctcgtcttctcatgcatgggcgccgcgtacgggaccgcgaagagcggcgttcggcgtggcgtcgatgggtgtgatgcggccggagct

SEQ ID NO: 2311 - protein, 50 aa, Zea mays
  misc_feature: Ceres CLONE 272905-F
  misc_feature: SWISSPROT Homolog: EC 3.6.3.14 H(+)-transporting two-sector ATPase
MSSVFSGDETAPFFGFLGAAPPSSSHAWAPRTGPRRAAFGVASMGVMRPE

SEQ ID NO: 2312 - DNA, 178 bp, Zea mays
  misc_feature: Ceres CLONE 272920-F
  misc_feature (118)..(118): n is a, c, t, g, unknown, or other
aggttttcttcggaggctttatttatcgtttatccacggaacttccggtgccggcgsgaccacttgtggcgatccatccctcaccatgtcgtcggagaaggaggcggcgctcgcgggncctcgatgacaggcccaaccatatttgacaagatcatcaaaaaggaaataccttctactg

SEQ ID NO: 2313 - DNA, 207 bp, Zea mays
  misc_feature: Ceres CLONE 272925-F
  misc_feature (116)..(116): n is a, c, t, g, unknown, or other
gaaagagacgaccgccgccgcatcggaccgtgcccgaaccccccttctcctcgctgactcggctcccctcctccgccgtcgccggasrcaagtggggaccaagaagcattagctgngtgaacccactcaaagggggcagggaattgtgtgctagtttraatggctgctacaaagcttcaggccctttggaaccacccggctggcccc

SEQ ID NO: 2314 - DNA, 403 bp, Zea mays
  misc_feature: Ceres CLONE 272926-F
  misc_feature: Encodes the peptide sequence at SEQ ID NO. 2315
  misc_feature (288)..(288): n is a, c, t, g, unknown, or other
accccccattcgaacgccggagctcgacaaggacgaccgacgacgcacgcggagatccggcgtactgcaaattttgaaaactgaactgtaagatggcatcagcagagctttcccgtgagaaaatgtgtacatggcgavtcgctgagcaggcggagaggtacgaggagatggttgagttcatggagaaggtagccaagactgttgactcggaggagctcactgtggaggagcgaaacctcttgtctgttgcatacaagaacgtcattkgagcccgccgcgcctcatggnrtcatctcctccatcgagcagaatgaggagggccsaggcaatataggaccgagtaacactcatcaaggattatcgtggcaagattkagactgagctgaccaagatctstgatggc

SEQ ID NO: 2315 - protein, 73 aa, Zea mays
  misc_feature: Ceres CLONE 272926-F
  misc_feature (16)..(16): Xaa is any aa, unknown, or other
  misc_feature (59)..(59): Xaa is any aa, unknown, or other
  misc_feature (66)..(66): Xaa is any aa, unknown, or other
MASAELSREKMCTWRXAEQAERYEEMVEFMEKVAKTVDSEELTVEERNLLSVAYKNVIXARRASWXHLLHRAE

SEQ ID NO: 2316 - DNA, 405 bp, Zea mays
  misc_feature: Ceres CLONE 273004-F
  misc_feature (65)..(65): n is a, c, t, g, unknown, or other
  misc_feature (212)..(212): n is a, c, t, g, unknown, or other
atcttgctctgaacgcattcctcccatctcccaagacctcctcagacccgagaagcgcmkgcggnccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaanaagggccgctacgscascgtcggcagcggtgcccccgtctacctcgcggccgtcctggagtacctcgccgctgaggtcctggagctcgccggcaacgcttkccaaggacaacaagaagacgcgcatcgtcccgcgccacgtgctgctggcgatccggcaacgacgaggagctcgggaasctgctgaccggcgt

SEQ ID NO: 2317 - DNA, 674 bp, Zea mays
  misc_feature: Ceres CLONE 273015
  misc_feature: Encodes the peptide sequence at SEQ ID NO. 2318
agcagcagaagcaaaccgagaggtgaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcctcgcctactacctgcactaagcggacggacggacggacgcgcgcatggcattggcatgcatggactgttgaacatctatgcatgcatggacgacgtcacttgcaacgctgttcccatatagtactactggtctgctatgaatatctatgcatgcatggtaacgggttgtgttatttaattattattattacgtagacattactatttaaaattcatgtgttcgcgtcaagtcgttctgtaatcttgtgatggaatatatatgatatttccttttaaaatcaaaaaaaaaaaaaaaa

SEQ ID NO: 2318 - protein, 88 aa, Zea mays
  misc_feature: Ceres CLONE 273015
MEMIKRILIAALLVVAVSATAVLASTEAAAAGAPAASESSASAEAPAGAAGAGAGTGTAAGPSASGAAPALAAAPAALLFSLLAYYLH

SEQ ID NO: 2319 - DNA, 686 bp, Zea mays
  misc_feature: Ceres CLONE 273024
  misc_feature: Encodes the peptide sequence at SEQ ID NO. 2320
aaaaacacaacgcggcaaacggctaatgctccttcctgtcaccatggccgtccacaccaccacctcctcctcacatcccctcctcttcctctatcgcggcaccgcaaaccctagccccgcggttatctccttgccttcttctctccgtggcgtgtctctccgctcccgggccaccgccgcaccgcccgcagagaccctctctgacgacggcatccctgacgcgccaccggaaggggagggaacgggaattccgttgccatcgtcgattggggatgatggggagcagctcgcacccaagcagaagatcagaatcaagctgcggtcctactgggtgccgttgatagaggactcatgcaagaagataattgaagctgcccaaacaaccaacgcaaagaccatgggtcctgttcctctgcccactaagcggagagtctattgtgtgctcaactctcctcacgtgcacaaggattcacggttccattttgagatccggacgcatcagcggctgattgatatcatgtatccaactgcccaaacaattgattcattgatgcaactccagctccctgccggtgtggatgttgaggttaagctatgattctgttggagctaaacttttccaagtttgatgtaatgtggtactcattttctgcagcttttcttcttgatcaaaaaaaaaaaaaaaa

SEQ ID NO: 2320 - protein, 190 aa, Zea mays
  misc_feature: Ceres CLONE 273024
  misc_feature (93)..(188): Pfam Name: Ribosomal_S10 Pfam Description: Ribosomal protein S10p/S20e
MLLPVTMAVHTTTSSSHPLLFLYRGTANPSPAVISLPSSLRGVSLRSRATAAPPAETLSDDGIPDAPPEGEGTGIPLPSSIGDDGEQLAPKQKIRIKLRSYWVPLIEDSCKKIIEAAQTTNAKTMGPVPLPTKRRVYCVLNSPHVHKDSRFHFEIRTHQRLIDIMYPTAQTIDSLMQLQLPAGVDVEVKL

SEQ ID NO: 2321 - DNA, 199 bp, Zea mays
  misc_feature: Ceres CLONE 273038-F
  misc_feature: Encodes the peptide sequence at SEQ ID NO. 2322
aagccgtgacgagttccggtcgagcgaggagcaaccaacaacatggcactctcgtttaggctggtcgccggckttcttctggtcctggcattagctctgctctcttcgagcgcggaggagaggagcgccgggysctgccactgtcagcsattgggctcagatcacgatcagacgtcggaagctccggtgccgccgttga

SEQ ID NO: 2322 - protein, 52 aa, Zea mays
  misc_feature: Ceres CLONE 273038-F
  misc_feature (11)..(11): Xaa is any aa, unknown, or other
  misc_feature (31)..(31): Xaa is any aa, unknown, or other
  misc_feature (36)..(36): Xaa is any aa, unknown, or other
MALSFRLVAGXLLVLALALLSSSAEERSAGXCHCQXLGSDHDQTSEAPVPPL

SEQ ID NO: 2323 - DNA, 428 bp, Zea mays
  misc_feature: Ceres CLONE 273064-F
  misc_feature: Translation starting site: 73
  misc_feature (20)..(20): n is a, c, t, g, unknown, or other
  misc_feature (329)..(329): n is a, c, t, g, unknown, or other
agattagcaggccgcctgcnctcctcctttcccctcagcctcccctcctctccggtgtacgtctccgccgagatggccgccccgctccggcgactccccctcccttggtcgcgcgcttytcacgccggcgccggccggatgctctccgcggaggcctctgatgccctcgttgagatcaagcccggggagatcgggatggtctccggcatccctgaggagcatctccgccgtaagttctaatttattcaccagctaggactgcatcccagcaaggttcaggcaaagtcgggaggtggaaaattaattttttgtcaacccaaaagtggganaacccgttgatgggatggacatctactggggatccatatgctaatgtcggtgaagcaggacttacgttttgacagtgcagaktcagcaaaggcgtttgc

SEQ ID NO: 2324 - DNA, 390 bp, Zea mays
  misc_feature: Ceres CLONE 273086-F
  misc_feature: Encodes the peptide sequence at SEQ ID NO. 2325
  misc_feature (132)..(132): n is a, c, t, g, unknown, or other
agatatctccgcgtacgcaaackcgacgsaaggtcagcacggacaactctacccctccgcctcgaccctgaccccccacctcgtcggcgatgagttcctcttccaacggcgggaagaagccggctcccgggncggccgcaggggtcccgccatccgcacgctcgctgacataagccgtgggcccaccggcttcccaggtgccggasggcgacasggcassaccgacgacgagccacaggaatactacaccggtggcgagaagagtggaatgcttgttcaagatccaacaagaagaaatgattgttggatgcgatatttgaacaagccagacaagcgggtatcaaaggaatgcctcctcctctttgatggcgaktctttccagctctagga

SEQ ID NO: 2325 - protein, 128 aa, Zea mays
  misc_feature: Ceres CLONE 273086-F
  misc_feature (8)..(8): Xaa is any aa, unknown, or other
  misc_feature (10)..(10): Xaa is any aa, unknown, or other
  misc_feature (44)..(44): Xaa is any aa, unknown, or other
  misc_feature (69)..(69): Xaa is any aa, unknown, or other
  misc_feature (71)..(71): Xaa is any aa, unknown, or other
  misc_feature (73)..(73): Xaa is any aa, unknown, or other
  misc_feature (124)..(124): Xaa is any aa, unknown, or other
DISAYANXTXGQHGQLYPSASTLTPHLVGDEFLFQRREEAGSRXGRRGPAIRTLADISRGPTGFPGAGXRXGXTDDEPQEYYTGGEKSGMLVQDPTRRNDCWMRYLNKPDKRVSKECLLLFDGXSFQL

SEQ ID NO: 2326 - DNA, 245 bp, Zea mays
  misc_feature: Ceres CLONE 273087-F
  misc_feature: Encodes the peptide sequence at SEQ ID NO. 2327
  misc_feature (184)..(184): n is a, c, t, g, unknown, or other
  misc_feature (193)..(193): n is a, c, t, g, unknown, or other
atcgcagaaattctccgcaacttcacagcgtatcatcgttttccatcgctcctactcctatcatccagaaaatctgagcggtattgatggcgcccaaggcggagaagaagccggcggcaagaaggtggcggaggaggagccctcggagaaggcggctccggcggagaaggcccccgcggttaanaaggccaangcggagaagcggctacctgcgggcaagtccgccggcaagagggcggcgacaa

SEQ ID NO: 2327 - protein, 81 aa, Zea mays
  misc_feature: Ceres CLONE 273087-F
  misc_feature (61)..(61): Xaa is any aa, unknown, or other
  misc_feature (64)..(64): Xaa is any aa, unknown, or other
SQKFSATSQRIIVFHRSYSYHPENLSGIDGAQGGEEAGGKKVAEEEPSEKAAPAEKAPAVXKAXAEKRLPAGKSAGKRAAT

SEQ ID NO: 2328 - DNA, 111 bp, Zea mays
  misc_feature: Ceres CLONE 273124-F
acacgcacaccgcgacccagtccagagccagtacgtgcgamggcacgcacgctgctggtccgcgtacsagacgacggtcaggtcggccggtgcttttcagtttggaataat

SEQ ID NO: 2329 - DNA, 333 bp, Zea mays
  misc_feature: Ceres CLONE 273126-F
  misc_feature: Translation starting site: 108
  misc_feature (154)..(154): n is a, c, t, g, unknown, or other
cagtctcctctagccgtctcgcgcgcttcaccttccccaccccgccgccgccatcgcacgcccgcagccgcatccgctatgggtgcgtacaagtacgtctcggagctatggcgaggaagcagtccgatgtgatgcggttcgtgcagcgcgtgcnkgggagtacaggcagcagcggccatcgtccgcctcacaaggcccactcgccctgacaagcgcgccgctcgggctacaaggccaagcagggttatgttgtttaccgtgtccgtgttaggcgtggtggcaggaagaggcctgtgcctaaagggtattgtctatggcaagccaaaggcacca

SEQ ID NO: 2330 - DNA, 224 bp, Zea mays
  misc_feature: Ceres CLONE 273137-F
  misc_feature: Encodes the peptide sequence at SEQ ID NO. 2331
actcatacatttcgactctcaactcccaaggtcccttttttttctcgatctggaagcgccgcagtagcagccatggacgtgagcggasaggcgggaaggcgaagaagggcgcggccggtkytgctaaggycggcgggcgagcgaagaagtcggtgtcgcggtcctccagggccgggctgcagttccccgtcagccgcgtcgggcgtgacctcaaaaagggccgg

SEQ ID NO: 2331 - protein, 74 aa, Zea mays
  misc_feature: Ceres CLONE 273137-F
  misc_feature (29)..(29): Xaa is any aa, unknown, or other
  misc_feature (40)..(40): Xaa is any aa, unknown, or other
  misc_feature (43)..(43): Xaa is any aa, unknown, or other
SYISTLNSQGPFFFSIWKRRSSSHGRERXGGKAKKGAAGXAKXGGRAKKSVSRSSRAGLQFPVSRVGRDLKKGR

SEQ ID NO: 2332 - DNA, 454 bp, Zea mays
  misc_feature: Ceres CLONE 273153-F
  misc_feature (138)..(138): n is a, c, t, g, unknown, or other
  misc_feature (420)..(420): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctgcagttccccgtcagccgcgtcgggcgtacctcaaaaagggccggtacgcgcrgttaggcacgggtgcccccgtctacctcgccgccgtcctggagtacctcgcggccgagtgctcgagctcgccggcaacgcggcaaggggacaacaagaagacgcgcatcatcccgcgccacgtgctcctcgccatccgcaacgacgaggagctcggcaagctgctttccggcgtcaccatcgcccacggcgncgtcctccccaacatccacactgtgctcctcccc

SEQ ID NO: 2333 - DNA, 471 bp, Zea mays
  misc_feature: Ceres CLONE 273186-F
  misc_feature (74)..(74): n is a, c, t, g, unknown, or other
acagccctacaacttactgcttgctctagctagctagctgctcccggcccatatccactacacaagtaggctancatgcagcagcagcaatggcctcggtgacgrttcccggccgtggcctcgtcctgctgctcgccgccagcgccttcctggccagcgaggtggcggcgtgcggcgctgcccgaaaccaactcctcctcctccatcgccaccaccgccgtcgcccaccagcacgccgtscctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgcgacctggaggccgccgtctgcctctgcaccgcgctcaaggccaacgtgctcggcatcaacctcgacgtccccgtcaagctcaccctgct

SEQ ID NO: 2334 - DNA, 439 bp, Zea mays
  misc_feature: Ceres CLONE 273246-F
  misc_feature (276)..(276): n is a, c, t, g, unknown, or other
cccgagccgccaaaaccctaccgccgccgcgaatcccgcacgaccccaaccatgaccgtgctgagccgccctaccccgggcacgcccagtgcttcgggcggaagaagaccgccgtcgcgtcgcggtacacgaagccgggacgcggcctgatcaaggtgaacggcgtcccgattgakctgatccgaccggagatgctccgcctcaaggccttcgagcccatcctgctggcggggcggtcccggttcaaggacatcgacatgcggatccgcgtccgsncgggcggaagacgtcgcagatctacgccatccgccagccgtcgccaaggggctcgtcgcctactaccagaagtacgtcgacgaggccgccaagaaggagatcaaggacatctttacccgctacgatcgcaccctcctcgtcgctgacccccggcgctgcgagc

SEQ ID NO: 2335 - DNA, 94 bp, Zea mays
  misc_feature: Ceres CLONE 273267-F
awaccctagtgcttcccaccgatccatttcagccgccgccgcgcgttasaagcaggagcagcaaggatgccggctggccacgggctgcgctcgc

SEQ ID NO: 2336 - DNA, 169 bp, Zea mays
  misc_feature: Ceres CLONE 273276-F
  misc_feature: Encodes the peptide sequence at SEQ ID NO. 2337
aacattttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgca

SEQ ID NO: 2337 - protein, 56 aa, Zea mays
  misc_feature: Ceres CLONE 273276-F
TFYLLYRYSKSTQSPSHGHLSHCRGRLVRFLGSKKPPAAVPPEGRNVHRRPAGARA

SEQ ID NO: 2338 - DNA, 486 bp, Zea mays
  misc_feature: Ceres CLONE 273315-F
  misc_feature: Pfam Name: potato_inhibit Pfam Description: Potato inhibitor I family
acacaaagaagctccataattaattattgccctttcagttcgccatcgsagccgagcaccatgagctccacaggcggcggcgacgatggcgcaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaataaattgctagtaaaaataatggcatcgtcggtatgcatgaataaaatgtatcagaatgttcatcctttcacgattggatatatgaaaattggatatatgaaaatgtgctcagttgtttggttt

SEQ ID NO: 2339 - DNA, 112 bp, Zea mays
  misc_feature: Ceres CLONE 273362-F
aacacgcacaccgcgacccagtccagagccagtacgtgcgamggcacgcacgctgctggtccgcgtacgagacgacggtcaggtcggccggtgcttttcagtttggaataat

SEQ ID NO: 2340 - DNA, 387 bp, Zea mays
  misc_feature: Ceres CLONE 273387-F
atctcaagccaccatcgaccttcaagtctcgctacgtagcagtgcaataaaaaaagcagccgcaatggcgagcagcaccatggccctctcctccacggccttcgcsgcaaggccgtgaacgtgccgtcgtcgtccgccttcggagggcccgcgtgacgatgcgcaagaytggcggcgaaggcaagccagcgggtcgtccgggagcccgtggtacggccccgaccgcgtgctgtacctgggcccactgtccggcgagccaccgagctacctgacgggcgatttcccgggcgactacggctgggacaccgcgggggctgtcgggcggacccggagacgttcgccaagaaccgggagctgggaggtgatccactcccgctgggccatgct

SEQ ID NO: 2341 - DNA, 193 bp, Zea mays
  misc_feature: Ceres CLONE 273412-F
  misc_feature (136)..(136): n is a, c, t, g, unknown, or other
aacaacaccagaatccgcgaatcacagacgcgtctatctcagcttgctgcactgcactaccctgccctgccatcatatcgtacgtkagcccggccgagcgagasmgggatgaggcatggctgctccgaagctcgcnacgctggcgctggccgtgctcctggcggcgaccgtggtggctcccccggccgcggtg

SEQ ID NO: 2342 - DNA, 764 bp, Zea mays
  misc_feature: Ceres CLONE 273461
  misc_feature: Encodes the peptide sequence at SEQ ID NO. 2343
agcgatcgcagagagttgcgcccggaccccggaccgcgccggctcgcaaactccccacaaccctcgtcgccgccggctgctccacccccgccaccgccatgggtaaattccgcaagcttggccgcaattactcccaacgcctctgcatgctcaggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcggggtgatgatgtcgttcataagctatttactgagctggccttccgctacaggcaatgtggcataaggagaacaactgtagtacaatatttaatagatcgagctgggggctacacaagaatgttaagaaccaggatacgtgttggtgatgctgctccaatggcatacatcgagttcgtggatagggagaatgagcttcgagaggccaaacctgcaacgccgccgcctcctcaacgagtccctcttgatccatgggccaagtcacgtgctagccaacagtgggcaggacctaaaatcaccaagacctcggaatcggacggcttatgagctagtatacctatgttccatagaaagtttcagttattttgcttaagagatttttttatctagagataactaccgatagaataattcaaactttattgtcattttgtatgcttctaattcacaaaaaaaaaaaaaaaa

SEQ ID NO: 2343 - protein, 175 aa, Zea mays
  misc_feature: Ceres CLONE 273461
  misc_feature (17)..(127): Pfam Name: Ribosomal_L17 Pfam Description: Ribosomal protein L17
MGKFRKLGRNYSQRLCMLRTMVSQLVKHERIETTVAKAKEVRRKADQMVQLGKEGTQHAARRAAAFVRGDDVVHKLFTELAFRYRQCGIRRTTVVQYLIDRAGGYTRMLRTRIRVGDAAPMAYIEFVDRENELREAKPATPPPPQRVPLDPWAKSRASQQWAGPKITKTSESDGL

SEQ ID NO: 2344 - DNA, 314 bp, Zea mays
  misc_feature: Ceres CLONE 273467-F
  misc_feature: Encodes the peptide sequence at SEQ ID NO. 2345
aaccgttctctgccttctccatcctaaaccctcctagtcctctccatccccatcccctccaatggcggcgactgcacgtccttcgccactctcgccgtcgcgcgctcggggggcagcggtccctccttgcctccaaggccgccccctcgccgctcctctccctccgcggcgcccgcctcccctcgcagggcgtctccttatctgggggcctcgcggcgtcgcctctcatagccgcgcgcgcttcgccacatcagccagcgccgagcccaaggaagcaggaccttcagtctaaaatyacaaacaaaggtgtactt

SEQ ID NO: 2345 - protein, 104 aa, Zea mays
  misc_feature: Ceres CLONE 273467-F
PFSAFSILNPPSPLHPHPLQWRRLHVLRHSRRRALGGQRSLLASKAAPSPLLSLRGARLPSQGVSLSGGLAASPLIAARASPHQPAPSPRKQDLQSKITNKGVL

SEQ ID NO: 2346 - DNA, 252 bp, Zea mays
  misc_feature: Ceres CLONE 273498-F
  misc_feature: Encodes the peptide sequence at SEQ ID NO. 2347
acaacaccagaatccgcgaatcacagacgcgtctatctcagcttgctgcactgcactaccctgccctgccatcatatcgtacgtgagcccggccgagcgagavgggatgaggcatggctgctccgaagctcgcgacgctggcgctggccgtgctcctggcggcgaccgtggtggctcccccggccgcggtgscgcgsgaattktcgtgctccaccgtgtacagcacgctgatgccgtgcctgccgttcgtcc

SEQ ID NO: 2347 - protein, 46 aa, Zea mays
  misc_feature: Ceres CLONE 273498-F
  misc_feature (27)..(27): Xaa is any aa, unknown, or other
  misc_feature (30)..(30): Xaa is any aa, unknown, or other
MAAPKLATLALAVLLAATVVAPPAAVXREXSCSTVYSTLMPCLPFV

SEQ ID NO: 2348 - DNA, 324 bp, Zea mays
  misc_feature: Ceres CLONE 273511-F
  misc_feature: Encodes the peptide sequence at SEQ ID NO. 2349
  misc_feature (276)..(276): n is a, c, t, g, unknown, or other
aagacctcgacatataagctaacgatcagcagaacacgtgctacatcgaatactttcctccaaaacagcatcacgtagcaaatggcagatgcagttttgttcagcaggaaggcgtcggcttcagcggccgtcgtcgtcctcgcggtastggtgacaatggcgtgccttgcggctccggtcgccgcgctggtaccgtacgggcgccctggtggcgggctgtgggacctgatgctcctcgacgacccattccgggtgctggagcagtcgccgctggsnttccatcggtgcccagagccagcctcgactctacgtcggcggccgggg

SEQ ID NO: 2349 - protein, 81 aa, Zea mays
  misc_feature: Ceres CLONE 273511-F
  misc_feature (23)..(23): Xaa is any aa, unknown, or other
  misc_feature (65)..(65): Xaa is any aa, unknown, or other
MADAVLFSRKASASAAVVVLAVXVTMACLAAPVAALVPYGRPGGGLWDLMLLDDPFRVLEQSPLXFHRCPEPASTLRRRPG

SEQ ID NO: 2350 - DNA, 643 bp, Zea mays
  misc_feature: Ceres CLONE 273530-R
  misc_feature: Pfam Name: hATC Pfam Description: hAT family dimerisation domain
ccgattgggtaccgggccccccctcgaggtcgacggtatcgataagctttttttttttttttttttttttttttttttttttaaagcgcacggaaccaaagatcagcttaaaccacaacgtattgaaaaaccaaaacgtagttttcgatacaatacatcataagtcaagtggaacgaggcacatacaaagcttctaatgaaaaactaaagattacaacggcatcagccatacgatgatcactatcatagtcaacaagatgataatgagaatcaacaaggtgtgaagacgatcccgtccgccatggctccactatgacacaacctggatgcggatatgatcctactcgaaatcctctggcatgaagtcgggatcctcaaaatgacgaaatctagtaaacttgaacaagtagtaatccaatggccttttaatcaatatcgtatcttcgttcactcatttttatgaactgatcaaccacagctccatttgtcactttcatcatctcttctttttccacatagccaataagcatattactcaggtgctcatctccgatgcgattgcgcaaataagttttcacaactttcatcgctgagaagcatctctcaactgtggcagtagcaactggtaatactagtacaagct

SEQ ID NO: 2351 - DNA, 347 bp, Zea mays
  misc_feature: Ceres CLONE 273542-F
  misc_feature: Encodes the peptide sequence at SEQ ID NO. 2352
  misc_feature (37)..(37): n is a, c, t, g, unknown, or other
  misc_feature (110)..(110): n is a, c, t, g, unknown, or other
atgctttacacgctctccctcccacttcgtgcgagcntcccgaactaagttgctcgtggtggaggtggtttgtggcgatggccttcaagctggtcaccaagcccgcgggncgtcgccgctgctgctcactggggagatctcgcccgggggccgcaggtacgagccgcgttgccttcggaccagcgcccaggaacaaggggctccgcacggccaacaactccgcaacgcccatggctaaggaagagaggggttgatcgaagtgaaatattgacattggatagcatcagacaagttttttgattagactagaagacagcatcatatttggacttttggagagagcacag

SEQ ID NO: 2352 - protein, 58 aa, Zea mays
  misc_feature: Ceres CLONE 273542-F
MAFKLVTKPAGRRRCCSLGRSRPGAAGTSRVAFGPAPRNKGLRTANNSATPMAKEERG

SEQ ID NO: 2353 - DNA, 459 bp, Zea mays
  misc_feature: Ceres CLONE 273559-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccggccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtg

SEQ ID NO: 2354 - DNA, 413 bp, Zea mays
  misc_feature: Ceres CLONE 273575-F
  misc_feature: Encodes the peptide sequence at SEQ ID NO. 2355
attcacgcacctagggttttcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtttttctgtaagctagcaagtgttgctatgacgcttttattaagattctggtgagcggtgatgttaagagaaaattggcactactgtggtgtaccccaagattccttgcagcattgctcacca

SEQ ID NO: 2355 - protein, 51 aa, Zea mays
  misc_feature: Ceres CLONE 273575-F
  misc_feature (9)..(51): Pfam Name: Ribosomal_L39 Pfam Description: Ribosomal L39 protein
MPSHKTFRIKKKLAKKMRQNRPIPYWIRMRTDNTIRYNAKRRHWRRTKLGF

SEQ ID NO: 2356 - DNA, 96 bp, Zea mays
  misc_feature: Ceres CLONE 273594-F
aacacactcgactctcctctctcgcatccgcrcctttcgagctctactccaccccctcgatctcgaagcgcaagcagcagtcaggcggccatggac

SEQ ID NO: 2357 - DNA, 373 bp, Zea mays
  misc_feature: Ceres CLONE 273606-F
  misc_feature: Translation starting site: 70
  misc_feature (134)..(134): n is a, c, t, g, unknown, or other
  misc_feature (305)..(305): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggccaaggycggcgggcrancgaagaagtcggtgtcgcggtcctccagggccgggctgcagttccccgtcagccgcgtcgggcgtacctcaaaaagggccggtacgcgcabgttaggcacgggtcccccgtctacctcgccgccgtcctggagtacctcgcggccgaggtgctcgagctcgccggcaacsncaaggggacaacaagaagacgcgcatcattccgcgccacgtgctcctcgccatccgcaacgrcgagga

SEQ ID NO: 2358 - DNA, 117 bp, Zea mays
  misc_feature: Ceres CLONE 273620-F
acacgcacaccgcgacccagtccagagccagtacgtgcgamggcacgcacgctgctggtccgcgtacgagacgacggtcaggtcggccggtgcttttcagtttggaataatgacggc

SEQ ID NO: 2359 - DNA, 367 bp, Zea mays
  misc_feature: Ceres CLONE 273631-F
  misc_feature (225)..(225): n is a, c, t, g, unknown, or other
  misc_feature (239)..(239): n is a, c, t, g, unknown, or other
atacatttcgactctcaactcccaaggtcccttttttttctcgatctggaagcgccgcagtagcagccatggacgtgagcggacaggcgggaaggcgaagaagggcgcggccgggcgcaaggycggcgggcgacgaagaagtcggtgtcgcggtcctccagggccgggctgcagttccccgtcagccgcgtcgggcggtacctcaaaaagggccggtacgcgcangtatggcacgggtncccccgtctacctcgccgccgtcctggagtacctcgcggccgaggtgctcgagctcgccggcaacgcgcaagggacaacaagaagacgcgcatcatcccgcgccacgtgctcctcgccatccgcaacg

SEQ ID NO: 2360 - DNA, 655 bp, Zea mays
  misc_feature: Ceres CLONE 273634-R
  misc_feature (1)..(1): n is a, c, t, g, unknown, or other
ncgattgggtaccgggccccccctcgaggtcgacggtatcgatattttttttttttttttttggtttttttttttttttttttttttttttttttttttttttttttggcacccgaatgcagatgcctcttccgaatacatgacagtcaaagatataagcacaattcaagtatgggcgacctaacagtgttcaaacatagtttggaaagacgtaaaatctagtaaacaagacaccctccccagtccaagcccctgaaaaatgtgtccctgaagcccatcaccccgaaagggctttgggaaatcaaaagaaaaacttctcaatcgagtccttgagaccctgtatctgttgtttcagctggctacccccattgctgggcactgaacaagcaatgacaggccttgtcacaccacaagcacggccaaaaacttgtttccatggaacaaatacctatgggacgttcttatcctcagctagcaaggggaggtggaagaagatctccagcggctcggtgtccccccccctcactaccaactccgatatccccctggtcaggggcttcctcgcttccttagctcccttcttgaactgcttgtaattggcggcccgctggatgatatccatgatacctatcgtcagctgcgcatcagccagcgg

SEQ ID NO: 2361 - DNA, 207 bp, Zea mays
  misc_feature: Ceres CLONE 273640-F
acagtcgcctccttcctgcgccgccgccgccgccgccgccgccgctaccaccgcctcgsgccgcctgcgtcccgcgtttccgcacggaagttggtgaaggtttcttgaggctgagaacatggtgctgaagacggaactttgccgcttcasscaaggaagatttatcctgggaaaggcattagatttatccgtgctgattctcaggtc

SEQ ID NO: 2362 - DNA, 484 bp, Zea mays
  misc_feature: Ceres CLONE 273654-F
  misc_feature: Encodes the peptide sequence at SEQ ID NO. 2363
acagtctctccccttcgcggctgcctcccaccgcgtgcygccgccctacgccaggtgccccccacgtcgtcatcgtgcccgtggccgccggcgacgaacgcccagcagggggaggaggatgggcgagttcgacgactactgggcgcgggcgtacaggggcgaccccgcggtcccgcactccgacccgcagcggctcatctccacctggaccggcgcctttgccctcggcgcggccgcctgcgtccaccaccacgcctccgcgctcgcatcccacctcaagtccctaccggcgacttggcaagacatgacattggcccttgatcaaaagcgatggaagaaagcttttgagaaaaaacggcagcaagcttaagctcgttgttctatccaacttcttgggccagttggatgagcacgtgtctggtcatcaattgtggcgcatgaagcttcaaagttctctctatatacacatgatgtagtgacctga

SEQ ID NO: 2363 - protein, 83 aa, Zea mays
  misc_feature: Ceres CLONE 273654-F
MGEFDDYWARAYRGDPAVPHSDPQRLISTWTGAFALGAAACVHHHASALASHLKSLPATWQDMTLALDQKRWKKAFEKKRQQA

SEQ ID NO: 2364 - DNA, 232 bp, Zea mays
  misc_feature: Ceres CLONE 273691-F
  misc_feature (33)..(33): n is a, c, t, g, unknown, or other
  misc_feature (123)..(123): n is a, c, t, g, unknown, or other
  misc_feature (215)..(215): n is a, c, t, g, unknown, or other
acggcagtcgtcacaccacgaaagcagcagcdngtcatcagcaacccacgatcggtcgatcgatcgggtactgctagcgaattcgatcgatcgggtacctgctgctagcgatasagcasaccnagcagatcccgtcgtcgccggcacgatggccagcccgtcgtcgtcgtcgtcgtcagctctggtcgtcctcgtggtggttctagccgcggcgntggcgtgctccgcgacg

SEQ ID NO: 2365 - DNA, 287 bp, Zea mays
  misc_feature: Ceres CLONE 273702-F
  misc_feature: Encodes the peptide sequence at SEQ ID NO. 2366
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcabktaaggcacgggtgccccgtctacctcgccgccgtcctggagtacctcgcggccgagg

SEQ ID NO: 2366 - protein, 71 aa, Zea mays
  misc_feature: Ceres CLONE 273702-F
  misc_feature (6)..(6): Xaa is any aa, unknown, or other
  misc_feature (52)..(52): Xaa is any aa, unknown, or other
  misc_feature (53)..(53): Xaa is any aa, unknown, or other
MDVSGXAVRRRRARRGARPAGDEEVGVAVLQGRAAVPRQPRRAYLKKGRYAXXRHGCPVYLAAVLEYLAAE

SEQ ID NO: 2367 - DNA, 116 bp, Zea mays
  misc_feature: Ceres CLONE 273714-F
acgcacaccgcgacccagtccagagccagtacgtgcgamggcacgcacgctgctggtccgcgtacsaggacgacggtcaggtcggccggtgcttttcagtttggaataatgacggc

SEQ ID NO: 2368 - DNA, 198 bp, Zea mays
  misc_feature: Ceres CLONE 273718-F
  misc_feature (9)..(9): n is a, c, t, g, unknown, or other
  misc_feature (68)..(68): n is a, c, t, g, unknown, or other
gtgcccgcngtgctactgacggttgctctagatccgttcatcctggtggttttgtgaggtcgaaagcngcgagcgaattagaagatgctggacaagctgtgggacgacgtggtggccgggcctcgccsaagacggccttcgagaagctccgcaagccaccaccgcccgcccgctcgtcatcaacaaagacgcggacgg

SEQ ID NO: 2369 - DNA, 222 bp, Zea mays
  misc_feature: Ceres CLONE 273736-F
  misc_feature (192)..(192): n is a, c, t, g, unknown, or other
aatcgcagaaattctccgcaacttcacagcgtatcatcgttttccatcgctcctactcctatcatccagaaaatctgagcggtattgatggcgcccaaggsgagaagaagccggcggcaagaaggtggcggaggaggagccctcggagaaggcggctccggcggagaaggcccccgcggtaagwaggccaangcggagaagcggctacctgcgggcaagtcc

SEQ ID NO: 2370 - DNA, 505 bp, Zea mays
  misc_feature: Ceres CLONE 273753-F
  misc_feature: Encodes the peptide sequence at SEQ ID NO. 2371
tccttccactcaaacgatcgcaacacgatccaaagaacgacgtgtgggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcaccggaccgatggagcgctgcccgacctgtgaccgggttcccatcccgtgcccctggaagcggaca

SEQ ID NO: 2371 - protein, 127 aa, Zea mays
  misc_feature: Ceres CLONE 273753-F
MADPSYWIGMDIETSVTMLVICLAAAVVSVCLFFIFMCIVQWLDSPRMRVFRLGGVTTLRQNLDYTCTLCQNSMEAGEKVRTLSCDHVFHCGGSVKCEGIDHCLRTGPMERCPTCDRVPIPCPWKRT

SEQ ID NO: 2372 - DNA, 693 bp, Zea mays
  misc_feature: Ceres CLONE 273771
  misc_feature: Encodes the peptide sequence at SEQ ID NO. 2373
caaccaccagtccactcatcatcgccatctcttctcttgttttgctcgctctatacataccagagaggtaggtagctagctagctagtggtgaacgtacaataatacaatcagcacagcaagacagtaatggcgcagcggcagggaagaggcagtggtgctgtggcccttgcggcggcggcggcggtgctcctctgcgtgctccttcatgcccacgtcgcggagtcggccgtgttcaccgtcggcgaccgtggcggctggagcttcagcaccggtacctggactaacggcaagcgcttcaaagctggggacgtcctagtgttcaagtacgactcgacggcgcacaacgtggtggtggtgaacgcggccggctacaaaggctgctcggcgccgcggggcgccaaggtgtacacgtccggcaacgaccgcgtcacgctggcccgcggcactaactacttcatctgcagcatccccggccactgccagtccggcatgaagatcgccgtcaccgccgcctgagtcctgaccgatcgcggccgccgccggcacgcctgctgccgcgggctacatacatctacctatcgactgcctgattgtcagttcgactggcttgtatcgactccctgattgttatatatatatgaataaaacacaccatcatgattcgatgtgtaaagtaaaaaaaaaaaaaaaa

SEQ ID NO: 2373 - protein, 129 aa, Zea mays
  misc_feature: Ceres CLONE 273771
  misc_feature (44)..(122): Pfam Name: Cu_bind_like Pfam Description: Plastocyanin-like domain
MAQRQGRGSGAVALAAAAAVLLCVLLHAHVAESAVFTVGDRGGWSFSTGTWTNGKRFKAGDVLVFKYDSTAHNVVVVNAAGYKGCSAPRGAKVYTSGNDRVTLARGTNYFICSIPGHCQSGMKIAVTAA

SEQ ID NO: 2374 - DNA, 379 bp, Zea mays
  misc_feature: Ceres CLONE 273778-F
  misc_feature: Encodes the peptide sequence at SEQ ID NO. 2375
  misc_feature (309)..(309): n is a, c, t, g, unknown, or other
cactctcgtctcctgttckccagagccacctcgctccagaagctttcctcccctagatctccctcccgtgcctggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccgggggcctcttcctggtggcggtcgcgtgctgctccgggatctcgccgccgcccgcggnacgacgacgagtccggcaaggagctcatcgagttcgtcgccgggtgccgcccggagcacctcgtcccgga

SEQ ID NO: 2375 - protein, 95 aa, Zea mays
  misc_feature: Ceres CLONE 273778-F
  misc_feature (72)..(72): Xaa is any aa, unknown, or other
MATKGKLGELVWEHRVQAAAAVAFVAAAAVSISAVGPRLGAVVSFFWPLLVSGGLFLVAVACCSGISPPPAXRRRVRQGAHRVRRRVPPGAPRPG

SEQ ID NO: 2376 - DNA, 118 bp, Zea mays
  misc_feature: Ceres CLONE 273854-F
gtcgttctccttccttcctctwcctcctcccctccacgcgatcgaaaccgaagcagcgaattaatacatcccggtccagcmctctccaggcgctccaccccgcgtcgcggacsctcga

SEQ ID NO: 2377 - DNA, 141 bp, Zea mays
  misc_feature: Ceres CLONE 273884-F
acgccgctgctccaagaaaccaccgccgagcccaaccgcacaagcgcgcgaggcaggagagagagagagaggcggggagcaaaacaatggaggggaaagaggaggacgtgcgcctgggcgcaacaagttctcggagcgcca

SEQ ID NO: 2378 - DNA, 469 bp, Zea mays
  misc_feature: Ceres CLONE 273887-F
  misc_feature: Encodes the peptide sequence at SEQ ID NO. 2379
  misc_feature (138)..(138): n is a, c, t, g, unknown, or other
  misc_feature (345)..(345): n is a, c, t, g, unknown, or other
gcctccgccggctcctccactcagaaaacccagccgccgccgcatcggcctcccaggtaagcaggagcgtccaccccagccgccgccatgaagcgcaacccccgcgtcacgagctcccgccggaagtgccgcaascancttcacggccccgtcctccgtccgccgcgtgctcatgtccgcggcgctatcgacggagctccgccacaagtacaatgtgcgttccatcccgatccgcaagacgacgaggtgcaggtcgtgcgcggcaccttacaagggccgtgaggcaaagtggtgcaggtgtaccgccgtcgctgggtcatccacgtcgagcggatcacccgcganaaggtgaacggctccaccgttgaacgtgggcatccacccttccaagggtgatggttacaaagctgaagcttgacaaggaccgcaagctctcctcgaccgcaagcccggggcgcgccgccgacaa

SEQ ID NO: 2379 - protein, 64 aa, Zea mays
  misc_feature: Ceres CLONE 273887-F
  misc_feature (16)..(16): Xaa is any aa, unknown, or other
  misc_feature (17)..(17): Xaa is any aa, unknown, or other
MKRNPRVTSSRRKCRXXLHGPVLRPPRAHVRGAIDGAPPQVQCAFHPDPQDDEVQVVRGTLQGP

SEQ ID NO: 2380 - DNA, 443 bp, Zea mays
  misc_feature: Ceres CLONE 273894-F
  misc_feature: Encodes the peptide sequence at SEQ ID NO. 2381
  misc_feature (394)..(394): n is a, c, t, g, unknown, or other
acgattggwgtttcacctcggcagcccagccagccagtggttcctcggctcggaggaacaggcgaacagcaagagcttctgaagatgaaggcgatccccgtggctctcctgctcctcgtcctggttgctgccgcctcctcgttcagcatctcgccgaggcagcagacggcggcgcggtgccggacgsgttgtkcgacggcaagtgccgcagccggtgctcgctgaataatgccgggcggtgcatrggcctgtgcatsatstsctgcggcaagtgccagggctgcktkccgtcggggccgtackccagcwaggacgattgcccctgctacagggacatgaagtcccccaagaaccagcgccccaagtgcccctaggccctaccgctctaasgganggacgattacccatgatttcgctcgcgatcctgcacascttctagtctt

SEQ ID NO: 2381 - protein, 123 aa, Zea mays
  misc_feature: Ceres CLONE 273894-F
  misc_feature (40)..(123): Pfam Name: GASA Pfam Description: Gibberellin regulated protein
  misc_feature (3)..(3): Xaa is any aa, unknown, or other
  misc_feature (62)..(62): Xaa is any aa, unknown, or other
  misc_feature (64)..(64): Xaa is any aa, unknown, or other
  misc_feature (81)..(81): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
  misc_feature (95)..(95): Xaa is any aa, unknown, or other
  misc_feature (101)..(101): Xaa is any aa, unknown, or other
  misc_feature (103)..(103): Xaa is any aa, unknown, or other
DWXFTSAAQPASGSSARRNRRTARASEDEGDPRGSPAPRPGCCRLLVQHLAEAADGGAVPDXLXDGKCRSRCSLNNAGRCXGLCXXXCGKCQGCXPSGPYXSXDDCPCYRDMKSPKNQRPKCP

SEQ ID NO: 2382 - DNA, 308 bp, Zea mays
  misc_feature: Ceres CLONE 273943-F
  misc_feature: Encodes the peptide sequence at SEQ ID NO. 2383
  misc_feature (139)..(139): n is a, c, t, g, unknown, or other
actcatacatttcgactctcaactcccaaggtccctttttttttctcgatctggaagcgccgcagtagcaggcatggacgtgagcggacaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgcasyktaggcacgggtgcccccgtctacctcgccgccgtcctggagtacctcgcggccgagtgctcgagctcgccggcaac

SEQ ID NO: 2383 - protein, 102 aa, Zea mays
  misc_feature: Ceres CLONE 273943-F
  misc_feature (47)..(47): Xaa is any aa, unknown, or other
  misc_feature (77)..(77): Xaa is any aa, unknown, or other
  misc_feature (78)..(78): Xaa is any aa, unknown, or other
THTFRLSTPKVPFFFSIWKRRSSRHGRERTGGKAKKGAAGRKAGGRXKKSVSRSSRAGLQFPVSRVGRTSKRAGTRXXGTGAPVYLAAVLEYLAAECSSSPA

SEQ ID NO: 2384 - DNA, 282 bp, Zea mays
  misc_feature: Ceres CLONE 273959-F
  misc_feature: Encodes the peptide sequence at SEQ ID NO. 2385
  misc_feature (101)..(101): n is a, c, t, g, unknown, or other
aaaaagcaacacttgcttgtccagtaaktgaaggaagcggcastgtcccatcatccctcattctcagtttggggtcctgggcctgtggctgtggtggaganaggtcaggagtggagcgattgtcggaggaggtcaccacaccagcagcggcgacgacgatgctgatcctggacctggcgatctggatcatcccggtgacgctcktcctcgtgccgttccggcggctggtggtcctggtggccaggctgcaggagctgraggagtacatcatgcggccgcggc

SEQ ID NO: 2385 - protein, 41 aa, Zea mays
  misc_feature: Ceres CLONE 273959-F
  misc_feature (16)..(16): Xaa is any aa, unknown, or other
  misc_feature (34)..(34): Xaa is any aa, unknown, or other
MLILDLAIWIIPVTLXLVPFRRLVVLVARLQELXEYIMRPR

SEQ ID NO: 2386 - DNA, 213 bp, Zea mays
  misc_feature: Ceres CLONE 273975-F
  misc_feature (169)..(169): n is a, c, t, g, unknown, or other
atacgccgccatattcgcaagcyaccgcaaccgaagcgcgccttcgccgccgcccccgcccccgccgcctctgcgatccccgcaagtcgcaaacatgtctaccgtgctccagcgcccgacccccggcacgtccagtgcttcggccgcaagawgacggctgtggcgygcncttacaccaagccggggcgcgggctgatcaaggtgaacggcgtc

SEQ ID NO: 2387 - DNA, 317 bp, Zea mays
  misc_feature: Ceres CLONE 273993-F
  misc_feature: Encodes the peptide sequence at SEQ ID NO. 2388
  misc_feature (268)..(268): n is a, c, t, g, unknown, or other
cttgcccgcgamsatggcggatgccccgcgatggcctcatcaccaccggcgtccgctgacgasgcgggtccatcctcgccttccgtagccgtccctcgtgtacttccctccagattgctcctagacaccccgcctccttccagcggtaggacgcggggcccsggggcgcagtgcggctgcggcgtcgaggcgcgggcgggcgaggcggaggcacgatgagggagtccactttgccggctgcggcttcaaacggtacaggatggaggangccggagcgggactggctcgccgaggcgttatgatgatcgggggggcca

SEQ ID NO: 2388 - protein, 72 aa, Zea mays
  misc_feature: Ceres CLONE 273993-F
  misc_feature (4)..(4): Xaa is any aa, unknown, or other
  misc_feature (5)..(5): Xaa is any aa, unknown, or other
  misc_feature (21)..(21): Xaa is any aa, unknown, or other
LARXXGGCPAMASSPPASADXAGPSSPSVAVPRVLPSRLLLDTPPPSSGRTRGPGAQCGCGVEARAGEAEAR

SEQ ID NO: 2389 - DNA, 597 bp, Zea mays
  misc_feature: Ceres CLONE 273996-R
  misc_feature (198)..(198): n is a, c, t, g, unknown, or other
  misc_feature (200)..(200): n is a, c, t, g, unknown, or other
  misc_feature (201)..(201): n is a, c, t, g, unknown, or other
  misc_feature (204)..(204): n is a, c, t, g, unknown, or other
  misc_feature (269)..(269): n is a, c, t, g, unknown, or other
  misc_feature (305)..(305): n is a, c, t, g, unknown, or other
  misc_feature (353)..(353): n is a, c, t, g, unknown, or other
  misc_feature (360)..(360): n is a, c, t, g, unknown, or other
  misc_feature (363)..(363): n is a, c, t, g, unknown, or other
  misc_feature (374)..(374): n is a, c, t, g, unknown, or other
  misc_feature (386)..(386): n is a, c, t, g, unknown, or other
  misc_feature (394)..(394): n is a, c, t, g, unknown, or other
  misc_feature (413)..(413): n is a, c, t, g, unknown, or other
  misc_feature (438)..(438): n is a, c, t, g, unknown, or other
  misc_feature (452)..(452): n is a, c, t, g, unknown, or other
  misc_feature (458)..(458): n is a, c, t, g, unknown, or other
  misc_feature (464)..(464): n is a, c, t, g, unknown, or other
  misc_feature (478)..(478): n is a, c, t, g, unknown, or other
  misc_feature (479)..(479): n is a, c, t, g, unknown, or other
  misc_feature (494)..(494): n is a, c, t, g, unknown, or other
  misc_feature (495)..(495): n is a, c, t, g, unknown, or other
  misc_feature (505)..(505): n is a, c, t, g, unknown, or other
  misc_feature (518)..(518): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (561)..(561): n is a, c, t, g, unknown, or other
  misc_feature (593)..(593): n is a, c, t, g, unknown, or other
tcgaggtcgattgtatcgataagcttttttttttttttttttagctgcctgacaatagcgatgtattaccaaaatcaaggatcaccaaaaaccctcgtcaacagcaggttacataacagaaaaatcacgtacggctaggcctgacaagaactgaaccaccacggatttgtaataaaagctcctccccgctgcggcgantnncanaacaaaaaggggggggggggggcccccccccaatttttggggggggggaaataaaacaacaccanaaaatttcgccccccctcaaaaaaaattgtttttcnccgccccgccaaaaattttttcttctccccggggagggggtgtgttgnctcctcnaanaattatttccnccccaaatgtgnccgccgcnccccctcccatttctctcncgggggggagaaaggaggggggggntgggttttgctttntgcggncggcgncgcccaaagagagnnagccgcggcgggggnnagaaagaaancagatctggggtnttttggggcgcaaaaaaaaaaannnngacctcccttccctctntcctcaccacggcgctttttctttctttgtcngttt

SEQ ID NO: 2390 - DNA, 166 bp, Zea mays
  misc_feature: Ceres CLONE 274049-F
  misc_feature (94)..(94): n is a, c, t, g, unknown, or other
aagggagcggtcgagcggtkacatcatcgtcatccagggtttctcaatcggcagcgatggcgaccagggcggcggcgaggttcctgcagcgctnttctgtcttccggcggcaaggtcctcagcgaggaggagaaggccgccgagaacgtgtacatcaagaaagtgg

SEQ ID NO: 2391 - DNA, 189 bp, Zea mays
  misc_feature: Ceres CLONE 274057-F
ayagtttggcgatcgcgatcgggaccttccctcagccacaggccgahatyccacgccgtcgaacggccggggatccgtacctccgctccgccccgactccctctcgccggacggctgcagatccggtcaggccgatccgtctcggacccggtggtascagtggaggaatccgctgccggtccatcgatc

SEQ ID NO: 2392 - DNA, 132 bp, Zea mays
  misc_feature: Ceres CLONE 274058-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacggcgacgacgacgacagc

SEQ ID NO: 2393 - DNA, 492 bp, Zea mays
  misc_feature: Ceres CLONE 274082-F
  misc_feature: Pfam Name: DREPP Pfam Description: DREPP plasma membrane polypeptide
gaatgttcttttatgcttcactgagtattcctatagctatcgttcagctcctggtggtgctacgggggtgactgcgggggcgactgcggctggtggctgttgtcctcatcgaccatctcggcgacgtcctactcgagcgagatctcgctgcagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaaaagtggaagctgctaggaagcaggaagagttgcaatctgtttgatgccttttctagaacatatctgtggttagaactttgttcagaactacgtgc

SEQ ID NO: 2394 - DNA, 458 bp, Zea mays
  misc_feature: Ceres CLONE 274159-F
  misc_feature: Encodes the peptide sequence at SEQ ID NO. 2395
  misc_feature (174)..(174): n is a, c, t, g, unknown, or other
  misc_feature (337)..(337): n is a, c, t, g, unknown, or other
  misc_feature (342)..(342): n is a, c, t, g, unknown, or other
  misc_feature (416)..(416): n is a, c, t, g, unknown, or other
actccacatttccactccaccgtttcagcagcaccagcaacacagccaaagcccaaagaggcggcasagcacagcagctcggcctgttcccatggctcctctgctgttcagggacatgaaggggctgtcgtgctcgtccccggcgtccacggcgatatgccgagcctggagcgncaccgatggtccggccacacaaagccattgccagtgccagccccctgtctcacgtccctgccgcgcccaggacacaccggcacgacggtaagaaagggcggcasaggaggagcagcagcagcgaaaggctgtcgtcgtcggaaacgccggtggcctcgtcagnccggntggytcgtcccgttacttgctgagcggccgtttcgccscaccgaggagatccaggaggtggagtctgccccggncgtcgacgtcaagcccaagcgsgaggaagcaggtgaagctgc

SEQ ID NO: 2395 - protein, 57 aa, Zea mays
  misc_feature: Ceres CLONE 274159-F
  misc_feature (28)..(28): Xaa is any aa, unknown, or other
MAPLLFRDMKGLSCSSPASTAICRAWSXTDGPATQSHCQCQPPVSRPCRAQDTPARR

SEQ ID NO: 2396 - DNA, 97 bp, Zea mays
  misc_feature: Ceres CLONE 274170-F
aactcaggaccagtgcctcttcggtcaaaaatatccttgtacctgcatctcgacctcacggcgtccgccggtggtatcacgatggtggcgttgctgg

SEQ ID NO: 2397 - DNA, 137 bp, Zea mays
  misc_feature: Ceres CLONE 274174-F
acaaaaacccagcatcagtcaagctcgctcacacgaccatggccgcggcgatgaccggcagtactcgcgccasggttccttcctcgtgtttctytttgtcgtgttggccggtgtcgtcgacgtcgcgtccgctgcca

SEQ ID NO: 2398 - DNA, 487 bp, Zea mays
  misc_feature: Ceres CLONE 274203-F
  misc_feature (272)..(272): n is a, c, t, g, unknown, or other
aacaacagccctacaacttactgcttgctctagctagctagctgctcccggcccatatccactacacaagtaggctagcagcagcagcagcaatggcctcggtgacgrgttcccggccgtggccctcgtcctgctgctcgccgccagcgccttcctggccagcgaggtggcggcgtgcggcggctgcccgawaccaactcctcctcctccatcgccaccaccgccgtcgcccaccagcacgccgtscctccgccaccgtccagctccggcgncaagtgccccaagaacgcgctgaaactgggcgtgtgcgcaacgtgctgggcctcgtcaaggtgtccatcggcaaggtgcccaccgactcgtgctgcccgctgctggacggcctcgcgacctggaggccgccgtctgcctctgcaccgcgctcaaggccaacgtgctcggcatcaacctcgacgtccccgtcaagctcaccctggctcctcaacta

SEQ ID NO: 2399 - DNA, 542 bp, Zea mays
  misc_feature: Ceres CLONE 274223-F
  misc_feature: Encodes the peptide sequence at SEQ ID NO. 2400
atcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaakagctcgccaagctgaagaaggcgtccacggcttaaggagtctctttccgtgaatgtcatgttagagtttttggttattgagttggatcagcaattcgattgagcgtt

SEQ ID NO: 2400 - protein, 134 aa, Zea mays
  misc_feature: Ceres CLONE 274223-F
  misc_feature (44)..(120): Pfam Name: Ribosomal_L14e Pfam Description: Ribosomal protein L14
  misc_feature (124)..(124): Xaa is any aa, unknown, or other
MPFKRFVEIGRVALVNYGEDYGRLVVIVDVVDQNRALVDAPDMVRCQVNFKRLSLTDIKIDIKRVPKKTALIKAMEEADVKTKWENSSWGKKLIVQKRRASLNDFDRFKVMLAKIKRGGAIRQXLAKLKKASTA

SEQ ID NO: 2401 - DNA, 473 bp, Zea mays
  misc_feature: Ceres CLONE 274234-F
  misc_feature: Encodes the peptide sequence at SEQ ID NO. 2402
  misc_feature (73)..(73): n is a, c, t, g, unknown, or other
  misc_feature (105)..(105): n is a, c, t, g, unknown, or other
aaccgacctttccccctcccccgcattccacctcgcggagatccagtccagccctagggtttcgccagckgmnccaaactccacgagcgggggaagaggggaaancagggacgacgagggggcagccatggggcagcagtcgctgatctacgcgttcgtggcccgtggcacgttcatactggccgagtacacggagttcaccggcaacttcaccaccatcgcctcccagtgcctcatgaagctccccgcaagcaacaacaagttcacctacaactgckacgggtcacactttcaattacctcgtggaagacggattcacatactgtgttgtttgctgttgaatcggtgggggcaacaaattcctattgctttcatggatagggttaaggaggatttcacaaaaaggtatggttggtggggaaagctgctactgctgcagctaacagcctcaatcgagagtttggatcaaaact

SEQ ID NO: 2402 - protein, 115 aa, Zea mays
  misc_feature: Ceres CLONE 274234-F
  misc_feature (51)..(51): Xaa is any aa, unknown, or other
MGQQSLIYAFVARGTFILAEYTEFTGNFTTIASQCLMKLPASNNKFTYNCXGSHFQLPRGRRIHILCCLLLNRWGQQIPIAFMDRVKEDFTKRYGWWGKLLLLQLTASIESLDQN

SEQ ID NO: 2403 - DNA, 117 bp, Zea mays
  misc_feature: Ceres CLONE 274241-F
acacgcacaccgcgacccagtccagagccagtacgtgcgamggcacgcacgctgctggtccgcgtacsagacgacggtcaggtcggccggtgcttttcagtttggaataatgacggc

SEQ ID NO: 2404 - DNA, 397 bp, Zea mays
  misc_feature: Ceres CLONE 274289-F
  misc_feature: Translation starting site: 74
  misc_feature (230)..(230): n is a, c, t, g, unknown, or other
  misc_feature (379)..(379): n is a, c, t, g, unknown, or other
  misc_feature (388)..(388): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcangtaaggcacgggtgcccccgtctacctcgccgccgtcctggagtacctcgcggccgaggtgctcgagctcgccggcaacgscaagggacaacaagaagacgcgcatcattccgcgccacgtgctcctcgccatccgcaacgacgagganctcggcaanctgctggcc

SEQ ID NO: 2405 - DNA, 155 bp, Zea mays
  misc_feature: Ceres CLONE 274303-F
gcttctctcgcattcgacctccccttcccaccctcaacagcgaagagcacacatggataccgccgkcttctccctcgcccatctcttccacggagtcgacgacagcgacgacgaccgagatgatatgcaaatctgctccgatggggagaagccgg

SEQ ID NO: 2406 - DNA, 480 bp, Zea mays
  misc_feature: Ceres CLONE 274317-F
  misc_feature: Encodes the peptide sequence at SEQ ID NO. 2407
  misc_feature (341)..(341): n is a, c, t, g, unknown, or other
  misc_feature (397)..(397): n is a, c, t, g, unknown, or other
  misc_feature (438)..(438): n is a, c, t, g, unknown, or other
accctgtgcgcgcgggctctcttcgtcgtgcggcaactgcgcgaccgccgacgcccgacggcaggtgcaccaggtcttcgtcgaccccttcgcaaggcctcggttccatccttcgccggasccgcccgtcaacaggacttgatctactactcactagcggtgtagaggcgaagagaagtaacttgaccatgagcagcataggcacaggttacgatttgtctgtcacgactttctccccagatggtcgtgtcttccaggtcgaktatgccaccaaggccgtcgacaacagcgggactgttgtkgggatcaagtgcaaagatggcattgtcctgggtgtcganaagctggtaacctcaaagatgatgctggaaggwtcaaaccgargatccattcggtncaccgtcactctggcttggttgttsgctggtttagcagcanatggcaggcaaattgtttcaaggaccaaatcagaagctgcca

SEQ ID NO: 2407 - protein, 97 aa, Zea mays
  misc_feature: Ceres CLONE 274317-F
  misc_feature: SWISSPROT Homolog: EC 3.4.25.1 Proteasome endopeptidase complex
  misc_feature (25)..(25): Xaa is any aa, unknown, or other
  misc_feature (51)..(51): Xaa is any aa, unknown, or other
  misc_feature (66)..(66): Xaa is any aa, unknown, or other
  misc_feature (70)..(70): Xaa is any aa, unknown, or other
  misc_feature (78)..(78): Xaa is any aa, unknown, or other
  misc_feature (84)..(84): Xaa is any aa, unknown, or other
MSSIGTGYDLSVTTFSPDGRVFQVXYATKAVDNSGTVVGIKCKDGIVLGVXKLVTSKMMLEGSNRXSIRXTVTLAWLXAGLAAXGRQIVSRTKSEAA

SEQ ID NO: 2408 - DNA, 502 bp, Zea mays
  misc_feature: Ceres CLONE 274347-F
  misc_feature: Encodes the peptide sequence at SEQ ID NO. 2409
agaaaccctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaattgatgtgtcgtttttctgtccaa

SEQ ID NO: 2409 - protein, 60 aa, Zea mays; identical to SEQ ID NO: 1569
  misc_feature: Ceres CLONE 274347-F
  misc_feature (3)..(42): Pfam Name: Ribosomal_L29e Pfam Description: Ribosomal L29e protein family

SEQ ID NO: 2410 - DNA, 310 bp, Zea mays
  misc_feature: Ceres CLONE 274358-F
  misc_feature: Pfam Name: DUF962 Pfam Description: Protein of unknown function (DUF962)
  misc_feature (64)..(64): n is a, c, t, g, unknown, or other
  misc_feature (237)..(237): n is a, c, t, g, unknown, or other
acccaacaaagtgacctgaaacggggagcaagcaaccgagggcgagascatggcgavkcgcggncggcggcggcctcctggacttagaggggcactacgccttctacggcgcctaccacagcaaccccgtcaacgtgggcatccacgagctcttcgtctggcccatcttcctcaccgcgctcatgctcctccacctcaccgccccctccacgcacgccgccggcatcagcgccgcgntctacgscttactacttcctcctcgaccgccgcgcggccgctcgccgccctcttctgctacctctgctgggcc

SEQ ID NO: 2411 - DNA, 303 bp, Zea mays
  misc_feature: Ceres CLONE 274374-F
  misc_feature: Encodes the peptide sequence at SEQ ID NO. 2412
atccactcccaagtcccaacacccgtcggcgtcgagcagcggcascgcgcgatgacgacgagcctgaagaagaaccggaagaagcgcgggcacgtgtcggcggggcacggccgcatcggcaagcaccggaagcacccgggaggccgcggcaacgccggckcattgcaccaccaccgcatcctcttcgacaagtaccacccgggctacttcggcaaggtgggcatgcgtctacttccacaggctccgcaacaagttccactgcccgtmggtcaacgtggagcggctctggtcgatggtgcccgc

SEQ ID NO: 2412 - protein, 84 aa, Zea mays
  misc_feature: Ceres CLONE 274374-F
  misc_feature (37)..(37): Xaa is any aa, unknown, or other
MTTSLKKNRKKRGHVSAGHGRIGKHRKHPGGRGNAGXLHHHRILFDKYHPGYFGKVGMRLLPQAPQQVPLPVGQRGAALVDGAR

SEQ ID NO: 2413 - DNA, 404 bp, Zea mays
  misc_feature: Ceres CLONE 274380-F
  misc_feature (81)..(81): n is a, c, t, g, unknown, or other
atcacacactaatcaacaagcaggaccagctagctagctcctctcactgctatcacccgcccagccatctcgctgaaaganaaaagcgcmscatgaagactactagctcgggcattgcagtcgtcctactggtggccatgctggcagtccattcgcgcgttggccgacatcgtcgtgctccgacgtgctcaacgacctgtcgccgtgcctgcccttcctgcagggcaaggcagccaaacccagcgagagcaacaaccagtkctgcgacggcgtcgagggccctgtacgcggcggcggacaccagggcccgacaggcaggccacgtgccggtgcctcaaggcgbcctacgttcaggtccacgctgtgctctccgcggcgcaggagctgcccgtcgactgcgggct

SEQ ID NO: 2414 - DNA, 425 bp, Zea mays
  misc_feature: Ceres CLONE 274405-F
  misc_feature: Encodes the peptide sequence at SEQ ID NO. 2415
atcacaagccagaacagccaagaacagagatacccaagtyaccgaagcaaccgctcacaatcccaatctcccgcgtcactcaaaacccgaagtaacacaaccgtcggtccgaccaacaatgtcgctgattcgccgtggaaacgcattcgaccccttctccctcgacctctgggaccccttcgagggcttcttccccttcggctccggcgacgtccgcagcctcgttccctcgttgccgcgcaccagctcggagaccgcggcatttgccggcgcgcggatcgactggaaggagacacccgaagcgcacgtgttcaaggcggacgtgccggggctgaggaaggaggaggtcaaggtggaggtcgaggacggcaacgtctgcagatcagcggcgagcgcaacaaggagcacgaggagaaagaacgaca

SEQ ID NO: 2415 - protein, 102 aa, Zea mays
  misc_feature: Ceres CLONE 274405-F
MSLIRRGNAFDPFSLDLWDPFEGFFPFGSGDVRSLVPSLPRTSSETAAFAGARIDWKETPEAHVFKADVPGLRKEEVKVEVEDGNVCRSAASATRSTRRKND

SEQ ID NO: 2416 - DNA, 527 bp, Zea mays
  misc_feature: Ceres CLONE 274415-F
  misc_feature: Encodes the peptide sequence at SEQ ID NO. 2417
  misc_feature (350)..(350): n is a, c, t, g, unknown, or other
  misc_feature (481)..(481): n is a, c, t, g, unknown, or other
actggtcctacaacactctccctaccacaccgaaccaacaagaggagcaagaggtagctatagcagcctagcacacaccaccacccaccaccgccaccgcgccacagagctgccgagagtgtgctgtgctttgctcatcgaccgaccgatcgatctcggcatggcggactgggggccggtgctgatcgggctggtgctcttcatcctgctctccccgggcctgctcttccagatccccggcaagggccggatcatcgagttcggcaacttccagaccagcggcctctccatcctcgtccacgccgtcatctacttcgccctcctcgccatcttcctcctcgccgtcgstnccacatttacctcggctagctagtcgccggcgggggccgcttgagcgaggctagctgctggcgcgcggcggcccggcccggctttatttgacatcatctgggtggctggattaggtactgcgtggtttcanaggcatatactacttatatacatttacatgtttcattctcatctgc

SEQ ID NO: 2417 - protein, 70 aa, Zea mays
  misc_feature: Ceres CLONE 274415-F
  misc_feature (63)..(63): Xaa is any aa, unknown, or other
  misc_feature (64)..(64): Xaa is any aa, unknown, or other
MADWGPVLIGLVLFILLSPGLLFQIPGKGRIIEFGNFQTSGLSILVHAVIYFALLAIFLLAVXXTFTSAS

SEQ ID NO: 2418 - DNA, 1083 bp, Zea mays
  misc_feature: Ceres CLONE 274418
  misc_feature: Encodes the peptide sequence at SEQ ID NO. 2419
gtcacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtggagaagccggaggaggggaagaagcccgacgaggagggtgacgagaggaagaaggccgacccctgccgccgagaaggagtaagaaggcgaggaagccgcggagcaggaagcccaagtccgccgggtctgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctgcgcggcttcgccgccaagggccgcctcgtcaaggtcaaggcttccttcaagctcgccgccgccgaggagaggaagccctccgcggccgcgaaggcgaagaagaaggcgtcggcgggaatggccaagcgcaagagggccgccgcgccggccaagaagaagccggcggccgctgcctcggcgccgtcgagggaggcacgtaaggtgcgcgcgaagcgagcgaggaaggtggccccggcgcccgcgcagcccaagcccaagccagcccgcgccgccgcttccggtgccggcaagaaggtcaacaaggccagcgcctgattagcggcggccgtcctggtccccccgcgcgcgcctccgtgtattatactagccggtagtagcagtaggagttgcaagtactagcagcgtggtagtcgtgatgatgttgtggtcgtcgtctccgccggcccgatcgatcgggcgctctgttccgccgtgtggcagagttttgtaaataactagtctggtgtgatgcgctcatggcaataaagcgcgcgcttctagcttccttgatgaaacatccatgatccattatcagtgcagtcttgtggttatcgtgttaaaaaaaaaaaaaaaaaaaaaaaaaacaaaaaaaaaaaaaaaa

SEQ ID NO: 2419 - protein, 226 aa, Zea mays
  misc_feature: Ceres CLONE 274418
  misc_feature (71)..(142): Pfam Name: Linker_histone Pfam Description: linker histone H1 and H5 family
MATVTEEVAPVVTVSEEPAPEAAKEVVEKPEEGKKPDEEGDERKKADPCRREGVRRRGSRGAGSPSPPGLHHPPYFEMIKEAILSQDGGKVGASPYAIAKHMGEKHRDVLPPNYRKVLAVQLRGFAAKGRLVKVKASFKLAAAEERKPSAAAKAKKKASAGMAKRKRAAAPAKKKPAAAASAPSREARKVRAKRARKVAPAPAQPKPKPARAAASGAGKKVNKASA

SEQ ID NO: 2420 - DNA, 453 bp, Zea mays
  misc_feature: Ceres CLONE 274453-F
  misc_feature: Encodes the peptide sequence at SEQ ID NO. 2421
  misc_feature (379)..(379): n is a, c, t, g, unknown, or other
  misc_feature (420)..(420): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgagcgaagaagtcggtgtcgcggtcctccagggccgggctgcagttccccgtcagccgcgtcgggcgtacctcaaaaagggccggtacgcgcabgtaaggcacgggtgcccccgtctacctcgccgccgtcctggagtacctcgcggccgaggtgctcgagctcgccggcaacgccaagggacaacaagaagacgcgcatcattccgcgccacgtgctcctcgccatccgcaacgacgagganctcggcaagctgctggccggcgtcaccatcgcccacggggncktcctccccaaacatccacactgtgctcctcc

SEQ ID NO: 2421 - protein, 126 aa, Zea mays
  misc_feature: Ceres CLONE 274453-F
  misc_feature (6)..(6): Xaa is any aa, unknown, or other
  misc_feature (53)..(53): Xaa is any aa, unknown, or other
  misc_feature (102)..(102): Xaa is any aa, unknown, or other
  misc_feature (116)..(116): Xaa is any aa, unknown, or other
  misc_feature (117)..(117): Xaa is any aa, unknown, or other
MDVSGXAVRRRRARRGARPAGERRSRCRGPPGPGCSSPSAASGVPQKGPVRAXKARVPPSTSPPSWSTSRPRCSSSPATPRDNKKTRIIPRHVLLAIRNDEXLGKLLAGVTIAHGXXLPKHPHCAP

SEQ ID NO: 2422 - DNA, 121 bp, Zea mays
  misc_feature: Ceres CLONE 274457-F
acacgcacaccgcgacccagtccagagccagtacgtgcgamrcaacgcacgctgctggtccgcgtacsagacgacggtcaggtcggccggtgcttttcagtttggaataatgacggcgacg

SEQ ID NO: 2423 - DNA, 112 bp, Zea mays
  misc_feature: Ceres CLONE 274460-F
acgcacaccgcgacccagtccagagccagtacgtgcgamggcacgcacgctgctggtccgcgtacsagacgacggtcaggtcggccggtgcttttcagtttggaataatgac

SEQ ID NO: 2424 - DNA, 392 bp, Zea mays
  misc_feature: Ceres CLONE 274486-F
  misc_feature: Encodes the peptide sequence at SEQ ID NO. 2425
  misc_feature (332)..(332): n is a, c, t, g, unknown, or other
acgatcacacaccactccacagcagtagcaagagggatagagcaaggccacacacacacacacaccactagtaggctagcctagccttttagtcgtcgaggaggagcaagaagggcgcgcdcgcaagcaggcaagcaagaamagagccgatcgaccgagagctagcacgcgatggcgaggtcttccaagatgatggtggcggcactctgctgccttggcctggcgtgtcgaccgccgaggcgaggaacatcaagaccacgacgacggagaagaaggacgacgcggtggtgcagccgcagacccttcccgcccttcgaccgcctcggcgcggncgcgtccccgagcgttcggcggcctccccggcggcasattcctggcagcagcattcccgg

SEQ ID NO: 2425 - protein, 73 aa, Zea mays
  misc_feature: Ceres CLONE 274486-F
  misc_feature (54)..(54): Xaa is any aa, unknown, or other
  misc_feature (66)..(66): Xaa is any aa, unknown, or other
MARSSKMMVAALCCLGLACRPPRRGTSRPRRRRRRTTRWCSRRPFPPFDRLGAXASPSVRRPPRRXIPGSSIP

SEQ ID NO: 2426 - DNA, 358 bp, Zea mays
  misc_feature: Ceres CLONE 274488-F
  misc_feature: Encodes the peptide sequence at SEQ ID NO. 2427
aactaacctttgccaccgcgggagccaccatgggtscagatgccggacgccgacgggaaggcccgctcggcgactcctcgtcctcttacgggtacacgccgtcggcccgccgcagcaccagtacggcacctttggccccccatccggagcctccggggagtttccgcagccggcggtcgggttcccccagccggcgccgcscctgggttgcagcactacccgcagcctccgccggcgtcgtatgccgtctacccacccccgcagcaaccctactcgaccgccgcgccgtactacgcccaaggytaccagatcgctcaaggttatattcctgttgttgaaggaaggcctgttagaatcc

SEQ ID NO: 2427 - protein, 106 aa, Zea mays
  misc_feature: Ceres CLONE 274488-F
MPDADGKARSATPRPLTGTRRRPAAAPVRHLWPPIRSLRGVSAAGGRVPPAGAAPGLQHYPQPPPASYAVYPPPQQPYSTAAPYYAQGYQIAQGYIPVVEGRPVRI

SEQ ID NO: 2428 - DNA, 445 bp, Zea mays
  misc_feature: Ceres CLONE 274502-F
  misc_feature: Encodes the peptide sequence at SEQ ID NO. 2429
  misc_feature (160)..(160): n is a, c, t, g, unknown, or other
  misc_feature (357)..(357): n is a, c, t, g, unknown, or other
agatcagaaccaaactcggctcgagagagatcgcatacgcctgcctgcccacccacctccccttttccttcctcttcgccccagcgacgcgccgcccggagaccgagcgaggcaggcaactaaccaccgagaggcagggacaggaacaggaagccggavnagatgtcgtcggtgttcagcggcgatgagacggcccccttcttcggcttcctcggcgccgcgccgccctcgtcttctcatgcatgggcgccgcgtacgggaccgcgaagagcgcgtcggcgtggcgtcgatgggtgtgatgcggccggagctcgtcatgaagtccatcgtgcccgtggtcatggctggtgtrctcrnkatctacgggctcatcatcgccgtcatcattagcacggggatcaaccccaaggccaagccctactacctctwtgatggctacgccacc

SEQ ID NO: 2429 - protein, 69 aa, Zea mays
  misc_feature: Ceres CLONE 274502-F
  misc_feature: SWISSPROT Homolog: EC 3.6.3.14 H(+)-transporting two-sector ATPase
  misc_feature (40)..(40): Xaa is any aa, unknown, or other
  misc_feature (64)..(64): Xaa is any aa, unknown, or other
MHGRRVRDREERVGVASMGVMRPELVMKSIVPVVMAGVLXIYGLIIAVIISTGINPKAKPYYLXDGYAT

SEQ ID NO: 2430 - DNA, 429 bp, Zea mays
  misc_feature: Ceres CLONE 274554-F
  misc_feature: Encodes the peptide sequence at SEQ ID NO. 2431
  misc_feature (171)..(171): n is a, c, t, g, unknown, or other
  misc_feature (202)..(202): n is a, c, t, g, unknown, or other
  misc_feature (209)..(209): n is a, c, t, g, unknown, or other
  misc_feature (211)..(211): n is a, c, t, g, unknown, or other
atacaacaggcacgaaacctcgcgccgccaccaaatctccagcgagcgaaggcgctccggcgagtgcgcggcaacgacgaaggcgtccggggccagtggcgagaggaagagcatgctgaagttcctccaaggtggtggtggagtactgccctctggacccgcggaaggcgncggcagtggagctcctcgcgcagtgcaacgnccgcaanangtgactccaacccggcctgctcggtcgagctccgccgcctcccgtccccagctccgtccacggacctcaagtygcagccgactctcccgcctccgagggtcctcgtgacctacttcaccggagctgaagaggccatcgtctttgctgagggagctacggcgcagggcatccgggaccagatcgtcgcacggggccggctcatcgatacggagaagatg

SEQ ID NO: 2431 - protein, 143 aa, Zea mays
  misc_feature: Ceres CLONE 274554-F
  misc_feature (68)..(68): Xaa is any aa, unknown, or other
  misc_feature (70)..(70): Xaa is any aa, unknown, or other
  misc_feature (71)..(71): Xaa is any aa, unknown, or other
  misc_feature (95)..(95): Xaa is any aa, unknown, or other
IQQARNLAPPPNLQRAKALRRVRGNDEGVRGQWREEEHAEVPPRWWWSTALWTRGRRRQWSSSRSATXAXXDSNPACSVELRRLPSPAPSTDLKXQPTLPPPRVLVTYFTGAEEAIVFAEGATAQGIRDQIVARGRLIDTEKM

SEQ ID NO: 2432 - DNA, 503 bp, Zea mays
  misc_feature: Ceres CLONE 274563-F
  misc_feature: Encodes the peptide sequence at SEQ ID NO. 2433
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacggggatggtga

SEQ ID NO: 2433 - protein, 119 aa, Zea mays; identical to SEQ ID NO: 566
  misc_feature: Ceres CLONE 274563-F
  misc_feature (28)..(115): Pfam Name: Tryp_alpha_amyl Pfam Description: Protease inhibitor/seed storage/LTP family

SEQ ID NO: 2434 - DNA, 405 bp, Zea mays
  misc_feature: Ceres CLONE 274601-F
  misc_feature: SWISSPROT Homolog: EC 3.4.25.1 Proteasome endopeptidase complex
  misc_feature (186)..(186): n is a, c, t, g, unknown, or other
  misc_feature (188)..(188): n is a, c, t, g, unknown, or other
  misc_feature (283)..(283): n is a, c, t, g, unknown, or other
  misc_feature (298)..(298): n is a, c, t, g, unknown, or other
cccaaaccctacacctgcccgccggcgcactcggggaccgtcgaatcgagcaggttgacggaggagagggagcctcgaagatgttccggaaccagtacgacaccgacgtgacgacatggagcccccaggggcgctctgttccaggtggagtacgccattgaggccgtcaagcagggctccgctgcntncgggctccggtcgagcacccacgccgtcctagccgccgtcaacaagcccgcctccgagctctcctcctaccagcggaaggtgttccgcgtcgctnaccacgccggggtcnctctcgccggcctcaccgccgacggccgcgttctctcgcgtttcctccgcaacgagtgcatcaaccactccttcgtctacgaggcgccgctccccgtctccatgctc

SEQ ID NO: 2435 - DNA, 724 bp, Zea mays
  misc_feature: Ceres CLONE 274615
  misc_feature: Encodes the peptide sequence at SEQ ID NO. 2436
gtcggcgagggcgagaagcggcggcaggcaggcaggcaggcacagctcttagctctgccctgcagtgcgcgcgagcgcgacgggggtgctgtgctgccgcagcggcgggagaccatggcaacggtgccgttgccgtggccgagcgtgaggaggtcgctgcaggagggggccgccagcgcggcgtcgtacgcgcggcgagctccgcggcccgcggccacggtgaggtcggtggagacgctggtggtgatcgtggccgcgatcgtgctcgccgccgtgctggcgggcgtcctcgcgcgggtctgtggcgggcggcacgtcgtgccgagcgcccagtaccacgacgaggaaggctgggtggagaggcgctgccggagctgcctcgacagcgggctgccgccgccggagcagggggcgtccaagacgagcgaggccaaatagcgtcattgtgcattgtggtagtactacttgtagtgctagcctagtagcctgctgcgtactagtactgtgctgtgctgctgtagtattatagtaatactactagcgtttgtctaggcaattaattactgcaggcttcttatcagcgtattgtacacaggagtggtacgaggctaggactaggacatcatcaggcattaatcctcgttgcagtatttttgtacgatatattggtagcaaagtaaacttattatgccccattcagttttacaaaaaaaaaaaaaaaaaa

SEQ ID NO: 2436 - protein, 107 aa, Zea mays
  misc_feature: Ceres CLONE 274615
MATVPLPWPSVRRSLQEGAASAASYARRAPRPAATVRSVETLVVIVAAIVLAAVLAGVLARVCGGRHVVPSAQYHDEEGWVERRCRSCLDSGLPPPEQGASKTSEAK

SEQ ID NO: 2437 - DNA, 216 bp, Zea mays
  misc_feature: Ceres CLONE 274618-F
  misc_feature: Encodes the peptide sequence at SEQ ID NO. 2438
  misc_feature (44)..(44): n is a, c, t, g, unknown, or other
  misc_feature (121)..(121): n is a, c, t, g, unknown, or other
  misc_feature (146)..(146): n is a, c, t, g, unknown, or other
aacgctctccgccgccacttctcctccggcatcgacgaggcganscaagcgcccgaktccctctccctgctcccacgacccattggcggcggatatggcgtacsgcsccgatgaaggcgcncaaggccgggttcgaggctggcatnatggatccgcagcacaggatccgcatcacgctctcctccaagagcgtcaagaacctcgagaaaktctgcg

SEQ ID NO: 2438 - protein, 35 aa, Zea mays
  misc_feature: Ceres CLONE 274618-F
  misc_feature (4)..(4): Xaa is any aa, unknown, or other
  misc_feature (12)..(12): Xaa is any aa, unknown, or other
  misc_feature (34)..(34): Xaa is any aa, unknown, or other
MKAXKAGFEAGXMDPQHRIRITLSSKSVKNLEKXC

SEQ ID NO: 2439 - DNA, 176 bp, Zea mays
  misc_feature: Ceres CLONE 274620-F
  misc_feature (146)..(146): n is a, c, t, g, unknown, or other
gtttcgccgaaccccaaaccctagcttcgctcgttgcggcggcgagcggcgatggcgaagtctctgcgatccaaacgcgagaagsggcttcagacgttgcgccgggagatagcggmscgttctacgacaagaaggaggccgccaanctcgccgcgcaggccgccgccctagctgct

SEQ ID NO: 2440 - DNA, 341 bp, Zea mays
  misc_feature: Ceres CLONE 274643-F
  misc_feature: Encodes the peptide sequence at SEQ ID NO. 2441
  misc_feature (190)..(190): n is a, c, t, g, unknown, or other
  misc_feature (214)..(214): n is a, c, t, g, unknown, or other
  misc_feature (230)..(230): n is a, c, t, g, unknown, or other
  misc_feature (331)..(331): n is a, c, t, g, unknown, or other
  misc_feature (336)..(336): n is a, c, t, g, unknown, or other
cagcaaaagcttccagtcttgttggctccgttcctccatgaaccagtagcctctstccaatccccatctcctcttcctggggttttcggtcagtgtsttggcttgtgtcggggtcgcaatggtgaaggacggcggcgtgaagaaggtggcggtggcggcgcggcgcsgagaagcgacgccaaccggcctnaccgcgacgccgaccctcaccgtnaagctaccggcaccanaggcgcgggagaagtgctataagaagacggtggggagattckacgttcctggagatcgctaaggactacttcaaccaattcaagaggtacccgctcaaaancactngatct

SEQ ID NO: 2441 - protein, 57 aa, Zea mays
  misc_feature: Ceres CLONE 274643-F
  misc_feature (17)..(17): Xaa is any aa, unknown, or other
  misc_feature (38)..(38): Xaa is any aa, unknown, or other
  misc_feature (52)..(52): Xaa is any aa, unknown, or other
MVKDGGVKKVAVAARRXEATPTGLTATPTLTVKLPAPXAREKCYKKTVGRFXVPGDR

SEQ ID NO: 2442 - DNA, 280 bp, Zea mays
  misc_feature: Ceres CLONE 274663-F
  misc_feature: Encodes the peptide sequence at SEQ ID NO. 2443
  misc_feature (210)..(210): n is a, c, t, g, unknown, or other
agtgttgttacataatattcctccgttgttctctagctactgcctactggcgttaccagatcgaaggaaagacgggcgatccatggagatggaactggaggctgctgcgcgctggctacgtgcaggagggacgggcggaggctggtgaggtgcccgcggctgcagctggacaccgagacggccacggccatcgaacgttccacggggganagcgtcgccgccgascgccgagggccgatgcsgtcaagatcgtgctcagcaagcagcagctcaagcaggt

SEQ ID NO: 2443 - protein, 92 aa, Zea mays
  misc_feature: Ceres CLONE 274663-F
  misc_feature (70)..(70): Xaa is any aa, unknown, or other
  misc_feature (75)..(75): Xaa is any aa, unknown, or other
CCYIIFLRCSLATAYWRYQIEGKTGDPWRWNWRLLRAGYVQEGRAEAGEVPAAAAGHRDGHGHRTFHGGXRRRRXPRADAVKIVLSKQQLKQ

SEQ ID NO: 2444 - DNA, 523 bp, Zea mays
  misc_feature: Ceres CLONE 274667-F
  misc_feature: Encodes the peptide sequence at SEQ ID NO. 2445
attagtccactcacaagtgacaagatatattttagacattttaagtttgataatggatccaagatatgttactttattcatcttcttagtacttgccttacagtggagatactacttttgcagaaacttgcaggcagttcgttaaagtgcatccattctgctttaaagcaatgtgcaaggcaaattgtgctatagagggaaaattctctgatggttcctatgtaaaggattacagatgtgaatcaggtggatttcactcagtgtgcgtttgcattttttgcaaacattagttatctaaagacaagcggagatatcttcttgtattcctatatgttatttaggagtattgtcaaataattatatggtagcttagttaactagctagtttgtttatttatagacatatgtagcactagttaactagttggtatttcttaaattcttagctatataccaggaaacatgttttcagcgcttcaataatgtatctttgttctcccttattataaagttycaatacttt

SEQ ID NO: 2445 - protein, 39 aa, Zea mays
  misc_feature: Ceres CLONE 274667-F
MCKANCAIEGKFSDGSYVKDYRCESGGFHSVCVCIFCKH

SEQ ID NO: 2446 - DNA, 132 bp, Zea mays
  misc_feature: Ceres CLONE 274697-F
acacgcacaccgcgacccagtccagagccagtacgtgcgamggcacgcacgctgctggtccgcgtacbagacgacggtcaggtcggccggtgcttttcagtttggaataatgacggckacgacgacgacagc

SEQ ID NO: 2447 - DNA, 328 bp, Zea mays
  misc_feature: Ceres CLONE 274735-F
  misc_feature: Encodes the peptide sequence at SEQ ID NO. 2448
acaaccaagctcgatccatctcactctccgctggtcgctcactcttgcagctccacccttcactcagtcttagtctcttattagctctaggctctagctagccgcgccactccttcgtgtagccatcagccttctcatcgybaccaatggccactgccgaggtccagaccccgaccgtcgtggcggccgaggaagcgcccgtggtggagaccccgccgccggccgtcgtgcccgaggagtctgcccccgccgaggccgaggccgagcaaggctgctgctcctgctgatcccgaggagcttcccgcggccgagcagcaggcagccgccg

SEQ ID NO: 2448 - protein, 46 aa, Zea mays
  misc_feature: Ceres CLONE 274735-F
MATAEVQTPTVVAAEEAPVVETPPPAVVPEESAPAEAEAEQGCCSC

SEQ ID NO: 2449 - DNA, 450 bp, Zea mays
  misc_feature: Ceres CLONE 274736-F
  misc_feature: Encodes the peptide sequence at SEQ ID NO. 2450
  misc_feature (438)..(438): n is a, c, t, g, unknown, or other
aggaatcatgatgcagcagcctcaggcgcatgcktcggcacttgcggtggcgcacccgcacgatccggcgggckggggacgcgccgccaaagcaggtggctcaggcgatggagcggctgggccgtgcgggccgtctcatcgcagacatccggctcggcgcggaccgcctcctcgaggccctcttcgtctccggcgacgcgcccccgtacagcgtgcgccabhcgacaggatggagcacawttatcgtcaaggaggatgccgccatgcgcctccacttccaggacytacgcgccctcggcaggcaactagaggagtctggagttcttaatggggcccttaaagctcgaggcaattcatggggcttgcacatgccacttgttttgttccagatgggtgctgttgtagcttatgcttggaagcgacaactaggcgggtcangccggtgcatct

SEQ ID NO: 2450 - protein, 140 aa, Zea mays
  misc_feature: Ceres CLONE 274736-F
  misc_feature (2)..(2): Xaa is any aa, unknown, or other
  misc_feature (64)..(64): Xaa is any aa, unknown, or other
  misc_feature (65)..(65): Xaa is any aa, unknown, or other
  misc_feature (71)..(71): Xaa is any aa, unknown, or other
  misc_feature (137)..(137): Xaa is any aa, unknown, or other
MXRHLRWRTRTIRRAGDAPPKQVAQAMERLGRAGRLIADIRLGADRLLEALFVSGDAPPYSVRXXTGWSTXIVKEDAAMRLHFQDLRALGRQLEESGVLNGALKARGNSWGLHMPLVLFQMGAVVAYAWKRQLGGSXRCI

SEQ ID NO: 2451 - DNA, 151 bp, Zea mays
  misc_feature: Ceres CLONE 274750-F
  misc_feature (73)..(73): n is a, c, t, g, unknown, or other
ctattgtcagcatcgctctccaaatcccaaaaccctaacctatccatcgtcgccaccgtttacygtcgctkgncgccaatatgggagcaagaggaggaggaggaggcggccgcaacggcaactttgckaccttccgcctcttcccgcgcgc

SEQ ID NO: 2452 - DNA, 421 bp, Zea mays
  misc_feature: Ceres CLONE 274761-F
  misc_feature: Encodes the peptide sequence at SEQ ID NO. 2453
  misc_feature (171)..(171): n is a, c, t, g, unknown, or other
  misc_feature (393)..(393): n is a, c, t, g, unknown, or other
gaaaaaaggaagacagagaaggaaacggcagtragtcgccggcgccgscgacaggaggaaggagggagtagcagcggcaggggaggtccggcgatctcggctgctgtggcgcggtaagggaggaagcggaccgcgacaggatgcactcgtttggkcaccgcgccaacggtncaacgtttgcggtcaccatactggccgcgatgtgcttcgccgcctccttctccgacaattttaacaccctgacacccaccgcatccgtcaagatcttgaatataaactggttccagaaggaggccaacggcaatgacgaggtcagcatgacgctgaacatttcggctgacctttcatctcttttcacgtggaacacaaaacaggtatttgtttttgtggcancagagtatgagactcgacaaaatgcttt

SEQ ID NO: 2453 - protein, 93 aa, Zea mays
  misc_feature: Ceres CLONE 274761-F
  misc_feature (1)..(93): Pfam Name: SPC22 Pfam Description: Signal peptidase subunit
  misc_feature (11)..(11): Xaa is any aa, unknown, or other
  misc_feature (85)..(85): Xaa is any aa, unknown, or other
MHSFGHRANGXTFAVTILAAMCFAASFSDNFNTLTPTASVKILNINWFQKEANGNDEVSMTLNISADLSSLFTWNTKQVFVFVAXEYETRQNA

SEQ ID NO: 2454 - DNA, 416 bp, Zea mays
  misc_feature: Ceres CLONE 274764-F
  misc_feature: Translation starting site: 301
  misc_feature (94)..(94): n is a, c, t, g, unknown, or other
gtcacagcgagtaccgagtaggagcaaccgcttgsktcagacgcacactgacggagagtgatcactgatttctggtcatggcaaccgtaacthnggaagttgctccggtcgtcaccgtctccgaggagccggcgccggaagcggcaaggaggtggtggagaagccggagggaagaatgcccgacgaggagggtgacgagaggaagaaggccgaccccgccgccgagaaggagaagawggckaggwwkccgcggacaggaagcccaagtccgccgggctgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaa

SEQ ID NO: 2455 - DNA, 475 bp, Zea mays
  misc_feature: Ceres CLONE 274771-F
  misc_feature: Encodes the peptide sequence at SEQ ID NO. 2456
gttcctcctgtcatctcctcctcctcagaaacccaccaaccccgtccagccgccggktytcggccgtcgccgccgccgccgccgccctatcccggtccttcaggtgaaccaggttggccatggccttcaacaagatcaaggtcgccaaccccatcgtcgagatgacggcgatgagatgaccagggtgttctggaaatctatcaaggacaagcttatattccctttcgtagacctcgacatcaaatattttgacctcgggcttccacaccgtgatgctaccgacgacaaagtcacattggaggctgcggaggccacactcaagtacaatgtggctatcaagtgtgccaccattacaccagatgaagcaagggtaaaggagtttggcttgaaggctatgtggaagagcccaaatggcacaattaggaatattctgaatggcactgtgttcagagaaccaatcatctgcaaaaacatc

SEQ ID NO: 2456 - protein, 100 aa, Zea mays
  misc_feature: Ceres CLONE 274771-F
  misc_feature: SWISSPROT Homolog: EC 1.1.1.42 Isocitrate dehydrogenase (NADP(+))
MTRVFWKSIKDKLIFPFVDLDIKYFDLGLPHRDATDDKVTLEAAEATLKYNVAIKCATITPDEARVKEFGLKAMWKSPNGTIRNILNGTVFREPIICKNI

SEQ ID NO: 2457 - DNA, 246 bp, Zea mays
  misc_feature: Ceres CLONE 274803-F
  misc_feature (2)..(2): n is a, c, t, g, unknown, or other
  misc_feature (203)..(203): n is a, c, t, g, unknown, or other
anttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgsctctcgsgcgtgccscacccacgtctcccgcgagttccacgccttctgtgccacgcgcggacncaaccttggagccactgttsgccgcgccctccgcatctccgac

SEQ ID NO: 2458 - DNA, 489 bp, Zea mays
  misc_feature: Ceres CLONE 274812-F
  misc_feature: Translation starting site: 195
  misc_feature: SWISSPROT Homolog: EC 1.2.1.24 Succinate-semialdehyde dehydrogenase
  misc_feature (277)..(277): n is a, c, t, g, unknown, or other
gtcgttttcctagttcgcacacccatccgccggcggcctccccccgtctcgatagtcgataccaggttctaaatggcgatggcgatgatggctatgcgacgcgcggtggcgtcggcstcgccacatccccgccgccgcagcctcttcgttccgagtcgtctccctccgccacatgagcgcggacsgtgcgccgcatggagaagatccgcgccgccgggctgctcaggacgcaggggcttatcgctggggcagtgggttggacgcctackacggaaanaccattgagggtgcaaaatccagcaactggtgaggtcctggcaaacgtgtcctgtatgggcagcagagaaacatctgatgctattgcttctgctcacagtacattctattcttggagtaaactcactgcaagkratggagcaaggcactaagaaaatggtacgatctaattatttcacacaaggaagagcttgcacttctcatgacactgga

SEQ ID NO: 2459 - DNA, 454 bp, Zea mays
  misc_feature: Ceres CLONE 274817-F
  misc_feature: Translation starting site: 293
  misc_feature (38)..(38): n is a, c, t, g, unknown, or other
  misc_feature (333)..(333): n is a, c, t, g, unknown, or other
  misc_feature (434)..(434): n is a, c, t, g, unknown, or other
gcggatagagcagcgagccatcgacacgatcgcgagcncaasacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacasrgcttgtggttcgcgtccaagcagtccctctcctacctcgatggcacgctgcccggcgactatggcttcgacccgctgggcctctcggacccggagcaccgngggcttcatcgagcccaagtggctggcctatggcgaggtgatcaacggccgctacgccatgctgggcgcggtgggcgcatcgcccggagatcttcggcaanatgggcatcatccccccgga

SEQ ID NO: 2460 - DNA, 329 bp, Zea mays
  misc_feature: Ceres CLONE 274826-F
  misc_feature: Encodes the peptide sequence at SEQ ID NO. 2461
  misc_feature (142)..(142): n is a, c, t, g, unknown, or other
acaaccaagctcgatccatctcactctccgctggtcgctcactcttgcagctccacccttcactcagtcttagtctcttattagctctaggctctagctagccgcgccactccttcgtgtagccatcagycttctcatcgbnaccaatggccactgccgaggtccagaccccgaccgtcgtggcggccgaggaagcgcccgtggtggagaccccgccgccggccgtcgtgcccgaggagtctgcccccgccgaggccgaggccgagscgagggtgctgctcctgctgatcccgaggagcttcccgcggccgagcagcaggcagccgccg

SEQ ID NO: 2461 - protein, 61 aa, Zea mays
  misc_feature: Ceres CLONE 274826-F
  misc_feature (41)..(41): Xaa is any aa, unknown, or other
MATAEVQTPTVVAAEEAPVVETPPPAVVPEESAPAEAEAEXRVLLLLIPRSFPRPSSRQPP

SEQ ID NO: 2462 - DNA, 606 bp, Zea mays
  misc_feature: Ceres CLONE 274837-R
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (90)..(90): n is a, c, t, g, unknown, or other
  misc_feature (95)..(95): n is a, c, t, g, unknown, or other
  misc_feature (97)..(97): n is a, c, t, g, unknown, or other
  misc_feature (100)..(100): n is a, c, t, g, unknown, or other
  misc_feature (103)..(103): n is a, c, t, g, unknown, or other
  misc_feature (104)..(104): n is a, c, t, g, unknown, or other
  misc_feature (107)..(107): n is a, c, t, g, unknown, or other
  misc_feature (109)..(109): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (116)..(116): n is a, c, t, g, unknown, or other
  misc_feature (117)..(117): n is a, c, t, g, unknown, or other
  misc_feature (119)..(119): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (157)..(157): n is a, c, t, g, unknown, or other
  misc_feature (281)..(281): n is a, c, t, g, unknown, or other
ntttttttttnnnnnnnntcacccccccccccccccctnnnnnggnnnnnnngcgtgtggggggggaccccgcggggtgtggtggaaaancccgngnggnttnnctntntnnnttnntnttgtgnnnnnnnccgattgggtacgggccccccctcgnagtcgacggtatcgatattttttttttttttttttaacaaaccacggtttccaaccggggtggaatttataagatagattgagttgcatagtcacctacattaagctaacaaacaagtcacggnacacaccgcgccttggggtcagggttacaggcaacctgaaacaagaaaagaagcattctttaatttttcgcccccggggggttaattacttttaaaccccccccaccccccccctgggtaaaagggaaaaaatttttcccctctccaaattggggttggggggggccccccccccccaattagggggttgtggcccccgggggggatttttttttttttaaaaaaaaatttttttgggggggcccctttggggggaccccccccccccccagggggaaatgggggggcccaaaaaaaaaatttttttttttacgccccccccgaa

SEQ ID NO: 2463 - DNA, 424 bp, Zea mays
  misc_feature: Ceres CLONE 274879-F
  misc_feature: Encodes the peptide sequence at SEQ ID NO. 2464
  misc_feature (383)..(383): n is a, c, t, g, unknown, or other
aacaacaccagaatccgcgaatcacagacgcgtctatctcagcttgctgcactgcactaccctgccctgccatcatatcgtacgtgagcccggccgagcgagasmgggaagaggcatggctgctccgaagctcgcgacgctggcgctggccgtgctcctggcggcgaccgtggtggctcccccggccgcggtgcgcgcgsgaatgtcgtgctccaccgtgtacagcacgctgatgccgtgcctgccgttcgtccagatgggcggggccatgccgccccagccgtgctgcggcgcatccgcagcctgctgcagcascaacaacacccccgaccgccgcaccatctgcggctgcctcaagaacgtcgccaacggcccaacgggancggcacctacatcagccgcgccgccgsttgcccagcaagtg

SEQ ID NO: 2464 - protein, 103 aa, Zea mays
  misc_feature: Ceres CLONE 274879-F
  misc_feature (29)..(29): Xaa is any aa, unknown, or other
  misc_feature (67)..(67): Xaa is any aa, unknown, or other
  misc_feature (90)..(90): Xaa is any aa, unknown, or other
  misc_feature (99)..(99): Xaa is any aa, unknown, or other
MAAPKLATLALAVLLAATVVAPPAAVRAXMSCSTVYSTLMPCLPFVQMGGAMPPQPCCGASAACCSXNNTPDRRTICGCLKNVANGPTGXAPTSAAPPXAQQV

SEQ ID NO: 2465 - DNA, 164 bp, Zea mays
  misc_feature: Ceres CLONE 274881-F
atttttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgc

SEQ ID NO: 2466 - DNA, 485 bp, Zea mays
  misc_feature: Ceres CLONE 274882-F
  misc_feature: Encodes the peptide sequence at SEQ ID NO. 2467
  misc_feature (154)..(154): n is a, c, t, g, unknown, or other
aacactagtcaaattttacgtaacttgcgtggttctcttcctgcgacggaascaaacactgcccgagacatagacagcgggacgtcgagatggccgacggggaggacgccgccgccgcgckcygccgggccgccatcacagactaccgcaagangctgctcaactgcagggagctagagtmgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaa

SEQ ID NO: 2467 - protein, 132 aa, Zea mays
  misc_feature: Ceres CLONE 274882-F
  misc_feature (11)..(11): Xaa is any aa, unknown, or other
  misc_feature (12)..(12): Xaa is any aa, unknown, or other
  misc_feature (22)..(22): Xaa is any aa, unknown, or other
  misc_feature (31)..(31): Xaa is any aa, unknown, or other
MADGEDAAAAXXRAAITDYRKXLLNCRELEXRVGTVRESLKTAKKDFTKTEDDLKSLQSVGQIIGEVLRPLDNERFIVKASSGPRYVVGCRSKVDKEKLTSGTRVVLDMTTLTIMRTLPREVDPVVYNMLHE

SEQ ID NO: 2468 - DNA, 332 bp, Zea mays
  misc_feature: Ceres CLONE 274926-F
  misc_feature: Encodes the peptide sequence at SEQ ID NO. 2469
atcaccaagttttggattccagcagcggcgcccccaggccaggccccacccgctcagcctcctcagctgccccaaccttctccccatctgctcagcctcagctgtcattcccgcgavcgtctcccggctctatcgatggaccgagtcgccgccctcgtcgtcgcgctcctcgccctcttcttcgccgccggggccacggscaggccccggcctcgtcgcccaagcgcactccagcgccasccacccaggacggccttcctcccgccgccgccgccagggcgcctatggcctccccgccctcgcctcccgcgatggcgccggktgcccgcgcc

SEQ ID NO: 2469 - protein, 65 aa, Zea mays
  misc_feature: Ceres CLONE 274926-F
  misc_feature (22)..(22): Xaa is any aa, unknown, or other
  misc_feature (35)..(35): Xaa is any aa, unknown, or other
  misc_feature (63)..(63): Xaa is any aa, unknown, or other
MDRVAALVVALLALFFAAGATXRPRPRRPSALQRXPPRTAFLPPPPPGRLWPPRPRLPRWRRXPA

SEQ ID NO: 2470 - DNA, 215 bp, Zea mays
  misc_feature: Ceres CLONE 274928-F
  misc_feature: Encodes the peptide sequence at SEQ ID NO. 2471
  misc_feature (126)..(126): n is a, c, t, g, unknown, or other
actcatacatttcgactctcaactcccaatgtccctttttttttctcgatctggaagcgccgcagtagcagccatggacgtgagcggacaggcggtaaggcgaagaagggcgcggcggggcgcaangccggcgggcgagcgaagaagtcggtgtcgcggtcctccagggccgggctgcagttccccgtcagccgcgtcgggcgtgacctcaaaaa

SEQ ID NO: 2471 - protein, 71 aa, Zea mays
  misc_feature: Ceres CLONE 274928-F
  misc_feature (42)..(42): Xaa is any aa, unknown, or other
THTFRLSTPNVPFFFSIWKRRSSSHGRERTGGKAKKGAAGRXAGGRAKKSVSRSSRAGLQFPVSRVGRDLK

SEQ ID NO: 2472 - DNA, 113 bp, Zea mays
  misc_feature: Ceres CLONE 274929-F
acacgcacaccgcgacccagtccagagccagtacgtgcgamrgcacgcacgctgctggtccgcgtacsagaacgacggtcaggtcggccggtgcttttcagtttggaataatg

SEQ ID NO: 2473 - DNA, 264 bp, Zea mays
  misc_feature: Ceres CLONE 274958-F
  misc_feature: Encodes the peptide sequence at SEQ ID NO. 2474
  misc_feature (113)..(113): n is a, c, t, g, unknown, or other
accaagttttggattccagcagcggcgcccccaggccaggccccacccgctcagcctcctcagctgcccaaccttctccccatctgctcagcctcagctgtcattcccgcgancgtctcccggctctatcgatggaccgagtcgccgccctcgtcgtcgcgctcctcgccctcttcttcgccgccggggccacggcgcaggccccggcctcgtcgcccaagcgcactccagcgccasctcaacccaggacggccttcctcccgc

SEQ ID NO: 2474 - protein, 44 aa, Zea mays
  misc_feature: Ceres CLONE 274958-F
  misc_feature (36)..(36): Xaa is any aa, unknown, or other
MDRVAALVVALLALFFAAGATAQAPASSPKRTPAPXQPRTAFLP

SEQ ID NO: 2475 - DNA, 367 bp, Zea mays
  misc_feature: Ceres CLONE 274969-F
  misc_feature (334)..(334): n is a, c, t, g, unknown, or other
ctcctcctctctctctctccacatttcctctcccgataagagtgaggcctcggctcagcttgagcttcccctccctcccctcctgcgctccagctcccctccatcctcggccaaaaattctgcggcgagctccgatccggtccgactactaacccacgccgcagaagccgcgcgacctgatcgcssggggtcgaggagaggggaagcgcggcgccgcggtttgcctgccaccgtaccgccgcagagaaggaagaggagcccgtatccctccgccccgctgcccgccggaccgatggactccgagcactggatctcgcgcctggccgccgcgaanttctacgcggcgcactcggccacagcgatcggg

SEQ ID NO: 2476 - DNA, 458 bp, Zea mays
  misc_feature: Ceres CLONE 274972-F
  misc_feature: Translation starting site: 23
  misc_feature: Pfam Name: Rick_17kDa_Anti Pfam Description: Rickettsia 17 kDa surface antigen
  misc_feature (378)..(378): n is a, c, t, g, unknown, or other
aacaagcgaaccgacggcggcgatggggatcggtgagcacttcgagggcgtcaasagcactgggcgagcaacttcgccttcctcgactacttcaagaaggtctacggccgcgcsagcccctccccaagtggtccgacgccgacgtsacgagttcatcgcatccgacccggtctacgggccccagctcaaggccctgcgggagtcgaggaagttcgcgctcgccggggccctcgtcggcgccgccacctcggcggstcgcgctcaagtactccaaggcgccgcacgktcctgctggcgaccggcttcggcgcgatcaccggcgccgtgctgggatccgaggtggcggaccactggtaccagctctacgagatggacaancaggggggccaacctcaggttcatctactggtgggaaggacaatgtctcaggccaaaagagctgaaccacatcgagtgat

SEQ ID NO: 2477 - DNA, 295 bp, Zea mays
  misc_feature: Ceres CLONE 274995-F
  misc_feature: Encodes the peptide sequence at SEQ ID NO. 2478
  misc_feature (25)..(25): n is a, c, t, g, unknown, or other
aagaacagctgtcgatccaattgtnacttgctctccctccaacaagctaattaaggccggtcgtcatccctcttctagctcgttttattatccatggcggaggagaagcaccaccaccaccacctgttccaccataagaaggacgaggagcaggaggagcagctcgccggcgsggttacggcgagtccgccagttacacggaggccacggtgacggaggtggtgtccacgggcgagaacgagtacgacgagtacaaggaggagaagcagcataagcacaagcagcacctcggcga

SEQ ID NO: 2478 - protein, 39 aa, Zea mays
  misc_feature: Ceres CLONE 274995-F
  misc_feature (27)..(27): Xaa is any aa, unknown, or other
MAEEKHHHHHLFHHKKDEEQEEQLAGXVTASPPVTRRPR

SEQ ID NO: 2479 - DNA, 301 bp, Zea mays
  misc_feature: Ceres CLONE 275058-F
  misc_feature: Translation starting site: 46
  misc_feature (61)..(61): n is a, c, t, g, unknown, or other
  misc_feature (163)..(163): n is a, c, t, g, unknown, or other
  misc_feature (166)..(166): n is a, c, t, g, unknown, or other
  misc_feature (169)..(169): n is a, c, t, g, unknown, or other
  misc_feature (183)..(183): n is a, c, t, g, unknown, or other
  misc_feature (237)..(237): n is a, c, t, g, unknown, or other
  misc_feature (283)..(283): n is a, c, t, g, unknown, or other
gaaaaccaaatctctctgtctactaggcgggagagtgagacggccatggcggaggcgcaanctaagttaccggcgcaaggtcccgacgaggcgcccctcgatgcgtccgccattcagagccgggtggagcagctctcattgaaaaggctggaggtggagccgnasnaanggtggcggaggatnaggtggcactaggtttggactccacgcacaaggcggctcaggatscgatggatnattgggactcggccactgctgcggttttcaattgatgatttggatncatacctggaacaactga

SEQ ID NO: 2480 - DNA, 467 bp, Zea mays
  misc_feature: Ceres CLONE 275068-F
  misc_feature: Encodes the peptide sequence at SEQ ID NO. 2481
ayattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtacctcccaggctgactgtgctgtcctgatcattgactccaccactggtgtttt

SEQ ID NO: 2481 - protein, 122 aa, Zea mays
  misc_feature: Ceres CLONE 275068-F
  misc_feature (5)..(122): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGV

SEQ ID NO: 2482 - DNA, 504 bp, Zea mays
  misc_feature: Ceres CLONE 275084-F
  misc_feature: Encodes the peptide sequence at SEQ ID NO. 2483
aaccaaaaccaaatccagaactctccctgggaatttggtggccgatttgccgccgcgtgggtgtggtggggcatgcgccgaacgactcctgcgtcggagctcaagcgcctcggggtctccagcaatggtatgaccatcatcggagctcgctgctcgtggatggtggcgaggcaacgtcgccagctccatcctcgtcacacccgcgcgtgaggacacgtgtcacctgaagaccatcctgatacctggaatctcaagtcccaggtcaagagcaggtaccacaggatgaggcgcatggaggatgctgtgacgagttcgtgagaggtctaggccgtcgtctcccagtcaactttgggttgctggaccgttgtctccatataatgtaattatttatttattttgtacaaaactccgattatatagtaaagatgtgacattcgatcctgtgccatgattcatcatatgtgtgagacttggtcccagcacacctgggtgattatgttcgcg

SEQ ID NO: 2483 - protein, 69 aa, Zea mays
  misc_feature: Ceres CLONE 275084-F
NQNQIQNSPWEFGGRFAAAWVWWGMRRTTPASELKRLGVSSNGMTIIGARCSWMVARQRRQLHPRHTRA

SEQ ID NO: 2484 - DNA, 366 bp, Zea mays
  misc_feature: Ceres CLONE 275088-F
  misc_feature: SWISSPROT Homolog: EC 5.2.1.8 Peptidylprolyl isomerase
  misc_feature (3)..(3): n is a, c, t, g, unknown, or other
  misc_feature (177)..(177): n is a, c, t, g, unknown, or other
  misc_feature (184)..(184): n is a, c, t, g, unknown, or other
  misc_feature (185)..(185): n is a, c, t, g, unknown, or other
  misc_feature (187)..(187): n is a, c, t, g, unknown, or other
gtnctttcttacaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccactccctccacaabnccttcanncnyhacggcgaggtcctcgagtccaagatcatcctcgatcgggagacgcagaggtcccgcggcttcggcttcgtcaccttctccacggaggaggcgatgcggaacscatcgagggcatgaacggcaaggagctggacggccgcaacatcaccgtcaacgaggcccagtcccgcggcggccg

SEQ ID NO: 2485 - DNA, 249 bp, Zea mays
  misc_feature: Ceres CLONE 275105-F
  misc_feature (171)..(171): n is a, c, t, g, unknown, or other
  misc_feature (212)..(212): n is a, c, t, g, unknown, or other
  misc_feature (218)..(218): n is a, c, t, g, unknown, or other
gaaggccgagctcatccaatccagtcgcctgattgcattgggatcccatggccaagctcgccgtcctcctcctcctcctcgccgtggccgcgtccgccacagtgccggtgcacgccgcgataccccgactgagatcaagctcatcaaaggcacgacgcctccggcggggcngacgacagcatggagtgcgtgtacacggtgttcatccgganggggtngatcctgaaggccgggacgacgcgaacgtca

SEQ ID NO: 2486 - DNA, 187 bp, Zea mays
  misc_feature: Ceres CLONE 275121-F
  misc_feature: Encodes the peptide sequence at SEQ ID NO. 2487
  misc_feature (92)..(92): n is a, c, t, g, unknown, or other
akagctagtatgtagccgaacctccgcccgcccgcgacccaaaagccgaaagcccaaaaccagaggcgggtagggttctagctgcaggcgancggccatggcscctccgccgccgccccggsttgcttcgacgcctcttctgcagctctattccagcctcctcctccgtactgcgcgctaccttttg

SEQ ID NO: 2487 - protein, 30 aa, Zea mays
  misc_feature: Ceres CLONE 275121-F
  misc_feature (9)..(9): Xaa is any aa, unknown, or other
MAPPPPPRXASTPLLQLYSSLLLRTARYLL

SEQ ID NO: 2488 - DNA, 92 bp, Zea mays
  misc_feature: Ceres CLONE 275129-F
  misc_feature: Encodes the peptide sequence at SEQ ID NO. 2489
aaccgcgctccggttctccccaattctaagcsagacggggcacaggaagaggagagcctaaaacccttaaccccccgaatcggatccggccg

SEQ ID NO: 2489 - protein, 30 aa, Zea mays
  misc_feature: Ceres CLONE 275129-F
  misc_feature (11)..(11): Xaa is any aa, unknown, or other
NRAPVLPNSKXDGAQEEESLKPLTPRIGSG

SEQ ID NO: 2490 - DNA, 208 bp, Zea mays
  misc_feature: Ceres CLONE 275135-F
  misc_feature: Pfam Name: Cu_bind_like Pfam Description: Plastocyanin-like domain
  misc_feature (187)..(187): n is a, c, t, g, unknown, or other
atcgtcgcgctggtcgcygccgccgggtgcgcgcctgcttcggccacgtcgtacaccgtcggcgactcgcagggctggacgaccaccggcgtagactacagcagctgggccagccgcaacactttcgtcgtcggagmacactagtgttcaactacgtgagcaaggcgcacacggtgacggaggtgancaaggccggctacgacgcctg

SEQ ID NO: 2491 - DNA, 289 bp, Zea mays
  misc_feature: Ceres CLONE 275160-F
  misc_feature: Encodes the peptide sequence at SEQ ID NO. 2492
actcatacatttcgactctcaactcccaaggtcccttttttttctcgatctggaagcgccgcagtagcagccatggacgtgagcggasaggcggtaaggcgaagaagggcgcggcggggcgcaaggccggcgggcgagcgaagaagtcggtgtcgcggtcctccagggccgggctgcagttccccgtcagccgcgtcgggcggtacctcaaaaagggccggtacacgcagcgtktaggcacgggtcccccgtctacctcgccgccgtcctggagtacctcgcggccgag

SEQ ID NO: 2492 - protein, 95 aa, Zea mays
  misc_feature: Ceres CLONE 275160-F
  misc_feature (29)..(29): Xaa is any aa, unknown, or other
  misc_feature (78)..(78): Xaa is any aa, unknown, or other
SYISTLNSQGPFFFSIWKRRSSSHGRERXGGKAKKGAAGRKAGGRAKKSVSRSSRAGLQFPVSRVGRYLKKGRYTQRXGTGPPSTSPPSWSTSRP

SEQ ID NO: 2493 - DNA, 287 bp, Zea mays
  misc_feature: Ceres CLONE 275175-F
  misc_feature (127)..(127): n is a, c, t, g, unknown, or other
  misc_feature (128)..(128): n is a, c, t, g, unknown, or other
  misc_feature (142)..(142): n is a, c, t, g, unknown, or other
  misc_feature (180)..(180): n is a, c, t, g, unknown, or other
  misc_feature (279)..(279): n is a, c, t, g, unknown, or other
ggccagatcawacgaatcggcagacgcatcggcatcgctccgacgatcttgagacaaacaaaacccaccgctgcggcaactccgcctcccgctgacacggggatcgcctgacaacaggyagagaaannaggcgcagggtttncccgcgaagatsgaggacgtggacgtctcgcggcactnaagcagatgacgaacttcatccgccagatgccgtcgakaaggcckccgagatcgaggccgccgccgccgaagagttccaaatagaaaagttacagcttntggaagct

SEQ ID NO: 2494 - DNA, 473 bp, Zea mays
  misc_feature: Ceres CLONE 275179-F
  misc_feature: Encodes the peptide sequence at SEQ ID NO. 2495
  misc_feature (170)..(170): n is a, c, t, g, unknown, or other
  misc_feature (245)..(245): n is a, c, t, g, unknown, or other
  misc_feature (257)..(257): n is a, c, t, g, unknown, or other
  misc_feature (341)..(341): n is a, c, t, g, unknown, or other
  misc_feature (458)..(458): n is a, c, t, g, unknown, or other
aaagaaaagcctccattcccgagtctccagccaaccgcatccagtccaccccatccccctcgaccccgacaaccccgagtcccgacccgatggcgcccaaggccgagaagaagccagcggagtatatgtatagcyggcggccgaggagaaggcggagaagacgaccgcanaagaagcccaagtccgagaagcgcctgcccgcctcgaagtcctccggcaaggagtgcggcgagawgwaggggaanaagaaggccaanaagagcgtggagacctacaaaatctacatcttcaaggtcctgaagcaggtgcaccccgacatcggcatctcctccaaggccatntccatcatgaactccttcatcaacgacatcttcgagaagctcgccggcgaggccgctaagctcgcccggtacaacaagaagcccaccatcacctcccgcgagatccatacctccgtncgcctcgtcctccca

SEQ ID NO: 2495 - protein, 128 aa, Zea mays
  misc_feature: Ceres CLONE 275179-F
  misc_feature (56)..(126): Pfam Name: Histone Pfam Description: Core histone H2A/H2B/H3/H4
  misc_feature (16)..(16): Xaa is any aa, unknown, or other
  misc_feature (27)..(27): Xaa is any aa, unknown, or other
  misc_feature (49)..(49): Xaa is any aa, unknown, or other
  misc_feature (50)..(50): Xaa is any aa, unknown, or other
  misc_feature (52)..(52): Xaa is any aa, unknown, or other
  misc_feature (56)..(56): Xaa is any aa, unknown, or other
  misc_feature (84)..(84): Xaa is any aa, unknown, or other
MAPKAEKKPAEYMYSXRPRRRRRRRPXKKPKSEKRLPASKSSGKECGEXXGXKKAXKSVETYKIYIFKVLKQVHPDIGISSKAXSIMNSFINDIFEKLAGEAAKLARYNKKPTITSREIHTSVRLVLP

SEQ ID NO: 2496 - DNA, 424 bp, Zea mays
  misc_feature: Ceres CLONE 275191-F
  misc_feature: Translation starting site: 119
  misc_feature: Pfam Name: Arf Pfam Description: ADP-ribosylation factor family
  misc_feature (28)..(28): n is a, c, t, g, unknown, or other
  misc_feature (161)..(161): n is a, c, t, g, unknown, or other
  misc_feature (172)..(172): n is a, c, t, g, unknown, or other
  misc_feature (217)..(217): n is a, c, t, g, unknown, or other
  misc_feature (294)..(294): n is a, c, t, g, unknown, or other
  misc_feature (342)..(342): n is a, c, t, g, unknown, or other
  misc_feature (359)..(359): n is a, c, t, g, unknown, or other
gaaagacggagagaggaaaagggacaanggcaaggcaagakagaggcgtcgtcgtttgatctgctkccggagtgcgaagaggaagaggaagaggaagaggagcgccggagttgtaaagatgttcctggtggactggttctatagggtgctggcatcgcttnggctgtggcanaaggaggctaagatcctcttccttggcctcgacaacgccggcaanaccaccctcctccacatgctgaaggacgagcggctcgtacagcaccagccaacgcakaccccacgtcagaagagttnagcatcggcaggatcaagttcaaggcgttcgaccttgggggccaccanatcgcccgccgcgtctngaaggactactacgccaaggttgatgctgttgtgtacttggtggatgctgttacaaggaacgttt

SEQ ID NO: 2497 - DNA, 491 bp, Zea mays
  misc_feature: Ceres CLONE 275211-F
  misc_feature (150)..(150): n is a, c, t, g, unknown, or other
  misc_feature (345)..(345): n is a, c, t, g, unknown, or other
  misc_feature (428)..(428): n is a, c, t, g, unknown, or other
aaaaacgcacacaagcacacgacgcaagggtgacgactgacgagagggggagagagagaggcgaggaaggagggagagagcacgggggcttgatcgaagatggatgccggagcaaaggtggtgaagaaggccgcggcggggcgtcgcgsngggggcggccccaagaagaagccggtctctcgctccgtgaaggccggcctccagttccccgtagccgtatcgsgcttacctcaagcagggtcgctactcccagcgtgtcggcaccggcgcccccgtctacctcgctgccgtcctcgagtacctcgccgccgagctcctcgagttggcggggaacgcagcgcgggnacaacaagaagaaccggatcatcccgcgacacgtactgctggcgatccgcaacgatgaggagctcgggaagctactggccggngtcaccatcgcacacggcggggttctgccaaacatcaaccctgtgttgttccccaagaaaacc

SEQ ID NO: 2498 - DNA, 499 bp, Zea mays
  misc_feature: Ceres CLONE 275219-F
  misc_feature: Encodes the peptide sequence at SEQ ID NO. 2499
  misc_feature (374)..(374): n is a, c, t, g, unknown, or other
  misc_feature (406)..(406): n is a, c, t, g, unknown, or other
ctcacaaccgcsgaasctgtcttccctctccattggacgcggccagcttccatctctcggtcacctccctctacatcccacggccgctaccaccttccctctacctcacacggccgccggcttctccaaggtctgcacacgcattcagcgacgcatttgcctatatcagcactgtggtcataactctagtagagrvvsgagaagatgcaggcatctagggcaaggcttttcaaggagtacaaggaggtacaacgagagaagtcagctgaccctgatatccaattaatatgtgatgattccaacatattcaagtggactgctcttatcaagggcccttctgaaacaccttatgaaggtggtgtgtttcaacttgngttcgcaattccagagcagtatcctctagtgnctcctcaagttcgatttttaaccaaaattttcacccaaatgtgcatttcaagacaggtgaaattygtctttggatatattgaagaatgcatgg

SEQ ID NO: 2499 - protein, 98 aa, Zea mays
  misc_feature: Ceres CLONE 275219-F
  misc_feature (7)..(98): Pfam Name: UQ_con Pfam Description: Ubiquitin-conjugating enzyme
  misc_feature: SWISSPROT Homolog: EC 6.3.2.19 Ubiquitin--protein ligase
  misc_feature (57)..(57): Xaa is any aa, unknown, or other
  misc_feature (68)..(68): Xaa is any aa, unknown, or other
MQASRARLFKEYKEVQREKSADPDIQLICDDSNIFKWTALIKGPSETPYEGGVFQLXFAIPEQYPLVXPQVRFLTKIFTQMCISRQVKFVFGYIEECM

SEQ ID NO: 2500 - DNA, 363 bp, Zea mays
  misc_feature: Ceres CLONE 275274-F
  misc_feature: Encodes the peptide sequence at SEQ ID NO. 2501
  misc_feature (277)..(277): n is a, c, t, g, unknown, or other
  misc_feature (299)..(299): n is a, c, t, g, unknown, or other
  misc_feature (306)..(306): n is a, c, t, g, unknown, or other
  misc_feature (318)..(318): n is a, c, t, g, unknown, or other
gaaaaatcacacactaatcaacaagcaggaccagctagctagctcctctcactgctatcacccgcccagccatctcgctgaaagagaaaagcgcmgcatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtnagggccctttacgcggcggcgnacaccangcccgacagcangccacgtgccgatgcctcaaggcggcctacgttcaggtccacgct

SEQ ID NO: 2501 - protein, 88 aa, Zea mays
  misc_feature: Ceres CLONE 275274-F
  misc_feature (68)..(68): Xaa is any aa, unknown, or other
  misc_feature (70)..(70): Xaa is any aa, unknown, or other
  misc_feature (74)..(74): Xaa is any aa, unknown, or other
MKTTSSGIAVVLLVAMLAVHSALADISCSDVLNDLSPCLPFLQGKAAKPSESNNQCCDGVRALYAAAXTXPDSXPRADASRRPTFRST

SEQ ID NO: 2502 - DNA, 226 bp, Zea mays
  misc_feature: Ceres CLONE 275275-F
  misc_feature: Encodes the peptide sequence at SEQ ID NO. 2503
  misc_feature (173)..(173): n is a, c, t, g, unknown, or other
gaatcgcgccgsatcacccacctcatggcggacaaggagcctgtcgtggagcgmcccgaggcgtctgaggaggaggacgcctccgccgcggccgcagcgggggaggaagaggacacgggcgcccaggtggcccccatcgtgcggcttgaggaggtactcgtcaccaccggtangaggacgaggacgtctgctcgacatgaaggcgamstgtaaccggtttgataaa

SEQ ID NO: 2503 - protein, 60 aa, Zea mays
  misc_feature: Ceres CLONE 275275-F
  misc_feature (50)..(50): Xaa is any aa, unknown, or other
MADKEPVVERPEASEEEDASAAAAAGEEEDTGAQVAPIVRLEEVLVTTGXRTRTSARHEG

SEQ ID NO: 2504 - DNA, 372 bp, Zea mays
  misc_feature: Ceres CLONE 275277-F
  misc_feature: Encodes the peptide sequence at SEQ ID NO. 2505
  misc_feature (138)..(138): n is a, c, t, g, unknown, or other
  misc_feature (150)..(150): n is a, c, t, g, unknown, or other
  misc_feature (298)..(298): n is a, c, t, g, unknown, or other
aacaagacagagagatacccgatcgccaccgccgaccggactcccctcaaaggcggccacagcacagcgagcatgggagaccggcatcagcatgggcctggcagcggcgtggaggacccggcgacgctgctgcgcggngtgcagacccsncgcccaactcgacgcaggtggtggggttcctgacgctgctcgtctctggcgccgtgctgctgctgctgacgggggtracgctgacgggcgccgtggtggcstcgtcttcctgggccccatcgcgctgctcaccagccccatctgggtncccgtcgccgtcgtgatctccgccatcgtcgccgccgcgctccccgtgccacctggattttaccgctacttcac

SEQ ID NO: 2505 - protein, 93 aa, Zea mays
  misc_feature: Ceres CLONE 275277-F
  misc_feature (16)..(16): Xaa is any aa, unknown, or other
  misc_feature (20)..(20): Xaa is any aa, unknown, or other
  misc_feature (46)..(46): Xaa is any aa, unknown, or other
  misc_feature (54)..(54): Xaa is any aa, unknown, or other
MGLAAAWRTRRRCCAXCRPXAQLDAGGGVPDAARLWRRAAAADGGXADGRRGGXVFLGPIALLTSPIWVPVAVVISAIVAAALPVPPGFYRYF

SEQ ID NO: 2506 - DNA, 473 bp, Zea mays
  misc_feature: Ceres CLONE 275283-F
  misc_feature: Translation starting site: 87
  misc_feature (183)..(183): n is a, c, t, g, unknown, or other
  misc_feature (258)..(258): n is a, c, t, g, unknown, or other
  misc_feature (309)..(309): n is a, c, t, g, unknown, or other
  misc_feature (318)..(318): n is a, c, t, g, unknown, or other
  misc_feature (360)..(360): n is a, c, t, g, unknown, or other
  misc_feature (387)..(387): n is a, c, t, g, unknown, or other
  misc_feature (390)..(390): n is a, c, t, g, unknown, or other
  misc_feature (411)..(411): n is a, c, t, g, unknown, or other
  misc_feature (432)..(432): n is a, c, t, g, unknown, or other
atcgcagaaattctccgcaacttcacagcgtatcatcgttttccatcgctcctactcctatcatccagaaaatctgagcggtattgatggcgcccaaggcggagaagaagccggcggsaagaaggtggcggaggaggagccctcggagaaggcggctccggcggagaaggcccccgcggtaanaaggccaaggcggagaagcggctacctgcgggcaagtccgccggcaatgagggcggcgacaagwwggggaggaanaaggcgaagaagagcgtggagacctacaagatctacatcttcaaggtcctnaagcaggtncaccccgacatcggcatctcctccaaggccatttccatcatnaactccttcatcaacgacatcttcganaanctcgccgcggaggccgccaanctcgcccggtacaacaataancccaccatcacctcccgcgagatccaacctccgtccgcctc

SEQ ID NO: 2507 - DNA, 328 bp, Zea mays
  misc_feature: Ceres CLONE 275290-F
  misc_feature: Translation starting site: 46
  misc_feature (121)..(121): n is a, c, t, g, unknown, or other
  misc_feature (177)..(177): n is a, c, t, g, unknown, or other
  misc_feature (209)..(209): n is a, c, t, g, unknown, or other
  misc_feature (260)..(260): n is a, c, t, g, unknown, or other
atccagtccacccccatccccctcgaccccgacaaccccgacccgatggcgcccaaggccgagaagaagccagcggagaagaagccggcggccgaggagaaggcggagaagacgaccgcanatagaagcccaagtccgagaagcgcctgcyggcctcgaagtcctccggtaaggagngcggcgagaagaaggggaagaagaaggccaanaagagcgtggagacctacaaaatctacatcttcaaggtcctgaagcaggtncaccccgacatcggcatctcctccaaggccatttccatcatgaactccttcatcaacgacatcttcga

SEQ ID NO: 2508 - DNA, 387 bp, Zea mays
  misc_feature: Ceres CLONE 275312-F
  misc_feature: Encodes the peptide sequence at SEQ ID NO. 2509
  misc_feature (367)..(367): n is a, c, t, g, unknown, or other
acacaacctaccacactcgcattgcattgcattgcattccttcagttcagtagtgtgctctgacagtkagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaassatgtgcgctcaccttcgaggacgagagcctcaccctctccgactccagggggatcctccgccacatctcccacaagtacgcgaasrggtgcaacccgtacctgattggcacgggcgctctggagcgggcgtccatcgancagtggctgcagacggaggc

SEQ ID NO: 2509 - protein, 105 aa, Zea mays
  misc_feature: Ceres CLONE 275312-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (53)..(53): Xaa is any aa, unknown, or other
  misc_feature (81)..(81): Xaa is any aa, unknown, or other
  misc_feature (82)..(82): Xaa is any aa, unknown, or other
  misc_feature (99)..(99): Xaa is any aa, unknown, or other
MASVKVFGSPTSAEVARVLMCLFEKEVEFQLIRVDAYRGTKRMPQYLKLQPQXCALTFEDESLTLSDSRGILRHISHKYAXXCNPYLIGTGALERASIXQWLQTE

SEQ ID NO: 2510 - DNA, 1608 bp, Zea mays
  misc_feature: Ceres CLONE 275327
  misc_feature: Encodes the peptide sequence at SEQ ID NO. 2511
actcggctgacgactgacgttccattcccgctccattcgtcgtcgcccttcgctccccctcctcccgaaatcccagagcggcctccttcgcaggcccgtacagcctgcgggggggccggtagagtagcctccaaggtcgccgactcgtcgtagttcctgctgtttcgtgcgtgacaccggagcgagccggagggggcaggaggcatggaggcgggagggaggaggctggcggcgggcagggtggaggcgagccccgagcgcggcaggccggcggcgtacgcgtcggcggggaggccggcgccggcgaggcccatgaggcgggtgcagatcatctactacctctgccgcaacgggcagctggagcacccgcacttcatggagctcgcgcagcacccgcaccagccccttcgcctcaaagatgtcatggacaggctgacgctgctgaggggcaagggcatgccggctctcttctcgtggtcctgcaagaggaactacaagaacgggtacgtgtggaacgacctgtcggagaacgacgtgatctacccgtcggacggcgtggagtacgtgctcaagggctccgagatcttccctggctgctcttcttccggtgcagatcggttccagcacctacgcgtgaccgaccggtcgccgacgaagccgccgccgccgccgccgctggcgctccctcacatgagccacaacaagcagtaccccgtggacgggtacggagactacgacgccgtggaggaccgggacgacgacgagctgggccactcgtaccaccaccgccggacggcgtcggggcggcccgagaaggccgccgccgccgccgtctcggcgcgcgcggccaccaaccgggcccgccccgtggagctccccgtcgaggagacctcgccgccgtcctccacgtcctcggacaagcccccgccgccagcggcgctgctgatgcagcagcagcagcagccggggaggagggccacgtcggaagtgcctgagccgagccgtcccgggtccatgctgctgcagctcatcgcgtgtgggtcgacgacggcgccgtccgcggcaggcggcggcggcggcccggggaagtgccgcgccgagccgaggcggagctgcggcctcgtgagccggctctcggcccgcggcggcgcggacgcggacgaggacgaggacggtgtgggcgcggggaccgacctgggccgccggttcggccgcctcgccgccgaggacaaggagtacttcagcggcagcatcgtggagggcggcggcggcaggggcacgccgctgccggcgtcgtcgctcaagcgctccaactcgtacaacgaggagaggagctgtaggcccggcggcgttgctggtggtgccgccatcggcgaggaggccatggatgaaggcgacggaggggtcaggggaagatgcatcccggggaggaaaaagccgccgccgcagcagcagcagcagaaatagcgcatttggctcatccttctttatgtgtaaacgcaaatcttgatctgaagacaagcgtagctttgtttagcattttcaattttcaaacatgccgttgtcgtggaggccatgcaggcagcaagtaaaaaaaaaaaaaaaaaa

SEQ ID NO: 2511 - protein, 420 aa, Zea mays
  misc_feature: Ceres CLONE 275327
  misc_feature (40)..(407): Pfam Name: DUF966 Pfam Description: Domain of unknown function (DUF966)
MEAGGRRLAAGRVEASPERGRPAAYASAGRPAPARPMRRVQIIYYLCRNGQLEHPHFMELAQHPHQPLRLKDVMDRLTLLRGKGMPALFSWSCKRNYKNGYVWNDLSENDVIYPSDGVEYVLKGSEIFPGCSSSGADRFQHLRVTDRSPTKPPPPPPLALPHMSHNKQYPVDGYGDYDAVEDRDDDELGHSYHHRRTASGRPEKAAAAAVSARAATNRARPVELPVEETSPPSSTSSDKPPPPAALLMQQQQQPGRRATSEVPEPSRPGSMLLQLIACGSTTAPSAAGGGGGPGKCRAEPRRSCGLVSRLSARGGADADEDEDGVGAGTDLGRRFGRLAAEDKEYFSGSIVEGGGGRGTPLPASSLKRSNSYNEERSCRPGGVAGGAAIGEEAMDEGDGGVRGRCIPGRKKPPPQQQQQK

SEQ ID NO: 2512 - DNA, 235 bp, Zea mays
  misc_feature: Ceres CLONE 275328-F
atcgcgactcaggcactcaccgaccgcggatatggccccgcgccatggcctctccttgcgacttccctcctcctcatcctattccaccactcgcctcgcgccgcggtggcgtttccgcgtctctgggcgacggcctcctgggcgccgccgcgcgccgggtttcgcggcttggctgcgcggcttgcggcgccgcatccacgagcgccccgagctcccttccaggaataccgcacga

SEQ ID NO: 2513 - DNA, 362 bp, Zea mays
  misc_feature: Ceres CLONE 275401-F
  misc_feature: Encodes the peptide sequence at SEQ ID NO. 2514
  misc_feature (218)..(218): n is a, c, t, g, unknown, or other
attttccatcaacagcatccgcctctggcaagctagcgacagcaactcattgcactccgcgcgctcgacaacacgatgcccgccgccgtcgaggagcggcccaagaaggtggctaaggtgggcgtccccgccgccgccgccaaggccgccgcctcccccgggagtggcggcaagaagaagaaggggaacgacgagaactcggcgcaagggccacggcngcggcggcggagcaggccgtggagtacatctcgtcggaggagctggaggcggcggcaaccctaaggccaaggccgcggggctggtcgcggacttgactccaaggactgggtcaggacctgcgaggcgctcaacgacgcgcgccg

SEQ ID NO: 2514 - protein, 68 aa, Zea mays
  misc_feature: Ceres CLONE 275401-F
  misc_feature (48)..(48): Xaa is any aa, unknown, or other
MPAAVEERPKKVAKVGVPAAAAKAAASPGSGGKKKKGNDENSAQGPRXRRRSRPWSTSRRRSWRRRQP

SEQ ID NO: 2515 - DNA, 463 bp, Zea mays
  misc_feature: Ceres CLONE 275429-F
  misc_feature: Encodes the peptide sequence at SEQ ID NO. 2516
  misc_feature (394)..(394): n is a, c, t, g, unknown, or other
atagaaatcgaccgagcgaatccctcgcatcgcattcgcagcctttgctsatcacaccaccgcgaaaccccagcagccgcatcgatggcgcctaaggsgagaagaagccggctgcgaagaagcagcgaggaggagcccgctgccgcgaaggccccggcggaagaagcccaaggccgagaagcgcctcccggcgccaagtcgtccggcaaagaaggcggcgacaagaagggtaagaagaaggcgaagaagtcggtggagacctacaagatctacatcttcaaggtgctgaagcaggtccacccggacatcggcatctcttccaaggccatgtccatcatgaactccttcatcaacgacatcttcgagaagctcgccggcgaggcttgccaasttngcgcgctacaacaagaagcccaccatcacctctcggggagattcaaacctctgtccgccttgtccttcc

SEQ ID NO: 2516 - protein, 126 aa, Zea mays
  misc_feature: Ceres CLONE 275429-F
  misc_feature (54)..(114): Pfam Name: Histone Pfam Description: Core histone H2A/H2B/H3/H4
  misc_feature (5)..(5): Xaa is any aa, unknown, or other
  misc_feature (103)..(103): Xaa is any aa, unknown, or other
  misc_feature (104)..(104): Xaa is any aa, unknown, or other
MAPKXRRSRLRRSSEEEPAAAKAPAEEAQGREAPPGAKSSGKEGGDKKGKKKAKKSVETYKIYIFKVLKQVHPDIGISSKAMSIMNSFINDIFEKLAGEACQXXALQQEAHHHLSGRFKPLSALSF

SEQ ID NO: 2517 - DNA, 127 bp, Zea mays
  misc_feature: Ceres CLONE 275449-F
ctaatcaaaaaatccatcacagctagctagcatacagacgaataatctcttcttcacctcactaacaccaactagcaactctttctctcctgcaataatggccgctcgctcctcctcctcccagccg

SEQ ID NO: 2518 - DNA, 356 bp, Zea mays
  misc_feature: Ceres CLONE 275485-F
  misc_feature: Encodes the peptide sequence at SEQ ID NO. 2519
atcgttgtccaatatataawaggccaaataatcaagcacaggcagcagccatacacacagcaagawaagaatggacatggagaaggccctagccctagttctactggtatcagctgccatactcctaggcgcacaccagccgacgagcgctcaggtgttctgccgctcgcagttcaacctggccaacgaggcgtgcagcatgcggaatttcatcccggggccgggggtgaggcgcgggggcctgccgcggcacagcagctcaacgagacgacgtcgtcgtcgacgggccaccacagccagcgctgtcagtcaggtgctgcagtcccggagcgacgacgacgacgacagccacggcg

SEQ ID NO: 2519 - protein, 95 aa, Zea mays
  misc_feature: Ceres CLONE 275485-F
MDMEKALALVLLVSAAILLGAHQPTSAQVFCRSQFNLANEACSMRNFIPGPGVRRGGLPRHSSSTRRRRRRRATTASAVSQVLQSRSDDDDDSHG

SEQ ID NO: 2520 - DNA, 453 bp, Zea mays
  misc_feature: Ceres CLONE 275489-F
  misc_feature: Encodes the peptide sequence at SEQ ID NO. 2521
gcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtsatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctac

SEQ ID NO: 2521 - protein, 124 aa, Zea mays
  misc_feature: Ceres CLONE 275489-F
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (29)..(29): Xaa is any aa, unknown, or other
MALANKLGGLLKKATSSNLSVYQAIRCMXSKLFVGGISYQTDDHSLRDEFAKYGQVIEARIIIDRESGRSRGFGFVTYTSSEEASAAITALDGKTLDGRSIRVNHANEKTGGFRGGGGYGGGGY

SEQ ID NO: 2522 - DNA, 103 bp, Zea mays
  misc_feature: Ceres CLONE 275506-F
  misc_feature (67)..(67): n is a, c, t, g, unknown, or other
acacgcacaccgcgacccagtccagagccagtacgtgcgamgcacgcacgctgctggtccgcgtacnagaacgacggtcaggtcggccggtgcttttcagttt

SEQ ID NO: 2523 - DNA, 198 bp, Zea mays
  misc_feature: Ceres CLONE 275507-F
  misc_feature (127)..(127): n is a, c, t, g, unknown, or other
  misc_feature (128)..(128): n is a, c, t, g, unknown, or other
  misc_feature (131)..(131): n is a, c, t, g, unknown, or other
gtgcccgckgtgctagtgacggttgctctagatccgttcatcctggtggttttgtgaggtcgaaagcggcgagcgaattagaagatgctggacaagctgtgggacgacgtggtggccgggcctcgcnnagnacggcctcgagaagctccgcaagccaccaccgcccgcccgctcgtcatcaacaaagacgcggacggc

SEQ ID NO: 2524 - DNA, 215 bp, Zea mays
  misc_feature: Ceres CLONE 275509-F
  misc_feature (77)..(77): n is a, c, t, g, unknown, or other
  misc_feature (130)..(130): n is a, c, t, g, unknown, or other
  misc_feature (157)..(157): n is a, c, t, g, unknown, or other
  misc_feature (174)..(174): n is a, c, t, g, unknown, or other
  misc_feature (183)..(183): n is a, c, t, g, unknown, or other
  misc_feature (208)..(208): n is a, c, t, g, unknown, or other
atagcgaacaaacatcgagtacagtcggctaggtaatctggtggtacgacgactgacgacgacattgcggccaccancagcaagtcgtcgtcgtcctcgagctcggcgcmgggcagcagctgccgccctnctcgtggcggtgtccgtcctggtggtnggcgcggcggcggtttncgacattancaacgagcagttcatgtcgttccancccgcgg

SEQ ID NO: 2525 - DNA, 436 bp, Zea mays
  misc_feature: Ceres CLONE 275510-F
  misc_feature (69)..(69): n is a, c, t, g, unknown, or other
  misc_feature (80)..(80): n is a, c, t, g, unknown, or other
  misc_feature (141)..(141): n is a, c, t, g, unknown, or other
  misc_feature (218)..(218): n is a, c, t, g, unknown, or other
  misc_feature (244)..(244): n is a, c, t, g, unknown, or other
  misc_feature (262)..(262): n is a, c, t, g, unknown, or other
  misc_feature (294)..(294): n is a, c, t, g, unknown, or other
  misc_feature (343)..(343): n is a, c, t, g, unknown, or other
  misc_feature (405)..(405): n is a, c, t, g, unknown, or other
gtacttttccggcctcccattcctcgcgcgggaccacccgattcgaagcgtgcgcagagaccgaagaancgggakatatngctcgtaccaagcagactgctcgcaagtccacgggagggaaggctcccaggaagcagcttnccaccaaggctgcccgtaagtctgcccccaccactggtgagtgaagaagcctcaccgctaccgccctggaactgttnccctccgtgagatccgcaagtatcanaagakcactkagctgctnatcaggaagctkcccttccagaggctcgtcanggaaattcacaggacttcaaaactgatttgcgtttccagagccatgcgntgcttgccctccaggaggctgctgaggcataccttgttggcctgtttsaggacaccaacctntgcgccatccatgctaagcgtgtgaccatca

SEQ ID NO: 2526 - DNA, 423 bp, Zea mays
  misc_feature: Ceres CLONE 275547-F
  misc_feature: Encodes the peptide sequence at SEQ ID NO. 2527
  misc_feature (2)..(2): n is a, c, t, g, unknown, or other
  misc_feature (152)..(152): n is a, c, t, g, unknown, or other
  misc_feature (174)..(174): n is a, c, t, g, unknown, or other
  misc_feature (200)..(200): n is a, c, t, g, unknown, or other
  misc_feature (203)..(203): n is a, c, t, g, unknown, or other
  misc_feature (252)..(252): n is a, c, t, g, unknown, or other
  misc_feature (256)..(256): n is a, c, t, g, unknown, or other
  misc_feature (276)..(276): n is a, c, t, g, unknown, or other
  misc_feature (373)..(373): n is a, c, t, g, unknown, or other
  misc_feature (401)..(401): n is a, c, t, g, unknown, or other
antctcagagcagccgcatccacaacctgcctctstcgtcccctggcggcgtccgcggcaggatggcggaatctacggcgaggacggtgaaggatgtcaacccgcacgagttcgtcaaggcctactccgcccacctcaagcgctccggcaanatggagctccctgagtgggttnacattgtgaagactgcgaggttcaangancttcctccttatgatcctgactgtkactacatcagggctgcatccattncaangragatctacctaaggcaangcatcggtgtgggtggctttcagaagatctacggtggccgccataggaattgctcccgcccaccacacttctgcaagagcagtggtgctgttgcacncaacatcctgcagcagctgcagattatnggcatcatcgatgtcgatccca

SEQ ID NO: 2527 - protein, 120 aa, Zea mays
  misc_feature: Ceres CLONE 275547-F
  misc_feature (7)..(120): Pfam Name: Ribosomal_S19e Pfam Description: Ribosomal protein S19e
  misc_feature (30)..(30): Xaa is any aa, unknown, or other
  misc_feature (38)..(38): Xaa is any aa, unknown, or other
  misc_feature (46)..(46): Xaa is any aa, unknown, or other
  misc_feature (47)..(47): Xaa is any aa, unknown, or other
  misc_feature (56)..(56): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (72)..(72): Xaa is any aa, unknown, or other
  misc_feature (104)..(104): Xaa is any aa, unknown, or other
  misc_feature (113)..(113): Xaa is any aa, unknown, or other
MAESTARTVKDVNPHEFVKAYSAHLKRSGXMELPEWVXIVKTARFXXLPPYDPDCXYIRAASIXXXIYLRQXIGVGGFQKIYGGRHRNCSRPPHFCKSSGAVAXNILQQLQIXGIIDVDP

SEQ ID NO: 2528 - DNA, 350 bp, Zea mays
  misc_feature: Ceres CLONE 275564-F
  misc_feature: Translation starting site: 118
  misc_feature (242)..(242): n is a, c, t, g, unknown, or other
gcgcacagaacccccccgcccccaattccaaatcccgagtgcccgcggccacagaccgacccccatcacacacgcgcatcgscacccccatccgtcaccgtcgacccgcgagcacchatggcgaagggaggaggtggaggccagcgcgagggtagcgccctgaagagggggcgatcgtcgcaggggggctcgcgctggcctggggtcaccgtggagaccgctttcaggcccttaatgggcgncctccgcgctgccatctccagctccaccgacaccgcccgcgaccccgaccaggaggagcctcccgcgcctgcctctgcggcggaggcggagaatgcgttccgcaccak

SEQ ID NO: 2529 - DNA, 489 bp, Zea mays
  misc_feature: Ceres CLONE 275581-F
  misc_feature: Encodes the peptide sequence at SEQ ID NO. 2530
  misc_feature (63)..(63): n is a, c, t, g, unknown, or other
  misc_feature (436)..(436): n is a, c, t, g, unknown, or other
aatccaacaagcacaaacctgcagtcatctatctcctccatcaccaccaccaagctcaacaanagccagctcgcgaaaataatgaagagccgcagcatggcatcatcggccgcgctcttggtgctagccctcgcgctagtggcggccaccgcccacaggtagcggaggcaaagaagaagagagcggcggagagcggcgaggcggcggaggcgaagaagatccaggacgacttctgctcgacgctgtgsagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgangtcaccaaggcctgcagcgtcacctgcgccaatgagaagaacccgcgcctcag

SEQ ID NO: 2530 - protein, 35 aa, Zea mays
  misc_feature: Ceres CLONE 275581-F
  misc_feature (18)..(18): Xaa is any aa, unknown, or other
MKVCQEECDKAYVVKAAXVTKACSVTCANEKNPRL

SEQ ID NO: 2531 - DNA, 183 bp, Zea mays
  misc_feature: Ceres CLONE 275593-F
  misc_feature: Encodes the peptide sequence at SEQ ID NO. 2532
  misc_feature (126)..(126): n is a, c, t, g, unknown, or other
ctgaacaagacaaggcccagaaaaaaattcagcaaacaagcaaaggtacggccaccaccaccggccaggaagcaagctcaaaccctaaccgccggckacgcagcwcgatggcccgctacgaccgcncgatcaccgtcttctcccccgatggcyacctcttccaggtcgagtacgccctggagg

SEQ ID NO: 2532 - protein, 60 aa, Zea mays
  misc_feature: Ceres CLONE 275593-F
  misc_feature: SWISSPROT Homolog: EC 3.4.25.1 Proteasome endopeptidase complex
  misc_feature (32)..(32): Xaa is any aa, unknown, or other
  misc_feature (35)..(35): Xaa is any aa, unknown, or other
  misc_feature (42)..(42): Xaa is any aa, unknown, or other
  misc_feature (51)..(51): Xaa is any aa, unknown, or other
EQDKAQKKIQQTSKGTATTTGQEASSNPNRRXRSXMARYDRXITVFSPDGXLFQVEYALE

SEQ ID NO: 2533 - DNA, 366 bp, Zea mays
  misc_feature: Ceres CLONE 275600-F
  misc_feature: Encodes the peptide sequence at SEQ ID NO. 2534
atcaaacaaaagcgtcgttctctcttcctggtccaagtgatcttgccaagttacgagcagcaagcagagatcagatcatccatcggcaatgtcgaacatcgggcagtccttccaggccggcaagsggaggcccagggcgagtaccaggcggacacgckgcgcagtgctcaaggacaccgccggakccgcggccgacagcgcgcaytgcagcagcaccgcgccaccggcaccgttgagcaggtggcgcagacgggccagggcgtggcggcaggcgtcaaggacacggtggcgggctcggcggttggcgtcaccaacacggtggcgggcgttgcggccgggcgtcacgaacacggttaccggcgcrgt

SEQ ID NO: 2534 - protein, 121 aa, Zea mays
  misc_feature: Ceres CLONE 275600-F
  misc_feature (42)..(42): Xaa is any aa, unknown, or other
  misc_feature (53)..(53): Xaa is any aa, unknown, or other
  misc_feature (62)..(62): Xaa is any aa, unknown, or other
IKQKRRSLFLVQVILPSYEQQAEIRSSIGNVEHRAVLPGRQXEAQGEYQADTXRSAQGHRRXRGRQRALQQHRATGTVEQVAQTGQGVAAGVKDTVAGSAVGVTNTVAGVAAGRHEHGYRR

SEQ ID NO: 2535 - DNA, 482 bp, Zea mays
  misc_feature: Ceres CLONE 275661-F
  misc_feature: Translation starting site: 303
  misc_feature (343)..(343): n is a, c, t, g, unknown, or other
ctcccaaactgcggatagagcagcgagccatcgacacgatcgcgagcgcaasacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacasvgcttgtggttcgcgtccaagcagtccctctcctacctcgatggcacgctgcccggcgactatggcttcgacccgctgggcctctcggacccggagcaccgngggcttcatcgagcccaagtggctggcctatggcgaggtgatcaacggccgctacgccatgctgggcgcggtgggcscatcgcccggagatcttcggcaagatgggcatcatcccccccggagaccgcgctgccgtggt

SEQ ID NO: 2536 - DNA, 407 bp, Zea mays
  misc_feature: Ceres CLONE 275668-F
  misc_feature: Encodes the peptide sequence at SEQ ID NO. 2537
atcgtgtcgtttcttccctttccctttcccccgttcagttcagcttcggttggctcgcgtactcgggtttgttcctcgcctcgcttccttcctccgcagtcctcgtctcgaattcgctcgcggtgggagaaatcggggcgcgaggatgaccgtgatcgacatcctcacccgggtggacgcgatctgccagaagtacgacaggtacgacgtcgacaagctcaacggcgcgaacgtcgccggcgacgacccgttcgcccgcctctacgcgtccgtcgacsgacatcaaccaatgcgtcgataaagcggaaacggcgamsaagakaagaaccgggccgcggtagtggcgcttaacgcgagatccggcgcaccaaggccaagctcctcgaggaagacctccccaagctgca

SEQ ID NO: 2537 - protein, 51 aa, Zea mays
  misc_feature: Ceres CLONE 275668-F
  misc_feature (45)..(45): Xaa is any aa, unknown, or other
MTVIDILTRVDAICQKYDRYDVDKLNGANVAGDDPFARLYASVDXHQPMRR

SEQ ID NO: 2538 - DNA, 347 bp, Zea mays
  misc_feature: Ceres CLONE 275674-F
  misc_feature: Encodes the peptide sequence at SEQ ID NO. 2539
  misc_feature (32)..(32): n is a, c, t, g, unknown, or other
  misc_feature (307)..(307): n is a, c, t, g, unknown, or other
atagccttatagccacataccggccagccgcngcaagtgcccagaaggccagaaccagaaccaagcagctcgttgcaacctcatatcatcccctgccacgcacctccgtccgccgcgccatggaatcgaggaggagggccgtgccaccgtgacggcggttgckgtggcgacgctgctgctgacgatgatgacgtcgtcgggcgtgggcggcgacttcgcggcggaccgggcggagtgctcggagcagttggcgggggctggcgacgtgcctgacgtacgtgcaggagcaggcgacggcgacggcsanccgcccgactgctgcgcgggcctcaaggcggtgctgcaga

SEQ ID NO: 2539 - protein, 54 aa, Zea mays
  misc_feature: Ceres CLONE 275674-F
  misc_feature (41)..(41): Xaa is any aa, unknown, or other
MMTSSGVGGDFAADRAECSEQLAGAGDVPDVRAGAGDGDGXPPDCCAGLKAVLQ

SEQ ID NO: 2540 - DNA, 422 bp, Zea mays
  misc_feature: Ceres CLONE 275744-F
  misc_feature: Encodes the peptide sequence at SEQ ID NO. 2541
  misc_feature (141)..(141): n is a, c, t, g, unknown, or other
  misc_feature (142)..(142): n is a, c, t, g, unknown, or other
  misc_feature (175)..(175): n is a, c, t, g, unknown, or other
  misc_feature (193)..(193): n is a, c, t, g, unknown, or other
  misc_feature (268)..(268): n is a, c, t, g, unknown, or other
agtcgcatctccctctccgaaatcaaggtagcgtacaccgctgcagtttctagagccctctctgccactcgtgatcccactagtcacaatgcctgcyctcgccaagcccgcctcccgcaccgccaagyccygccgcggctnnsgaagccgaagcctgccgccgccaagccgavsnccacctgctggtgccthncacccgccttacttcgagatgatcaaggaggctatcacggcgctcaaggagaggaccggctccagctcgcaagcnatcgccaagtatgtgggggacaagcacggcgcgtctctgccggccaacttcaagaagatgctttccatccagctccgtgggtccgcagccaagggcaagctctgtgaaggtcaaggcttcgtacaagctctcggacgccgccawkaaggcatcc

SEQ ID NO: 2541 - protein, 111 aa, Zea mays
  misc_feature: Ceres CLONE 275744-F
  misc_feature (35)..(106): Pfam Name: Linker_histone Pfam Description: linker histone H1 and H5 family
  misc_feature (14)..(14): Xaa is any aa, unknown, or other
  misc_feature (15)..(15): Xaa is any aa, unknown, or other
  misc_feature (18)..(18): Xaa is any aa, unknown, or other
  misc_feature (19)..(19): Xaa is any aa, unknown, or other
  misc_feature (29)..(29): Xaa is any aa, unknown, or other
  misc_feature (35)..(35): Xaa is any aa, unknown, or other
  misc_feature (108)..(108): Xaa is any aa, unknown, or other
  misc_feature (109)..(109): Xaa is any aa, unknown, or other
MPALAKPASRTAKXXRGXXSRSLPPPSRXPPAGAXHPPYFEMIKEAITALKERTGSSSQAIAKYVGDKHGASLPANFKKMLSIQLRGSAAKGKLCEGQGFVQALGRRXXGI

SEQ ID NO: 2542 - DNA, 153 bp, Zea mays
  misc_feature: Ceres CLONE 275750-F
  misc_feature (50)..(50): n is a, c, t, g, unknown, or other
aktctcgcatggactccaccactgctgctgctaccgcggccgsctgsggnccggccgcggttgctgctggtgacgaacgacgacgaatcgacgcgccggggctccgcttccttgtcgaccgtctcgtcgccgcaggcattaccgcgtactcgt

SEQ ID NO: 2543 - DNA, 101 bp, Zea mays
  misc_feature: Ceres CLONE 275782-F
  misc_feature (21)..(21): n is a, c, t, g, unknown, or other
ctctccgtgctttctcagagngtgggttggcttctcctcccccaccggttcgtgttcaggttctggttcgtgggcgagagggaatgagatggccggcgtcg

SEQ ID NO: 2544 - DNA, 132 bp, Zea mays
  misc_feature: Ceres CLONE 275833-F
  misc_feature (64)..(64): n is a, c, t, g, unknown, or other
  misc_feature (65)..(65): n is a, c, t, g, unknown, or other
atccatcacagctagctagcatacagacgaataatctcttcttcacctcactaacaccagctannaactctttctctcctgcaataatggccgctcgctcctcctcctcccagccgcagctgtcgcggcggc

SEQ ID NO: 2545 - DNA, 398 bp, Zea mays
  misc_feature: Ceres CLONE 275848-F
  misc_feature: Encodes the peptide sequence at SEQ ID NO. 2546
  misc_feature (38)..(38): n is a, c, t, g, unknown, or other
tttttcatgtgacgtgaacccctttcctcgctccgtantgcggaggaaggggagctcgacgcacccaagttcgcccgcccacggaacgcgccgccgccgccgccgccatcacatcacagaggccwcgccgcgtctcggatattccccgccgtagaccagtttccctccagctgccggagaccatgtcgggcggcctggacatgtccctggacgacctcatcaagcagtccaagtcccgacccaaggacagcccggcgtccttgtcggggcctgcccgccgcgctctcacaccccgcccgckccgcgccctacccaccggccgctcccaaggcccgtgccgccgccgactcgccctacggggtctactccaagcacatcgccgcgatagccgcccccgc

SEQ ID NO: 2546 - protein, 72 aa, Zea mays
  misc_feature: Ceres CLONE 275848-F
  misc_feature (40)..(40): Xaa is any aa, unknown, or other
MSGGLDMSLDDLIKQSKSRPKDSPASLSGPARRALTPRPXRALPTGRSQGPCRRRLALRGLLQAHRRDSRPR

SEQ ID NO: 2547 - DNA, 103 bp, Zea mays
  misc_feature: Ceres CLONE 275861-F
acacgcacaccgcgacccagtccagagccagtacgtgcgamgtcacgcacgctgctggtccgcgtacsagaacgacggtcaggtcggccggtgcttttcagtt

SEQ ID NO: 2548 - DNA, 203 bp, Zea mays
  misc_feature: Ceres CLONE 275863-F
gtgcccgcggtgctactgacggttgctctagatccgttcatcctggtggttttgtgaggtcgaaagcggcgagcgaattagaagatgctggacaagctgtgggacgacgtggtggccgggcctcgccgaagaacggcctcgagaagctccgcaagccaccaccgcccgcccgctcgtcatcaacaaagacgcggacggcggca

SEQ ID NO: 2549 - DNA, 630 bp, Zea mays
  misc_feature: Ceres CLONE 275875-R
  misc_feature: Translation starting site: 161
gtgagcctgctgtgagagtgggttctgtattattgttcggttctttgaatcaaagcgatgttgcagattgcacagccacaggccggtcgtgtgcgtacaagatcgcaaaagggcacgcgaccctcaagagtttgctttaacattcactacgaatgacggaatgaggacaccgagtcgactcgacgccggtggccttttattattcagcgtgtttggatcccttgccttttgcccagtgcagtcgcactggctatcatcagctcattactggcagctgactggcgggaggccgcacttggccggcaggctgctgatgatgctgaacgttccgcaggcgcagtccctggacacggcccccagcgcggagcagcactccggcccgggcgccggcggaacctgccgcggcaagggtggcacggtgaagagcaagaagggggccagcccgcgcatctgccccgcgtacgtctgctgcgtctcggggccaccgcccaggcccgctgacaacaccacgagcaccagcagggacaacgtcgcgagcatgccgcgcgacagcaccttgccagaggcgagggctggcgtcgacggcgccctcattattccgcactgggccaggacgggccgacctggacg

SEQ ID NO: 2550 - DNA, 137 bp, Zea mays
  misc_feature: Ceres CLONE 275878-F
  misc_feature (130)..(130): n is a, c, t, g, unknown, or other
atcacaattcacagcgctcaagttctcgcgctcacagccaaatttttctccactcaatcgcggcataagctgcactgcvccattggacgccagckgaccggttagcaaggcgaagaagggggcggctggncgcaagg

SEQ ID NO: 2551 - DNA, 362 bp, Zea mays
  misc_feature: Ceres CLONE 275919-F
  misc_feature: Encodes the peptide sequence at SEQ ID NO. 2552
  misc_feature (353)..(353): n is a, c, t, g, unknown, or other
gaagaagccgcgtgcgtgttatcctttgagcagtttgggcgctgagcaagtccagtgagagagggagagcggcgagaggatggctgggatggcgtcgctgcatggcgccatggcgtcgctctccatctccgcgctaggcgscggaacggcgagcagcagcagcttctggggcaaccggctcgccacctactccgcgccgcagcctggggtaaggtttatggtcaagatatgcccaattgaaatgagacttaagakatgggaccgaaagaagtttaaaccaaacagtcttcctgtgctgcacaagatgcatgttaggatcgggggacacggtacaggttattgcaggccgtaanaaaggaaag

SEQ ID NO: 2552 - protein, 90 aa, Zea mays
  misc_feature: Ceres CLONE 275919-F
  misc_feature (21)..(21): Xaa is any aa, unknown, or other
  misc_feature (59)..(59): Xaa is any aa, unknown, or other
MAGMASLHGAMASLSISALGXGTASSSSFWGNRLATYSAPQPGVRFMVKICPIEMRLKXWDRKKFKPNSLPVLHKMHVRIGGHGTGYCRP

SEQ ID NO: 2553 - DNA, 107 bp, Zea mays
  misc_feature: Ceres CLONE 275933-F
acacgcacaccgcgacccagtccagagccagtacgtgcgamgtcacgcacgctgctggttccgcgtacsagacgacggtcaggtcggccggtgcttttcagtttgga

SEQ ID NO: 2554 - DNA, 430 bp, Zea mays
  misc_feature: Ceres CLONE 275941-F
  misc_feature: Encodes the peptide sequence at SEQ ID NO. 2555
  misc_feature (348)..(348): n is a, c, t, g, unknown, or other
gaaacatagtgcagcaagcaactgcaaagcrcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcgsattgggtacggcaggtccggcggcgacgactacggccgtggcaccggcggtggtggctacaacaagtccggcggcggcgacgactacggccgcagcggcgcnattggggtatggaaggtccgggcggcgacgactacggccgtggcaccggcggcggcgggtacaacaagtccggcaacgacgy

SEQ ID NO: 2555 - protein, 114 aa, Zea mays
  misc_feature: Ceres CLONE 275941-F
  misc_feature (53)..(53): Xaa is any aa, unknown, or other
  misc_feature (87)..(87): Xaa is any aa, unknown, or other
MADEYGRSGYGRSGAGDDYDSGYNSKSGTDDYGRGEGGYNKSGGDDDYGRSGXLGTAGPAATTTAVAPAVVATTSPAAATTTAAAAXLGYGRSGRRRLRPWHRRRRVQQVRQRR

SEQ ID NO: 2556 - DNA, 113 bp, Zea mays
  misc_feature: Ceres CLONE 275952-F
acacgcacaccgcgacccagtccagagccagtacgtgcgamgccacgcacgctgctggtccgcgtacsagacgacggtcaggtcggccggtgcttttcagtttggaataatga

SEQ ID NO: 2557 - DNA, 661 bp, Zea mays
  misc_feature: Ceres CLONE 275963-R
  misc_feature (1)..(1): n is a, c, t, g, unknown, or other
ncgattggtgaccgggccccccctcgaggtcgacggtatcgataagcttttttttttttttttttcttttttttttttttttttttttttttttttttttttttttttttttttctgggcaccaaacgttcacatcatatatgaaagttgtaacccaaacagggtgaagggtttttgaatccctacagtaaacaattcttttcctaaactcaaacctttttaaaatgaaaatactacattatgggcccgatacaaatgcatcccccagctcaaatggcgcaaaactccccacttcctgttctactcttcgtctttcaggactcgctccctggggggcaacgtggccgtggcggtagcggcggcttcctcttcttcccaaaggatcttctgcacatcgtttacccgcatccggacaataccgccaaccacaattgcggcggtgcccagggtccaaatccacaggatcttgaggcccgggctcttctggctccacctcgtcaccattaaaggagcggcggcagctggcaatcgcggtggaaaaagagcggctccggccgggctagcggcccgaggtgtgcaaggcggcccaagctgaccaaggggcacggcgtggggggcaggcgatctgctccagcggcctggcgcgtcggcggcccagcag

SEQ ID NO: 2558 - DNA, 118 bp, Zea mays
  misc_feature: Ceres CLONE 275967-F
  misc_feature (44)..(44): n is a, c, t, g, unknown, or other
  misc_feature (69)..(69): n is a, c, t, g, unknown, or other
aacacgcacaccgcgacccagtccagagccagtacgtgcgamgncacgcacgctgctggtccgcgtacnagacgacggtcaggtcggccggtgcttttcagtttggaataatgacggc

SEQ ID NO: 2559 - DNA, 290 bp, Zea mays
  misc_feature: Ceres CLONE 276007-F
  misc_feature: Translation starting site: 69
  misc_feature: Pfam Name: Ribosomal_L1 Pfam Description: Ribosomal protein L1p/L10e family
  misc_feature (103)..(103): n is a, c, t, g, unknown, or other
  misc_feature (230)..(230): n is a, c, t, g, unknown, or other
  misc_feature (261)..(261): n is a, c, t, g, unknown, or other
ctcttcctctcgctccgttgctcgcctcgggtcaaaccctaagcagggagttgatttatccgtgcagcatgagtwagttksagtctgagtctgtcaaggatgncatctcccagattgtyggggatgcaaggagaagaayaggaagtycactgagacygtggaacttcagattggtcygaagaattatgatccacagaaggacaagcgtttcagtggctctgttaagttgncccatatcctcgtcccaagaygaaggtgtgnatgcytggtgatgcccagcatgttgagga

SEQ ID NO: 2560 - DNA, 343 bp, Zea mays
  misc_feature: Ceres CLONE 276013-F
  misc_feature: Encodes the peptide sequence at SEQ ID NO. 2561
  misc_feature (62)..(62): n is a, c, t, g, unknown, or other
  misc_feature (268)..(268): n is a, c, t, g, unknown, or other
  misc_feature (295)..(295): n is a, c, t, g, unknown, or other
ctactgcggcttcaggactcgacctcttgckccgccgccatgaccttcaagcgccgcaacgnscgcaaacaagcatggccgcggtcacgtcaagtacatccggtgctcaaactgcgccaagtgctgccccaaggacaaggcgatcaagaggtttcaggtgaggaacatcgtgaacaggcggccatcagggacgtccaggaagcatgcgtctatgatggctacgtcctcccgaagcctgtacgccaaggtgcaccactgcgtctcgtgngcgatccacgctcaaatcgtccgcgtncggatcccgtgagaagcgcagggaccgcaagcygccggagcgcttcag

SEQ ID NO: 2561 - protein, 30 aa, Zea mays
  misc_feature: Ceres CLONE 276013-F
  misc_feature (18)..(18): Xaa is any aa, unknown, or other
MATSSRSLYAKVHHCVSXAIHAQIVRVRIP

SEQ ID NO: 2562 - DNA, 421 bp, Zea mays
  misc_feature: Ceres CLONE 276092-F
  misc_feature: Encodes the peptide sequence at SEQ ID NO. 2563
  misc_feature (24)..(24): n is a, c, t, g, unknown, or other
aagggggaagcgaaaccgaaaganaggcagagcttggcaatggagctcccgtggggaatgctgctgccgctgctgctggtcctctccgtctcgtcctcgtcatcgtcgtcggctgctgccaccctcgccgtcagcgctccgcccccagtgcctgttcctcctcctcgtcatgctcaagacgccgamcrtgccttcatcaacggcaacttcgagacggcgccgcggaggctgaacaagaccctcatcgtggggcgccactcgctgccggggtggacggtgcagggccacgtggagtacgtctcgggcggtccccagcccgggggcatgttcttcgcggtgccgcacgsttgcacgcgctgcgcctcggcagccgcgcgtcggcgtcgcagaacgtgacggtgcggccgggggcgctgtacgc

SEQ ID NO: 2563 - protein, 118 aa, Zea mays
  misc_feature: Ceres CLONE 276092-F
  misc_feature (49)..(49): Xaa is any aa, unknown, or other
  misc_feature (50)..(50): Xaa is any aa, unknown, or other
  misc_feature (103)..(103): Xaa is any aa, unknown, or other
MELPWGMLLPLLLVLSVSSSSSSSAAATLAVSAPPPVPVPPPRHAQDAXXAFINGNFETAPRRLNKTLIVGRHSLPGWTVQGHVEYVSGGPQPGGMFFAVPHXCTRCASAAARRRRRT

SEQ ID NO: 2564 - DNA, 470 bp, Zea mays
  misc_feature: Ceres CLONE 276105-F
  misc_feature: Encodes the peptide sequence at SEQ ID NO. 2565
  misc_feature (196)..(196): n is a, c, t, g, unknown, or other
  misc_feature (359)..(359): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakndtgtcatgcaggactacgtcgtcgacggcttcatgaagaacaccaactgtgacgacccggagctcaaggagaagctcaccagactctccaagacgacgaccgtgaggactcggtacgtggtgatgtcggatgagatcctcaagaactacccggagctggcgcnggaggggctgccgacgatgaatcagcgtctggacatctcgaacgcggcggtgacsagatggcgacggakgcgtccctgtcgtgcgtccgctcgtggggcggcsgctctcgt

SEQ ID NO: 2565 - protein, 128 aa, Zea mays
  misc_feature: Ceres CLONE 276105-F
  misc_feature (10)..(128): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
  misc_feature (92)..(92): Xaa is any aa, unknown, or other
  misc_feature (115)..(115): Xaa is any aa, unknown, or other
MVSSSMDTTSDKRASSMLAPNPGKATILALGHAFPQXXVMQDYVVDGFMKNTNCDDPELKEKLTRLSKTTTVRTRYVVMSDEILKNYPELAXEGLPTMNQRLDISNAAVTRWRRXRPCRASARGAAAL

SEQ ID NO: 2566 - DNA, 436 bp, Zea mays
  misc_feature: Ceres CLONE 276130-F
  misc_feature: Encodes the peptide sequence at SEQ ID NO. 2567
  misc_feature (206)..(206): n is a, c, t, g, unknown, or other
  misc_feature (414)..(414): n is a, c, t, g, unknown, or other
aagagtttcctgccgtagcaacagacaagggagagtgggagactagcgcaacaggacagcgcacggaaagcgaggggaggggagacggagagggcgcatcggacggcggcgagatgctggcggtgttcgatcccacggtggccaagtgcccggaggtctccgcagccccccggtcgccgggcggccgctggagcaggcggggccgncgcgggcgcstgatgaagggcttctccgactcgcacgacggcgccgtcaccgtcagcctgggcccctccggcgcgctggcctasktcggcggccaaccagagccccctcgtgccaaggttgtttggtgctgtgaatgacatcttctgcttgttccaagggcacattgagaacattgccaacctgaagcagcattatggcctgagcaanactgcaaatgaaggtgactatc

SEQ ID NO: 2567 - protein, 76 aa, Zea mays
  misc_feature: Ceres CLONE 276130-F
  misc_feature (35)..(35): Xaa is any aa, unknown, or other
  misc_feature (59)..(59): Xaa is any aa, unknown, or other
  misc_feature (60)..(60): Xaa is any aa, unknown, or other
MLAVFDPTVAKCPEVSAAPRSPGGRWSRRGRRGRXMKGFSDSHDGAVTVSLGPSGALAXXGGQPEPPRAKVVWCCE

SEQ ID NO: 2568 - DNA, 97 bp, Zea mays
  misc_feature: Ceres CLONE 276158-F
  misc_feature: Encodes the peptide sequence at SEQ ID NO. 2569
actcacagctcaaaagcagccaaaacgctagctagctgcagcgatgatgtctcgctcctgctgcctccgccggtgtcggtccttctcgcggtcgccg

SEQ ID NO: 2569 - protein, 32 aa, Zea mays
  misc_feature: Ceres CLONE 276158-F
THSSKAAKTLASCSDDVSLLLPPPVSVLLAVA

SEQ ID NO: 2570 - DNA, 151 bp, Zea mays
  misc_feature: Ceres CLONE 276241-F
awaccagcacccgccgccgacagggaacatcgccggccgagatcggctgcacatctgtstgcttcagggcgccggagttcgcgtcgtcgttcggtaactttcggggtcaattggaggagggraagacaagcattacgagagcgacaarggg

SEQ ID NO: 2571 - DNA, 395 bp, Zea mays
  misc_feature: Ceres CLONE 276257-F
  misc_feature: Translation starting site: 77
  misc_feature (116)..(116): n is a, c, t, g, unknown, or other
ctagagccgcagcagcacactcccgcagtagcagcagccgccgccgccgccgcccagccgcagaaacaggaggaagatgccggcggggcacgggcttcggtcgcggacccgccatnttcgcgcggccgttccgcaagaagggttacatcccgctcaccacgtacctgcgcacctacaagatcggcgactacgtsacgtcaaggtgaacggcgccgtgcacaagggcatgccgcacaagttctaccacggccgcaccggtcgcgtctggaacgtcaccaagcgcgccatcgstttgagatcaacaagcaggttaatggccgcatcatcaggaagcgtatccatgtccgtgtggagcatgtgcagccctcccgttgcacagagggagttccggcttg

SEQ ID NO: 2572 - DNA, 270 bp, Zea mays
  misc_feature: Ceres CLONE 276260-F
  misc_feature (232)..(232): n is a, c, t, g, unknown, or other
aatcttgctctgaacgcattcctcccatctcccaagacctcctcagacccaagawgcgcmkgcggtccatggacgccaccggcactggagctggagggaaggcgaagaagggagcggccggtcgcaaggccgcgggcgatggaagaagtcggtgacgaggtccgtgaaggccgggctccagttccccgtcggccgcatcgggcgctacctcaagaagggccgctacgcgcancgtcggcagcggtgcccccgtctacctcgcggccgtcc

SEQ ID NO: 2573 - DNA, 389 bp, Zea mays
  misc_feature: Ceres CLONE 276268-F
  misc_feature: Encodes the peptide sequence at SEQ ID NO. 2574
  misc_feature (19)..(19): n is a, c, t, g, unknown, or other
  misc_feature (100)..(100): n is a, c, t, g, unknown, or other
ccacacagcaagccagcwnagcagaaagcagccgcagccccagcccccacaagacgaggcaacaatggcgctagaagcagccaccgccccccgcgcactnctcgccgcgtgcytcgtcctgctggtcctcggcggcggcaccggcccgtcgtcggtgctgcgcggcgccggggccaggccggcggcagtgctgcgcagctgaaccgcctcctggstgccgcgcgtacctggtgcccggcgcgccgtaccccagcgcggactgctgcagcgcgctgagscggtgtcgcacgagtgcgcctgcagcaccatgggcatcatcaacagcctgcccggccggtgccacctcgcccaagccaactgctccgcttgaagcagggacctggcacgcg

SEQ ID NO: 2574 - protein, 45 aa, Zea mays
  misc_feature: Ceres CLONE 276268-F
  misc_feature (17)..(17): Xaa is any aa, unknown, or other
MALEAATAPRALLAACXVLLVLGGGTGPSSVLRGAGARPAAVLRS

SEQ ID NO: 2575 - DNA, 337 bp, Zea mays
  misc_feature: Ceres CLONE 276271-F
  misc_feature: Encodes the peptide sequence at SEQ ID NO. 2576
  misc_feature (34)..(34): n is a, c, t, g, unknown, or other
  misc_feature (148)..(148): n is a, c, t, g, unknown, or other
  misc_feature (253)..(253): n is a, c, t, g, unknown, or other
actcttcgcttccgttcctgtyctctcctctgtncctctacggtgcttctkctcgccggcccaaaatcgcctcatcgaccacgcccccttccaggctcccgtctccattggtctcctctcaaacaggattkggagggagagcctcaangcgcgggatcatatctactcctggagggcggcgtgggtctacgcgcatcacggaatatatgtkggcgatgataaggtgatccatttcacaagaggaagaggacangaggtcggaacaggaacttcgtcgatattattcttgtgagttccacccccaaacgragcaacacgccttgcccggtgtgcaccg

SEQ ID NO: 2576 - protein, 96 aa, Zea mays
  misc_feature: Ceres CLONE 276271-F
  misc_feature (17)..(17): Xaa is any aa, unknown, or other
  misc_feature (44)..(44): Xaa is any aa, unknown, or other
  misc_feature (49)..(49): Xaa is any aa, unknown, or other
  misc_feature (84)..(84): Xaa is any aa, unknown, or other
LFASVPVLSSVPLRCFXSPAQNRLIDHAPFQAPVSIGLLSNRIXRESLXARDHIYSWRAAWVYAHHGIYVGDDKVIHFTRGRGXEVGTGTSSILFL

SEQ ID NO: 2577 - DNA, 486 bp, Zea mays
  misc_feature: Ceres CLONE 276287-F
  misc_feature: Encodes the peptide sequence at SEQ ID NO. 2578
  misc_feature (22)..(22): n is a, c, t, g, unknown, or other
  misc_feature (435)..(435): n is a, c, t, g, unknown, or other
gcagattagcaggccgcctgcnctcctcctttcccctcagcctcccctcctctccggtgtacgtctccgccgagatggccgccccgctccggcgastcccctcccttggtcgcgcgcttctcacgccggcgccggscggattgctctccgcggaggcctctgatgccctcgttgagatcaagcccggggagatcgggatggtctccggcatccctgagggagcatctccgccgtaagtttctaatttattcaccagctaggactgcatcccagcaaggttcaggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgccganaaaacatggatggaattatgtggttcgggaaacgccatgcacctcttctga

SEQ ID NO: 2578 - protein, 107 aa, Zea mays
  misc_feature: Ceres CLONE 276287-F
  misc_feature (24)..(105): Pfam Name: ETC_C1_NDUFA4 Pfam Description: ETC complex I subunit conserved region
  misc_feature (91)..(91): Xaa is any aa, unknown, or other
MPSLRSSPGRSGWSPASLREHLRRKFLIYSPARTASQQGSGKVGRWKINFLSTQKWENPLMGWTSTGDPYANVGEAGLTFDSAESAKAFAXKTWMELCGSGNAMHLF

SEQ ID NO: 2579 - DNA, 433 bp, Zea mays
  misc_feature: Ceres CLONE 276294-F
  misc_feature: Encodes the peptide sequence at SEQ ID NO. 2580
  misc_feature (124)..(124): n is a, c, t, g, unknown, or other
  misc_feature (126)..(126): n is a, c, t, g, unknown, or other
  misc_feature (296)..(296): n is a, c, t, g, unknown, or other
  misc_feature (308)..(308): n is a, c, t, g, unknown, or other
atccgtgcatacatgctcattgctcaccaagggcaagggaggaggagaggacacacagcagtagcgcaaaatggcggcgatgatgatggatagtaccgcggagaaagacctcgccggckacscntngcggtgagcgggcacgggcaggacttggagcggtcttgccatgaccaggagcccgccgctgcagatggtgcgagcagcagaggcctagccatcgggcgtttcgtacgggagctgatggtggagggcgtggcgtcgttcctgctggtgttctggtccgcggtggcgcgctnatgcaggagatncacggcacgctgacgttccccatggtgtgcctcgtcgtcgcgctcaccgtcgtcttcgtgctctgctggctcggccccgcgcacttcaaccccgccgtcaccgtcaccttcaccgtattcggcta

SEQ ID NO: 2580 - protein, 45 aa, Zea mays
  misc_feature: Ceres CLONE 276294-F
  misc_feature (4)..(4): Xaa is any aa, unknown, or other
MQEXHGTLTFPMVCLVVALTVVFVLCWLGPAHFNPAVTVTFTVFG

SEQ ID NO: 2581 - DNA, 241 bp, Zea mays
  misc_feature: Ceres CLONE 276295-F
  misc_feature: Encodes the peptide sequence at SEQ ID NO. 2582
  misc_feature (89)..(89): n is a, c, t, g, unknown, or other
  misc_feature (90)..(90): n is a, c, t, g, unknown, or other
  misc_feature (142)..(142): n is a, c, t, g, unknown, or other
  misc_feature (145)..(145): n is a, c, t, g, unknown, or other
  misc_feature (215)..(215): n is a, c, t, g, unknown, or other
aaacaaagccgaggtaaagcagggagcatcttgagtgttcgacagtgagccatggagaagacgtccgagagcgccataccgccggcgcnnccccgctgatgctgttcgggtcgtgggcgagctcgtacacgcaccggtcaanctngcgctgcgggctcaagggcctggagtacgactacgtggaggaggacctggggaacaaaagcgacgagctncttcgccacaaccccgtccacaagaa

SEQ ID NO: 2582 - protein, 47 aa, Zea mays
  misc_feature: Ceres CLONE 276295-F
  misc_feature: SWISSPROT Homolog: EC 2.5.1.18 Glutathione transferase
  misc_feature (15)..(15): Xaa is any aa, unknown, or other
  misc_feature (16)..(16): Xaa is any aa, unknown, or other
MLFGSWASSYTHRSXXRCGLKGLEYDYVEEDLGNKSDELLRHNPVHK

SEQ ID NO: 2583 - DNA, 207 bp, Zea mays
  misc_feature: Ceres CLONE 276305-F
  misc_feature: Encodes the peptide sequence at SEQ ID NO. 2584
  misc_feature (95)..(95): n is a, c, t, g, unknown, or other
  misc_feature (96)..(96): n is a, c, t, g, unknown, or other
  misc_feature (98)..(98): n is a, c, t, g, unknown, or other
acagcgaaggacacaaaaacacaggtagggttaggcgacgcggcggcgagagcgcgagagtaggaggaggcgtcggccatgacggggaaggcgannangaagcacacggcgaaggagatcgccgcgaagatcgacgcggcgacgacgaaccggggcggcggcaaggtcgrgcaggcggatcggctagggcaggacaagggcgggcac

SEQ ID NO: 2584 - protein, 43 aa, Zea mays
  misc_feature: Ceres CLONE 276305-F
  misc_feature (6)..(6): Xaa is any aa, unknown, or other
  misc_feature (7)..(7): Xaa is any aa, unknown, or other
  misc_feature (31)..(31): Xaa is any aa, unknown, or other
MTGKAXXKHTAKEIAAKIDAATTNRGGGKVXQADRLGQDKGGH

SEQ ID NO: 2585 - DNA, 195 bp, Zea mays
  misc_feature: Ceres CLONE 276326-F
  misc_feature: Encodes the peptide sequence at SEQ ID NO. 2586
  misc_feature (37)..(37): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
awaagctagcttatttcccttcccttcacgcggcaangtcggccggccttccgccgccatggccaccaccaccgcgcccgtcctcctcgtcttcctcgttgccattgcyacktccgtcnnnccctcattccccatcctgacgatggcggcggacgcggacaacggcaccacccacctgagcttcttcatgcacga

SEQ ID NO: 2586 - protein, 45 aa, Zea mays
  misc_feature: Ceres CLONE 276326-F
  misc_feature (21)..(21): Xaa is any aa, unknown, or other
MATTTAPVLLVFLVAIATSVXPSFPILTMAADADNGTTHLSFFMH

SEQ ID NO: 2587 - DNA, 466 bp, Zea mays
  misc_feature: Ceres CLONE 276329-F
  misc_feature: Encodes the peptide sequence at SEQ ID NO. 2588
tytcgaggtatcgagtctcgaccaacccatacgcacctaccctccgccaccgttccccccctctgcatctcgcccgccgttctcgtccttgtagatctcctcgcacctcgcccattcgcttcaccaagggtttaagaccggcggcgatggcggcgaacgtggcgcacgtgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgattgtgtcaagcaggtatggaataacaggaaggacctcacggttgaggaccttggcattgccagtttgtttggagttgagctctatgcatggttctgcgt

SEQ ID NO: 2588 - protein, 106 aa, Zea mays
  misc_feature: Ceres CLONE 276329-F
  misc_feature (8)..(106): Pfam Name: ATP-synt_G Pfam Description: Mitochondrial ATP synthase g subunit
MAANVAHVRTQVTRAAEFASKHGCSYYKEVMEKNKQYVVQPPTVEKCQELSKQLFYTRLASLPGRYESFWKELDCVKQVWNNRKDLTVEDLGIASLFGVELYAWFC

SEQ ID NO: 2589 - DNA, 124 bp, Zea mays
  misc_feature: Ceres CLONE 276332-F
acgcacaccgcgacccagtccagagccagtacgtgcgamggcacgcacgctgctggtccgcgtacsagacgacggtcaggtcggccggtgcttttcagtttggaataatgacggcgacgacgac

SEQ ID NO: 2590 - DNA, 442 bp, Zea mays
  misc_feature: Ceres CLONE 276334-F
  misc_feature: Translation starting site: 327
  misc_feature (220)..(220): n is a, c, t, g, unknown, or other
  misc_feature (391)..(391): n is a, c, t, g, unknown, or other
  misc_feature (425)..(425): n is a, c, t, g, unknown, or other
  misc_feature (428)..(428): n is a, c, t, g, unknown, or other
atatgcactagcagtatcacctcatttaatatgcggccggcatcgtcgccagagctctcgatcaagctcgccagvbcctcatctcatacgccggagtgctccagagagcagggctgaagaggtgcggcaagagctgcaggctgaggtacaccaactatcgcgcgctgatctgggcgacgaactgmgtgcgcgtttgcaggtggtccctgatcgcgamagnctgccggggcggacgggcaacgacgtgaggaaccgttggaacacgaaactkagagcaagcagctgcggcasgcgggatcgaccccaccgcccccatcgccggcctcatgcacatcttcgtcggcgccctctccttacggcgacgacggcacggtaacgacgacggcacggnagagatcatcgacgccaccctggactgcgacaanaanacacgggtggacca

SEQ ID NO: 2591 - DNA, 270 bp, Zea mays
  misc_feature: Ceres CLONE 276338-F
cttctcgaccagatccggaagttctgtgggtagaggactagagactgcagatcgagggtctkgcaccgggccgtggcagttgggtgattacgacgaagagagatgggcctcctcgacaagctgtgggacgacaccgtscaggcccgckcccggacaccggctcggccgcctccgcaagcagcctgtgcgtcmmcgccgccgtcaagatcagtgatccggccggggacgctgcagsttcgtgccgccctcgccggcttcgggtagcgagga

SEQ ID NO: 2592 - DNA, 436 bp, Zea mays
  misc_feature: Ceres CLONE 276348-F
  misc_feature (80)..(80): n is a, c, t, g, unknown, or other
  misc_feature (169)..(169): n is a, c, t, g, unknown, or other
  misc_feature (192)..(192): n is a, c, t, g, unknown, or other
  misc_feature (394)..(394): n is a, c, t, g, unknown, or other
csgcccgaagccgaggaggagaggggagcagcgagatcgtgcgcgcctccgagatctccacgaagtttgtgggtaacatngggctcaccttcacgaagctcttcagccggctcttctccaagaaagagatgaggatcsttatggttggtctcgatgcagctggtaagancaccawcctctacaaggctcaangctcggagaaatcgtgaccaccatccctacaatcgggtttaatgtggagactgttgaatacaagaacattagcttcactgtctgggatgttggaggtcagacaatatcaggccattgtggaggcactatttccagaacacccaaggccttatstttgttgttgatagcaatgacagagatcgtgttgttgaagcaaaggatnagctccacaggatgctgaacgaggatgaattgagggatgctg

SEQ ID NO: 2593 - DNA, 345 bp, Zea mays
  misc_feature: Ceres CLONE 276381-F
  misc_feature: Encodes the peptide sequence at SEQ ID NO. 2594
  misc_feature (177)..(177): n is a, c, t, g, unknown, or other
  misc_feature (208)..(208): n is a, c, t, g, unknown, or other
  misc_feature (259)..(259): n is a, c, t, g, unknown, or other
  misc_feature (320)..(320): n is a, c, t, g, unknown, or other
akaggctactgggtgaccgccgcctctgccgccctacgccaggttccaggtcttcgtcactccctttcattatcttcgtcgtctcattcgccggcgacgagcacccaccagaaatcatagctgctttgggtatggaggcgctgtttgggagcaataaccatggcggccacaaggctnattttggcctcgcttataattacccaggttnccttggaggtgccaaggttacttgggctccttgccatgattckgcataatnaaatctttacatctggtggagaccagaatttrattactaggattctggggcaaaagcgaanatgaaactaatcctgagaacaaaga

SEQ ID NO: 2594 - protein, 53 aa, Zea mays
  misc_feature: Ceres CLONE 276381-F
  misc_feature (17)..(17): Xaa is any aa, unknown, or other
  misc_feature (31)..(31): Xaa is any aa, unknown, or other
  misc_feature (34)..(34): Xaa is any aa, unknown, or other
MAATRLILASLIITQVXLEVPRLLGLLAMIXHNXIFTSGGDQNLITRILGQKR

SEQ ID NO: 2595 - DNA, 268 bp, Zea mays
  misc_feature: Ceres CLONE 276396-F
  misc_feature: Pfam Name: DUF6 Pfam Description: Integral membrane protein DUF6
  misc_feature (73)..(73): n is a, c, t, g, unknown, or other
atggatgcagggcaacgctgaaccaggtgctgttcgtcgtggggctcaagtccaccagcgcgaccgtggcgtncgcgctcaccaacacgctgccggcgckgaccttcgtgatkdcggcggcgctcaagatggagccggtgcgccgggcacgsggcggggcaggccaagctggtgggcacggcggtgtgcgtgggcggatccatgctcatacccttctacaagggccccgtcctcagggtgtgggcgtccccgatccactggcgcttcg

SEQ ID NO: 2596 - DNA, 97 bp, Zea mays
  misc_feature: Ceres CLONE 276417-F
acacactcgactctcctctctcgcatccgcagcctttcgagctctactccaccccctcgatctcgaagcgcmaggcagcagtcaggcggccatggac

SEQ ID NO: 2597 - DNA, 308 bp, Zea mays
  misc_feature: Ceres CLONE 276433-F
  misc_feature: Translation starting site: 72
  misc_feature (204)..(204): n is a, c, t, g, unknown, or other
  misc_feature (271)..(271): n is a, c, t, g, unknown, or other
  misc_feature (274)..(274): n is a, c, t, g, unknown, or other
atccaattcacaggctcaccacaccaaccaacaagcaaaaattccccaatcctctcgtctccgcggcgaagatgtcggggcgcggcaagggcggcaagggcctgggcaagggcggcgcgamkcaccggaaggtcttgcgcgayaacatccaggggatcacgaagccggcgatccggaggctggcgcggcggggcggcgtgaagnatctcggggctcatctacgaggagacccgcggcgtgctcaagatcttcctggagaacgtcatccggngangccgtcacytacaccgagcacgcgcgccgtaaga

SEQ ID NO: 2598 - DNA, 482 bp, Zea mays
  misc_feature: Ceres CLONE 276447-F
  misc_feature: Encodes the peptide sequence at SEQ ID NO. 2599
aatccaacaagcaaacctgcagtcatctcctccaccaccaccaccaagctcaacaacagccagctcgcgaaaataatgaagagccgcagcatggcatcatcggccgcgctcttggtgctagccctcgcgctagtggcggccaccgcccacaggtagcggaggcaaagaagaagagagcggcggagagcggcgaggcggcggaggcgaagaagatccaggacgacttctgctcgacgctgtgsagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctca

SEQ ID NO: 2599 - protein, 35 aa, Zea mays
  misc_feature: Ceres CLONE 276447-F
MKVCQEECDKAYVVKAAEVTKACSVTCAKEKNPRL

SEQ ID NO: 2600 - DNA, 177 bp, Zea mays
  misc_feature: Ceres CLONE 276461-F
  misc_feature (101)..(101): n is a, c, t, g, unknown, or other
  misc_feature (156)..(156): n is a, c, t, g, unknown, or other
scagagtsatcgcggcgtgttcaaatcccacaatcttcttgtagcacaccactgtsttcgtccaactcggcggcgatgtctggcgcggcaagggcggcaangggctgggcaaggtggtgcgaaacgccaccgtaagttctccgcgacaacatccanggtatcacgaagccggcaatc

SEQ ID NO: 2601 - DNA, 314 bp, Zea mays
  misc_feature: Ceres CLONE 276469-F
  misc_feature (226)..(226): n is a, c, t, g, unknown, or other
  misc_feature (264)..(264): n is a, c, t, g, unknown, or other
aaaccgaagcgtccgcctcccacacacgggactccggccgcgagaacccgcgactaagccaggacgcgggacscacagccaccggcctcagcatccgcctaggacgaataacccttctaggctgccgccgccgccgtccttagctcatattgttgccggcgaagagcgccccagatccgcccctgctatggagtcggcggttaacccgaagcgtacccgctggctnatgcgcacgtgacgataggtatcatcgatatcatccancaggccgccaactacaagcagctcaagaagggatctaacgaagcgacgaa

SEQ ID NO: 2602 - DNA, 462 bp, Zea mays
  misc_feature: Ceres CLONE 276477-F
  misc_feature: Encodes the peptide sequence at SEQ ID NO. 2603
  misc_feature (224)..(224): n is a, c, t, g, unknown, or other
  misc_feature (229)..(229): n is a, c, t, g, unknown, or other
  misc_feature (422)..(422): n is a, c, t, g, unknown, or other
gctctcaaatatctctcaccacctctcccctcagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcasrttggaagaagggcggcggcggcggtggtggcggaggcagtgttagcgnaasgnaggcgtcaacctgaatccctgggagtgctcgcccaagtgcgggtcgcggtgctccaagacgcakacaggaaggcctgcctcaccttatgcaacaagtgctgcgccaagtgcctctgcgtgccaccggggttctacggcaacaagggcgcctgccctgctacaacaactggaaaaccaagaaggagggcccaanttcccctagaataagatccaccgcagctcccgtccgccat

SEQ ID NO: 2603 - protein, 113 aa, Zea mays
  misc_feature: Ceres CLONE 276477-F
  misc_feature (2)..(107): Pfam Name: GASA Pfam Description: Gibberellin regulated protein
  misc_feature (27)..(27): Xaa is any aa, unknown, or other
  misc_feature (28)..(28): Xaa is any aa, unknown, or other
  misc_feature (44)..(44): Xaa is any aa, unknown, or other
  misc_feature (45)..(45): Xaa is any aa, unknown, or other
  misc_feature (67)..(67): Xaa is any aa, unknown, or other
  misc_feature (110)..(110): Xaa is any aa, unknown, or other
MATKVICFLVLASLLLAVAFPVSALRXXGRRAAAAVVAEAVLAXXRRQPESLGVLAQVRVAVLQDAXRKACLTLCNKCCAKCLCVPPGFYGNKGACPATTTGKPRRRAQXPLE

SEQ ID NO: 2604 - DNA, 231 bp, Zea mays
  misc_feature: Ceres CLONE 276482-F
  misc_feature (107)..(107): n is a, c, t, g, unknown, or other
  misc_feature (214)..(214): n is a, c, t, g, unknown, or other
aggacaggttgcatttgcatcttagttcctgatcgttgtattccagtttcttccgtgagttttgtgggatcgcgagghagaaggatgtcgtgctgcggaggcaactncgggtgcggcgccggctgcaagtkcggcasggctgcgagggtgcaagatgtacccggacattgctgagcaggtgaccaccaccaccaccacccagactctcatcatnggtgttgcaccatccaa

SEQ ID NO: 2605 - DNA, 392 bp, Zea mays
  misc_feature: Ceres CLONE 276492-F2
  misc_feature (247)..(247): n is a, c, t, g, unknown, or other
  misc_feature (281)..(281): n is a, c, t, g, unknown, or other
  misc_feature (313)..(313): n is a, c, t, g, unknown, or other
  misc_feature (368)..(368): n is a, c, t, g, unknown, or other
  misc_feature (370)..(370): n is a, c, t, g, unknown, or other
caactcgcaattccgcattcgttccaactcctgagcactttctcctcgtccccgacaagccaatcgaagccgagatacggccatggactccaccggcaccgagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgscasynttcggcaccggcgcccccgtctacctcgccgctntcctcgaatacctcgccgctgaggttctgganctcgctggtaatactcccagggacaacaataagactcgcattattccgcgccacntncttctggcgatccggaacgacg

SEQ ID NO: 2606 - DNA, 392 bp, Zea mays; identical to SEQ ID NO: 2605
  misc_feature: Ceres CLONE 276492-F
  misc_feature: Encodes the peptide sequence at SEQ ID NO. 2607
  misc_feature (247)..(247): n is a, c, t, g, unknown, or other
  misc_feature (281)..(281): n is a, c, t, g, unknown, or other
  misc_feature (313)..(313): n is a, c, t, g, unknown, or other
  misc_feature (368)..(368): n is a, c, t, g, unknown, or other
  misc_feature (370)..(370): n is a, c, t, g, unknown, or other

SEQ ID NO: 2607 - protein, 100 aa, Zea mays
  misc_feature: Ceres CLONE 276492-F
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (94)..(94): Xaa is any aa, unknown, or other
QLAIPHSFQLLSTFSSSPTSQSKPRYGHGLHRHRAGGKGKKGAAGRKVGGPRKKSVSRSVKAGLQFPVGRIGRYLKKGRYXXXRHRRPRLPRRXPRIPRR

SEQ ID NO: 2608 - DNA, 424 bp, Zea mays
  misc_feature: Ceres CLONE 276500-F
  misc_feature: Translation starting site: 86
  misc_feature (180)..(180): n is a, c, t, g, unknown, or other
  misc_feature (216)..(216): n is a, c, t, g, unknown, or other
  misc_feature (242)..(242): n is a, c, t, g, unknown, or other
  misc_feature (341)..(341): n is a, c, t, g, unknown, or other
  misc_feature (390)..(390): n is a, c, t, g, unknown, or other
  misc_feature (407)..(407): n is a, c, t, g, unknown, or other
  misc_feature (411)..(411): n is a, c, t, g, unknown, or other
tcgcagaaatcctccgcaacttcacagcgtatcatcgttttccatcgctcctactcctatcatccagaaaatctgagcggtattgatggcgcccaaggsgagaagaagccggcggsaagaaggtggcggaggaggagccctcggagaaggcggctccggcggaaaggcccccgcggtaanaagcccaaggcggagaagcggctacctgcgggcaantccgccggcaagagggcggcgacaanaagggtaggaagaaggcgaagaagagcgtggagacctacaagatctacatcttcaaggtcctgaagcaggtgcaccccgacatcggcatctcctccaangccatttccatcattaactccttcatcaacgacatcttcgagaagctcnccgcggaagccgccaanctcncccggtacaacaa

SEQ ID NO: 2609 - DNA, 94 bp, Zea mays
  misc_feature: Ceres CLONE 276503-F
atcacacactcgactctcctctctcgcatccgcrcctttcgagctctactccaccccctcgatctcgaagcgcaagcagcagtcaggcggccat

SEQ ID NO: 2610 - DNA, 472 bp, Zea mays
  misc_feature: Ceres CLONE 276510-F
  misc_feature: Translation starting site: 90
  misc_feature (415)..(415): n is a, c, t, g, unknown, or other
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaangaaggttataggctgctcctgtgtcgtcgtcaaggactacggtgaagaatctgaggg

SEQ ID NO: 2611 - DNA, 224 bp, Zea mays
  misc_feature: Ceres CLONE 276524-F
  misc_feature: Encodes the peptide sequence at SEQ ID NO. 2612
accaatcccatcctccacccaatcgaaggacctagcgagcggcassggggggcgatcggagaagatggtgcgcaaggcgaagsttgagttcgacgagcagccgccggataacttckcacccgaagaacccgtatgccgacccggtggccgatgctcgagtaccgggaacacctggtgcgagagcaagtggatccagatcgagaccgccaagatcatccgggagc

SEQ ID NO: 2612 - protein, 53 aa, Zea mays
  misc_feature: Ceres CLONE 276524-F
  misc_feature (7)..(7): Xaa is any aa, unknown, or other
  misc_feature (18)..(18): Xaa is any aa, unknown, or other
MVRKAKXEFDEQPPDNFXPEEPVCRPGGRCSSTGNTWCESKWIQIETAKIIRE

SEQ ID NO: 2613 - DNA, 102 bp, Zea mays
  misc_feature: Ceres CLONE 276533-F
aaaagaagacggacggacccagtgaggcgagcatgggcgctcaccggctatggcgacgagggcatggstggccgcggcggtggcttgaaccctcaactgctg

SEQ ID NO: 2614 - DNA, 425 bp, Zea mays
  misc_feature: Ceres CLONE 276539-F
  misc_feature: Translation starting site: 75
  misc_feature (291)..(291): n is a, c, t, g, unknown, or other
  misc_feature (405)..(405): n is a, c, t, g, unknown, or other
tcgcttcgaagtgttcgtgcgaaggcgaccctccctccttcgctccttccccgccgcctcccggccgtcgcsgcatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccytgaggatgttattgctcacaagcaggcaattcccttccggagatactgtgggggtgttggtcgcactgcgcaanyaagtctcgccactccaatgggcagggccgctggcggttaaatcagacgggttcatcctggatttgctgaagaatgctgagagtaacgctgatgtgaaaggcttggatgtgganaacctctatatttcacacat

SEQ ID NO: 2615 - DNA, 453 bp, Zea mays
  misc_feature: Ceres CLONE 276605-F
  misc_feature: Translation starting site: 3
  misc_feature: Pfam Name: Cystatin Pfam Description: Cystatin domain
  misc_feature (81)..(81): n is a, c, t, g, unknown, or other
  misc_feature (256)..(256): n is a, c, t, g, unknown, or other
  misc_feature (262)..(262): n is a, c, t, g, unknown, or other
  misc_feature (273)..(273): n is a, c, t, g, unknown, or other
  misc_feature (322)..(322): n is a, c, t, g, unknown, or other
  misc_feature (330)..(330): n is a, c, t, g, unknown, or other
  misc_feature (339)..(339): n is a, c, t, g, unknown, or other
  misc_feature (342)..(342): n is a, c, t, g, unknown, or other
  misc_feature (382)..(382): n is a, c, t, g, unknown, or other
  misc_feature (385)..(385): n is a, c, t, g, unknown, or other
  misc_feature (412)..(412): n is a, c, t, g, unknown, or other
  misc_feature (439)..(439): n is a, c, t, g, unknown, or other
atatgcgcaaacatcgaatcgtctcgctagtggctgccctactcgtgctgcttgccctcgccgccgtttcctccacgcgcnvacaaaaggagtccgcggctkacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttttaaggccaaacacaantggttnctggcacgatntactatctcactattgaagtgaaggatggcgaagtcaataagctctatnaagctaangtctggganaanccatgggagaacttcaagcagctgcaggaattcaagcctnttnaagagggtgctagcgcctaaggatctntcgtctccctgtgcaatttgctgcctnaagcgcaaaactaa

SEQ ID NO: 2616 - DNA, 409 bp, Zea mays
  misc_feature: Ceres CLONE 276609-F
  misc_feature: Encodes the peptide sequence at SEQ ID NO. 2617
  misc_feature (254)..(254): n is a, c, t, g, unknown, or other
  misc_feature (357)..(357): n is a, c, t, g, unknown, or other
  misc_feature (397)..(397): n is a, c, t, g, unknown, or other
  misc_feature (406)..(406): n is a, c, t, g, unknown, or other
atcgttgtccaatatataaraggccaaataatcaagcacaggcagcagcatacacacagcaagaaaagaatggacatggagaaggccctagccctagttctactggtatcagctgccatactcctaggcgcacaccagccgacgagcgctcaggtgttctgccgctcgcagttcaacctggccaacgaggcgtgcagcatgcggaatttcatcccggggccgggggtgaggcgcgggggccttccgcggcacancagctcaacgagacgacgtcgtcgtcgaacggccaccacagccagcgctgtcagtcaaggtgctgcagtcccggagcgacgacgacgacgacagccacggcgngaggcggtcccggcgccggcaccagcaccggcacagcgangacgggganggc

SEQ ID NO: 2617 - protein, 112 aa, Zea mays
  misc_feature: Ceres CLONE 276609-F
  misc_feature (62)..(62): Xaa is any aa, unknown, or other
  misc_feature (110)..(110): Xaa is any aa, unknown, or other
MDMEKALALVLLVSAAILLGAHQPTSAQVFCRSQFNLANEACSMRNFIPGPGVRRGGLPRHXSSTRRRRRRTATTASAVSQGAAVPERRRRRQPRREAVPAPAPAPAQRXRG

SEQ ID NO: 2618 - DNA, 1257 bp, Zea mays
  misc_feature: Ceres CLONE 276642
  misc_feature: Encodes the peptide sequence at SEQ ID NO. 2619
aaatcgaatccactggcccattcgtcttcaggactttctcgtgtagcatcatttccgctacccaaatctctccatccacggcgacgcccgacgccatccgtcagccagccccatctccaccacccctccccgtccccgacgtagcagcactgcagcagagcggagaggcggccaagccaactcctcaccggtagctcctccgcgctcccgggctccgtctcgccgcactcggatgccccctgcgctggcgcctagagcggcggcggtctagcgggcgccgggagcggtgaaatccacccatggccgacgctctcctccttccgtgccgcttcctcgcgccgttgtcagtcgcatccggcgcctcttcatcagcctcttcgtccccgccgtgtcgttgggtgctctcgtcgcccggctcgccgtggcggccgcgcttggctgccgggcaacggcaaccccgacctcgccggttcactcggcacaagatttgtgcagcagagcgtggtgagcaaccgaaatggtgggagaaaaatgctgggccaaacatgattgacatccactccacagtggagttcttggatgcactaagagatgctggagacaggcttgttattgttgagttctacggaacctggtgtggttcatgcagggctctctttccaaggctctgccggacagctttggagacccctgatgtattgtttctaaaagtgaattttgatgaaaacaaacccatgtgcaaacgactgaatgtcaaagtccttcctttccttcccattttttatcgtggagctgatgggctactggaggctttctcctgttccttagctaagtttcagaagctgaaggatgccattgcaatgcacaacactgctcgttgcagcattggtccacctgttggagttggcgatgttgacttgctggatagcgcgagccctcaagagaaacctgcagaagctagcccacgttagattaatgataaggggctcctccccatccacgtctacatcctgctcattgttttcttcactatagaccttaatgtaatcagttcaggagaaccaaagtaccctcaattcatgaatcagatgtatggattatcgtacgcattcttgaaagggaaaaaagtgtataatagtgataactatacgttttttggacagaagaaccatgtacttgtacgtcattttaggtgaagacgtcatgagcatttaagcgcccttgtgggccgttttatcagtaaaaaaaaaaaaaaaa

SEQ ID NO: 2619 - protein, 223 aa, Zea mays
  misc_feature: Ceres CLONE 276642
  misc_feature (85)..(189): Pfam Name: Thioredoxin Pfam Description: Thioredoxin
  misc_feature: SWISSPROT Homolog: EC 1.8.1.8 Protein-disulfide reductase
MADALLLPCRFLAPLSVASGASSSASSSPPCRWVLSSPGSPWRPRLAAGQRQPRPRRFTRHKICAAERGEQPKWWEKNAGPNMIDIHSTVEFLDALRDAGDRLVIVEFYGTWCGSCRALFPRLCRTALETPDVLFLKVNFDENKPMCKRLNVKVLPFLPIFYRGADGLLEAFSCSLAKFQKLKDAIAMHNTARCSIGPPVGVGDVDLLDSASPQEKPAEASPR

SEQ ID NO: 2620 - DNA, 126 bp, Zea mays
  misc_feature: Ceres CLONE 276645-F
atcttgctctgaacgcattcctcccatctcccaagacctcctcagacccgagaagcgcmkgcgggccatggacgccaccggcactggagctggagggaaggcgaagaaggagcggccggtcgcaag

SEQ ID NO: 2621 - DNA, 138 bp, Zea mays
  misc_feature: Ceres CLONE 276693-F
  misc_feature (71)..(71): n is a, c, t, g, unknown, or other
atcccatccatcacagctagctagcatacagacgaataatctcttcttcacctcactaactaccagctaknaactctttctctcctgcaataatggccgctcgctcctcctcctcccagccgcagctgtcgcggcggc

SEQ ID NO: 2622 - DNA, 416 bp, Zea mays
  misc_feature: Ceres CLONE 276694-F
  misc_feature: Encodes the peptide sequence at SEQ ID NO. 2623
  misc_feature (79)..(79): n is a, c, t, g, unknown, or other
  misc_feature (80)..(80): n is a, c, t, g, unknown, or other
akatccgtgttccgtgtccgcgtccagtgtgtccgctactccgctccccctcagtcctcagttcctcacctagcggtanngccgcgcgggagacgtagatggcggcttcggaggcggcasggcggcgtcaacaccggtgacgcgacaagaggggacggtgatcgcgatccacagcctggaggagtggagcatccagatcgaggaggccaacagcgccaagaagctggtggtgattgacttcactgcaacatgggtgtcctccgtgccgcgccatggctccaatttttgctgatatggccaagaagtccccaaatgttgttttcctgaaagttgatgtggatgaaatgaagaccattgctgagcaattcagcgtagaggccatgcaacattcctgttcatgagggagggcgacgtca

SEQ ID NO: 2623 - protein, 42 aa, Zea mays
  misc_feature: Ceres CLONE 276694-F
MAPIFADMAKKSPNVVFLKVDVDEMKTIAEQFSVEAMQHSCS

SEQ ID NO: 2624 - DNA, 340 bp, Zea mays
  misc_feature: Ceres CLONE 276722-F
  misc_feature: Translation starting site: 43
  misc_feature: Pfam Name: Thaumatin Pfam Description: Thaumatin family
  misc_feature (88)..(88): n is a, c, t, g, unknown, or other
  misc_feature (294)..(294): n is a, c, t, g, unknown, or other
gagatcgacatcgatccaccgaggtttcttgtgcgtgccgccatggccatggcagtagctcaccttcttcctcagctctccgccgamnatggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccactcgccgccgctcgcgcgtcgggcttctacctggcgccgtccgcaacgtccagcatggaccngccgtcgtcggggacatggtccggcacgttgtgggcgcgcacgggc

SEQ ID NO: 2625 - DNA, 191 bp, Zea mays
  misc_feature: Ceres CLONE 276723-F
  misc_feature (113)..(113): n is a, c, t, g, unknown, or other
  misc_feature (115)..(115): n is a, c, t, g, unknown, or other
gtttcttcggaggctttatttatcgtttatccacggaacttccggtgccggcggcgaccacttgtgcgatccatccctcaccatgtcgtcggagaaggaggcggcgctcgcgngnccttcgatgacagcccaaccatatttgacaagatcatcaaaaaggaaataccttctactgtggttaatgaggacga

SEQ ID NO: 2626 - DNA, 301 bp, Zea mays
  misc_feature: Ceres CLONE 276754-F
  misc_feature: Encodes the peptide sequence at SEQ ID NO. 2627
  misc_feature (2)..(2): n is a, c, t, g, unknown, or other
  misc_feature (185)..(185): n is a, c, t, g, unknown, or other
  misc_feature (187)..(187): n is a, c, t, g, unknown, or other
anagcccgaactcttcacgtcgcgtcggccggcaattggcattcccactgcgccgccgtcggaatcgactgggtcctcgccgccgatgggcttcttccgccggatcgccggcttcctaggcatctcgcgggacgacgccgaccacccggactccccgacctccgtcgcggcgcscggcggcgsgnanactccctcatgacagggcggcggcgcacggggtaaggcagggggttcagcgtcaaggttcctgtccatgtcgagcggcaggtcccgtgcccgtgctggtgccctgcccgcaggg

SEQ ID NO: 2627 - protein, 37 aa, Zea mays
  misc_feature: Ceres CLONE 276754-F
  misc_feature (30)..(30): Xaa is any aa, unknown, or other
  misc_feature (33)..(33): Xaa is any aa, unknown, or other
  misc_feature (34)..(34): Xaa is any aa, unknown, or other
MGFFRRIAGFLGISRDDADHPDSPTSVAAXGGXXTPS

SEQ ID NO: 2628 - DNA, 476 bp, Zea mays
  misc_feature: Ceres CLONE 276757-F
  misc_feature: Translation starting site: 65
  misc_feature: Pfam Name: Ribosomal_L34e Pfam Description: Ribosomal protein L34e
  misc_feature (2)..(2): n is a, c, t, g, unknown, or other
  misc_feature (95)..(95): n is a, c, t, g, unknown, or other
anactatctgccgctccagcctttcgctagggtttatccaccggcggcgcgcgckacgcgcaagatggtgcagcgtctgacctaccgcaagctgncacagctatgccacgaatccaaccagacgcgggtcgtcaagacctggtggcaagctcgtgtaccagtacaccaagaagagagccagcggcccaagcktcccgtgaccgggaagaagatccagggcattccccatctgaggccagctgagtacaaaaggtccaggttgtctaggaaccgcagaactgtgaaccgtccctatggggagtactatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacatttttgtcg

SEQ ID NO: 2629 - DNA, 337 bp, Zea mays
  misc_feature: Ceres CLONE 276759-F
  misc_feature: Encodes the peptide sequence at SEQ ID NO. 2630
acacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcsaggccggcgggcagtgctgcgcagctgaaccgcctcctggsttgccgcgcgtacctggtgcccggcgcgccggaccccagcgcggactgctgcagcgcgctgagscgttgtcgcacgagtgcgcctgcagcaccatgggcatcatcaacagcctgcccggccgg

SEQ ID NO: 2630 - protein, 91 aa, Zea mays
  misc_feature: Ceres CLONE 276759-F
  misc_feature (51)..(51): Xaa is any aa, unknown, or other
  misc_feature (72)..(72): Xaa is any aa, unknown, or other
MALEAATAPRALLAACLVLLVLGGGTGPSSVLRGAGARPAGSAAQLNRLLXCRAYLVPGAPDPSADCCSALXRCRTSAPAAPWASSTACPA

SEQ ID NO: 2631 - DNA, 468 bp, Zea mays
  misc_feature: Ceres CLONE 276786-F
  misc_feature: Encodes the peptide sequence at SEQ ID NO. 2632
gaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgt

SEQ ID NO: 2632 - protein, 119 aa, Zea mays; identical to SEQ ID NO: 566
  misc_feature: Ceres CLONE 276786-F
  misc_feature (28)..(115): Pfam Name: Tryp_alpha_amyl Pfam Description: Protease inhibitor/seed storage/LTP family

SEQ ID NO: 2633 - DNA, 179 bp, Zea mays
  misc_feature: Ceres CLONE 276804-F
  misc_feature (127)..(127): n is a, c, t, g, unknown, or other
atccaacccacacacaggctgaccccaccaacagcaagcgaaaatctcccgatcccctctagtctccgcggcgaagatgtcggggcgcggcaagggcgggaagggcctgggcaagggcggacggaancaccggaaggtctccgcgacaacatccaggggatcacgaagccggcgatccg

SEQ ID NO: 2634 - DNA, 449 bp, Zea mays
  misc_feature: Ceres CLONE 276818-F
  misc_feature: Encodes the peptide sequence at SEQ ID NO. 2635
  misc_feature (278)..(278): n is a, c, t, g, unknown, or other
  misc_feature (300)..(300): n is a, c, t, g, unknown, or other
  misc_feature (307)..(307): n is a, c, t, g, unknown, or other
  misc_feature (319)..(319): n is a, c, t, g, unknown, or other
  misc_feature (366)..(366): n is a, c, t, g, unknown, or other
  misc_feature (398)..(398): n is a, c, t, g, unknown, or other
agaagcatcacacactaatcaacaaacaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtnagggccctttacgcggcggcgnacaccangcccgacagcangccacgtgccgtkcctcaaggcggcctacgttcacgtccacgctgtnctctccgcggcgcaggatcttcccggcgactncggcctctcgctttcctacaacatcacccccgacatcactkcgacaagatc

SEQ ID NO: 2635 - protein, 117 aa, Zea mays
  misc_feature: Ceres CLONE 276818-F
  misc_feature (68)..(68): Xaa is any aa, unknown, or other
  misc_feature (70)..(70): Xaa is any aa, unknown, or other
  misc_feature (74)..(74): Xaa is any aa, unknown, or other
  misc_feature (90)..(90): Xaa is any aa, unknown, or other
  misc_feature (114)..(114): Xaa is any aa, unknown, or other
MKTTSSGIAVVLLVAMLAVHSALADISCSDVLNDLSPCLPFLQGKAAKPSESNNQCCDGVRALYAAAXTXPDSXPRAVPQGGLRSRPRCXLRGAGSSRRLRPLAFLQHHPRHHXDKI

SEQ ID NO: 2636 - DNA, 144 bp, Zea mays
  misc_feature: Ceres CLONE 276825-F
  misc_feature (45)..(45): n is a, c, t, g, unknown, or other
  misc_feature (123)..(123): n is a, c, t, g, unknown, or other
aacaaaacacatcctaatcgactcgcgaccccgtttcccggaganccgcgacggtkcgacgccgaacttccctwacccttaattccctaagcgtaggcgcggggggcggcggtgcgaggcaanctgcacagcaacacgggccac

SEQ ID NO: 2637 - DNA, 241 bp, Zea mays
  misc_feature: Ceres CLONE 276833-F
  misc_feature (137)..(137): n is a, c, t, g, unknown, or other
  misc_feature (165)..(165): n is a, c, t, g, unknown, or other
  misc_feature (232)..(232): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcancgaagaagtcggtgtcgcggtcctccanggccgggctgcagttccccgtcagccgcgtcgggcgtacctcaaaaagggccggtacgcgcabgtanggcacgggt

SEQ ID NO: 2638 - DNA, 389 bp, Zea mays
  misc_feature: Ceres CLONE 276845-F
  misc_feature (230)..(230): n is a, c, t, g, unknown, or other
  misc_feature (240)..(240): n is a, c, t, g, unknown, or other
  misc_feature (377)..(377): n is a, c, t, g, unknown, or other
atacatttcgactctcaactcccaaggtccctttttttttctcgatctggaagcgccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcabgtanggcacgggtncccccgtctacctcgccgccgtcctggagtacctcgcggccgaggtgctcgagctcgccggcaacgcccaagggacaacaagaagacgcgcatcattccggcgccacgtgctcctcgccatccgcaacgacgagganctcggcaacctc

SEQ ID NO: 2639 - DNA, 179 bp, Zea mays
  misc_feature: Ceres CLONE 276847-F
  misc_feature: Encodes the peptide sequence at SEQ ID NO. 2640
atccaattcacaggctcaccacaccaaccaacaagcaaaaattccccaatcctctcgtctccgcggcgaagatgtcggggcgcggcaagggcggcaagggcctgggcaagggcggcgcgamstcatccggaaggtgcttgcgcgacaacatccaggggatcacgaagccggcgatccgg

SEQ ID NO: 2640 - protein, 36 aa, Zea mays
  misc_feature: Ceres CLONE 276847-F
  misc_feature (17)..(17): Xaa is any aa, unknown, or other
MSGRGKGGKGLGKGGAXSSGRCLRDNIQGITKPAIR

SEQ ID NO: 2641 - DNA, 276 bp, Zea mays
  misc_feature: Ceres CLONE 276850-F
  misc_feature (57)..(57): n is a, c, t, g, unknown, or other
  misc_feature (71)..(71): n is a, c, t, g, unknown, or other
  misc_feature (158)..(158): n is a, c, t, g, unknown, or other
  misc_feature (226)..(226): n is a, c, t, g, unknown, or other
  misc_feature (271)..(271): n is a, c, t, g, unknown, or other
attsactttccaagttgtccgaaaagaccagactaccctgttcccccgaagtcaganggggaawgagctanggatagagcagcgtcatcgcaccgctcgccggcgagccagatcatcagtgaggaaggcagcgatggcgggtggtggagctgtggganacgctgaagcaggcgatcgttgcgtacacgggcctgtctccggcggccttcttcacggctgtgcggtngcggccgctctgtaccacgttgtgtcggggctcttcgcggccccnccccc

SEQ ID NO: 2642 - DNA, 245 bp, Zea mays
  misc_feature: Ceres CLONE 276859-F
  misc_feature: Encodes the peptide sequence at SEQ ID NO. 2643
  misc_feature (57)..(57): n is a, c, t, g, unknown, or other
  misc_feature (195)..(195): n is a, c, t, g, unknown, or other
tbgccgcctcctccccactgcctcgtgtggccgtcgtctcccgttcggaacgccaancccccccctccggcgaaatggcccccaagcgaggtggcagggcgccggtgccggccaagaagaagacggataaagtgacgaaccctctattcgagaagagtccgaagcagttcggcatcggcggcgcgttgccscaanaaggacctgcaccggttcgtcaagtggcccaaggtcgtgcgtatccagcg

SEQ ID NO: 2643 - protein, 57 aa, Zea mays
  misc_feature: Ceres CLONE 276859-F
  misc_feature (41)..(41): Xaa is any aa, unknown, or other
MAPKRGGRAPVPAKKKTDKVTNPLFEKSPKQFGIGGALPQXGPAPVRQVAQGRAYPA

SEQ ID NO: 2644 - DNA, 661 bp, Zea mays
  misc_feature: Ceres CLONE 276902-R
cgattgggtaccgggccccccctcgaggtcgacggtatcgataagcttttttttttttttttttcgggtttacctccgtgcacggatctttttttatttttcttcatggtgacttacagaaggctgtacagccggcccacatggtatgccaagtgcactgctgagagtgttgcgctgccaactcctacaaagttcgtcgacgccgcagacacggggaattgcaggtccacacctaacgcgaaaagtccctcttaaacgacctctgacacgctgaactggtgggccagggggacacatccgactcattattcccgaacatactacttagataccgcgcgatcttcacttggccttcctcacccggggcttcatctcaataacatgtcgcttgatgcttccctctgtcttcgcaaacgactccttgctcctctctgggtcgactcaacctctctcttccaactctgctgggagaggatccccttcattgaaacatctgtagccaccggcttgctgctcacaatagcttgttgttccgccagaacatttcattgctgacagagacccgcccaatggcgctttccgccagctgccgctataacttcccctcgttgcgaacacctggtgctgacaggtcatggaccaccccccttactagtggtaa

SEQ ID NO: 2645 - DNA, 478 bp, Zea mays
  misc_feature: Ceres CLONE 276921-F
  misc_feature: Translation starting site: 77
atccaacccacacacaggctgaccccaccaacagcaagcgaaaatctcccgatcccctctagtctccgcggcgaagatgtcggggcgcggcaagggcgggaagggcctgggcaagggcggacggacgcaccggaaggtcttccgcgacaacatccaggggatcacgaagccggcgatccggcgctggcgcgcaggggcggcgtgaagcsatctccgggctcatctacgaggagacccgcggcgtcctcaagatcttcctggagaacgtgatccgcgacgccgtcacctacaccgaacacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaattgtggctgggtggcsaaaatwctggttactgtacc

SEQ ID NO: 2646 - DNA, 117 bp, Zea mays
  misc_feature: Ceres CLONE 276931-F
acacgcacaccgcgacccagtccagagccagtacgtgcgamrcacgcacgctgctgggtccgcgtacsagacgacggtcaggtcggccggtgcttttcagtttggaataatgacggc

SEQ ID NO: 2647 - DNA, 427 bp, Zea mays
  misc_feature: Ceres CLONE 276951-F
  misc_feature: Encodes the peptide sequence at SEQ ID NO. 2648
  misc_feature (293)..(293): n is a, c, t, g, unknown, or other
  misc_feature (341)..(341): n is a, c, t, g, unknown, or other
  misc_feature (357)..(357): n is a, c, t, g, unknown, or other
  misc_feature (368)..(368): n is a, c, t, g, unknown, or other
  misc_feature (374)..(374): n is a, c, t, g, unknown, or other
atccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaagtccaccgctggtgcctcccacccgccttacttcgagatgatcaaggaggctatcacggcgctcaaggagaggaccggctccagctcgcaagckatcgccaaktatttgggggacaancacggcgcgtctctgccggccaacttcaagaatatgctttccatccanctccgtgggtccgcanccaagggcaanctcgtnaaggtcaaggcttcgtacaagctctcggacgccgccaataaggcatcccccaa

SEQ ID NO: 2648 - protein, 111 aa, Zea mays
  misc_feature: Ceres CLONE 276951-F
  misc_feature (34)..(104): Pfam Name: Linker_histone Pfam Description: linker histone H1 and H5 family
  misc_feature (62)..(62): Xaa is any aa, unknown, or other
  misc_feature (67)..(67): Xaa is any aa, unknown, or other
  misc_feature (83)..(83): Xaa is any aa, unknown, or other
  misc_feature (89)..(89): Xaa is any aa, unknown, or other
  misc_feature (92)..(92): Xaa is any aa, unknown, or other
MPALAKPASRTAKPAAAPKPKPAAAKPKSTAGASHPPYFEMIKEAITALKERTGSSSQAIAXYLGDXHGASLPANFKNMLSIXLRGSAXKGXLVKVKASYKLSDAANKASP

SEQ ID NO: 2649 - DNA, 427 bp, Zea mays
  misc_feature: Ceres CLONE 276957-F
  misc_feature: Encodes the peptide sequence at SEQ ID NO. 2650
  misc_feature (221)..(221): n is a, c, t, g, unknown, or other
  misc_feature (299)..(299): n is a, c, t, g, unknown, or other
  misc_feature (359)..(359): n is a, c, t, g, unknown, or other
  misc_feature (414)..(414): n is a, c, t, g, unknown, or other
  misc_feature (425)..(425): n is a, c, t, g, unknown, or other
atccatcgagctgcccgcgcgcgcagttaaagctcacacatcagctagctcaccttggacggccgaccaggtacgttgcgagckatggcggatacaaagcgtcgggcggcacggcgctcggcgtcgtcctggctgttgccgcgctcctcgccgcggcggcattggcggtggacgacgagcacatgtaccactggaagtgcttcaactcgtgcacggggaantgccgcgacgaggacgcctttgacgacggccaccgttccggggattcgaacgtctcttccgtcgtctctggcggcaantgcaacaacaggtgcctcagcgagtgcttcgaggacctcccggccatctgctaccaccantgcgtcggtcagcaagtgcctctgcttcccaccctttagcaaagagaaaacgatntgcattaaganct

SEQ ID NO: 2650 - protein, 131 aa, Zea mays
  misc_feature: Ceres CLONE 276957-F
  misc_feature (28)..(28): Xaa is any aa, unknown, or other
  misc_feature (73)..(73): Xaa is any aa, unknown, or other
  misc_feature (99)..(99): Xaa is any aa, unknown, or other
  misc_feature (119)..(119): Xaa is any aa, unknown, or other
PSSCPRAQLKLTHQLAHLGRPTRYVASXGGYKASGGTALGVVLAVAALLAAAALAVDDEHMYHWKCFNSCTGXCRDEDAFDDGHRSGDSNVSSVVSGGXCNNRCLSECFEDLPAICYHXCVGQQVPLLPTL

SEQ ID NO: 2651 - DNA, 267 bp, Zea mays
  misc_feature: Ceres CLONE 276968-F
  misc_feature: Encodes the peptide sequence at SEQ ID NO. 2652
  misc_feature (92)..(92): n is a, c, t, g, unknown, or other
  misc_feature (126)..(126): n is a, c, t, g, unknown, or other
  misc_feature (227)..(227): n is a, c, t, g, unknown, or other
  misc_feature (241)..(241): n is a, c, t, g, unknown, or other
actcatacatttcgactctcaactcccaaggtcccttttttttctcgatctggaagcgccgcagtagcagccatggacgtgagcggacaggngggaaggcgaagaagggcgcggccgggcgcaagnhggcgggcgacgaagaagtcggtgtcgcggtcctccagggccgggctgcagttccccgtcagccgcgtcgggcgtacctcaaaaagggccggtacgcgcangttaggcacgggtncccccgtctacctcgccgccgtcctg

SEQ ID NO: 2652 - protein, 65 aa, Zea mays
  misc_feature: Ceres CLONE 276968-F
  misc_feature (7)..(7): Xaa is any aa, unknown, or other
  misc_feature (18)..(18): Xaa is any aa, unknown, or other
  misc_feature (19)..(19): Xaa is any aa, unknown, or other
  misc_feature (52)..(52): Xaa is any aa, unknown, or other
  misc_feature (57)..(57): Xaa is any aa, unknown, or other
MDVSGQXGRRRRARPGAXXRATKKSVSRSSRAGLQFPVSRVGRTSKRAGTRXLGTGXPVYLAAVL

SEQ ID NO: 2653 - DNA, 314 bp, Zea mays
  misc_feature: Ceres CLONE 276970-F
  misc_feature: Encodes the peptide sequence at SEQ ID NO. 2654
aaaacattttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgcacccggtttttgtgggcgtggcggccagctcgccgcccacgcbrccggatctcgcaaagaaggtgtccgagagcatcaagcaggcccaggagacgtgcgcagatgacccggtgagcggcgagtgcgtggcgacgtgggacgagg

SEQ ID NO: 2654 - protein, 87 aa, Zea mays
  misc_feature: Ceres CLONE 276970-F
  misc_feature (54)..(54): Xaa is any aa, unknown, or other
MAISVTAVAALSAFSAQRSLPQPYRQRVVTFIVVRPVRAHPVFVGVAASSPPTXPDLAKKVSESIKQAQETCADDPVSGECVATWDE

SEQ ID NO: 2655 - DNA, 161 bp, Zea mays
  misc_feature: Ceres CLONE 276981-F
  misc_feature (90)..(90): n is a, c, t, g, unknown, or other
atcacccaaaacacaagtagggttaggaaggcggcggccagcggcgagagcgcgagaggaggaggggtcggccatgacggggaaggcganskagaagcacacagcgaaggagatcgccgcgaagatcgacgcggcacgacgaaccggggcggcggcaaggc

SEQ ID NO: 2656 - DNA, 378 bp, Zea mays
  misc_feature: Ceres CLONE 276990-F2
  misc_feature (216)..(216): n is a, c, t, g, unknown, or other
  misc_feature (225)..(225): n is a, c, t, g, unknown, or other
  misc_feature (335)..(335): n is a, c, t, g, unknown, or other
  misc_feature (365)..(365): n is a, c, t, g, unknown, or other
gtttccccgccgccgcctccaagcgcccccgcgagccagctccggcgaagtcgacagcaccaagcatggcgacacgaaggcgtcacccgcggtgatccgcacgcgcaagttcatgaccaaccgcctcctctcccgcaagcagttcgtgctcgaggttctccaccccggccgcgccaacgtctctaaggcggactcaaggagaggctggctaagatntacgaggtnaaggatcccaactgcatcttcgtcttcaagttccgcacccacttcggaggcggcaattctaccggattcggtctcatctacgacaacgtcactcagccaagaagttcgancccaattacaggcttatcaggaacgtcttnctaccaaggtgga

SEQ ID NO: 2657 - DNA, 378 bp, Zea mays; identical to SEQ ID NO: 2656
  misc_feature: Ceres CLONE 276990-F
  misc_feature: Encodes the peptide sequence at SEQ ID NO. 2658
  misc_feature (216)..(216): n is a, c, t, g, unknown, or other
  misc_feature (225)..(225): n is a, c, t, g, unknown, or other
  misc_feature (335)..(335): n is a, c, t, g, unknown, or other
  misc_feature (365)..(365): n is a, c, t, g, unknown, or other

SEQ ID NO: 2658 - protein, 125 aa, Zea mays
  misc_feature: Ceres CLONE 276990-F
  misc_feature (72)..(72): Xaa is any aa, unknown, or other
  misc_feature (75)..(75): Xaa is any aa, unknown, or other
  misc_feature (112)..(112): Xaa is any aa, unknown, or other
  misc_feature (122)..(122): Xaa is any aa, unknown, or other
FPRRRLQAPPRASSGEVDSTKHGDTKASPAVIRTRKFMTNRLLSRKQFVLEVLHPGRANVSKADSRRGWLRXTRXRIPTASSSSSSAPTSEAAILPDSVSSTTTSLSQEVRXQLQAYQERLXTKV

SEQ ID NO: 2659 - DNA, 376 bp, Zea mays
  misc_feature: Ceres CLONE 277014-F
  misc_feature (182)..(182): n is a, c, t, g, unknown, or other
  misc_feature (186)..(186): n is a, c, t, g, unknown, or other
  misc_feature (187)..(187): n is a, c, t, g, unknown, or other
  misc_feature (320)..(320): n is a, c, t, g, unknown, or other
  misc_feature (344)..(344): n is a, c, t, g, unknown, or other
  misc_feature (362)..(362): n is a, c, t, g, unknown, or other
akaccgccgccgcccccagtccccgatccgaagctgtgcctcgtaccatttcgatccaatggcgccgacgtcgaagctgtcgacgggcatcaagcgcgcttcsgtcgcacacgtaccatcgccgtgggctgtgggccatcaaggccaagawcggcggcgcttccccaaggccgacaaggccncgcnnccgtggaacccaagttctaccctgccgacgacgtcaagccccgcgttcccagcacccgcaagcctaagcctaccaagctcaggtcgagcatcacgcctgggacggtgctgatcctcctcgcaggcgcttcatngggaagagagtggtgtttctcaancagctcaagtctagcctnctccttatctctgg

SEQ ID NO: 2660 - DNA, 221 bp, Zea mays
  misc_feature: Ceres CLONE 277017-F
atcagccatcagatcagatcaarsaagtccgcctccgcctccgcctccctaggggtttgctctcggctcgtcggatccagttcgggggatcctccatggcgtcgcgtcgcgtcgctgaagtcgaagcccaagggcaagggcgggaagaagggccaccgctgacgacgaggacgccaccgcggcggcgaccacggtgaggctcatgaaggagtggaccacgt

SEQ ID NO: 2661 - DNA, 220 bp, Zea mays
  misc_feature: Ceres CLONE 277041-F
  misc_feature: SWISSPROT Homolog: EC 3.6.3.14 H(+)-transporting two-sector ATPase
agatcagaaccaaactcggctcgagagagatcgcatacgcctgcctgcccacccacctccccttttccttcctcttcgccccagcgacgcgtccgcccggwgaccgagcgaggcaggcaactaaccaccgagaggcagggacaggaacaggaagccggavaagatgtcgtcggtgttcagcggcgatgagacggcccccttcttcggcttcctcggcgcc

SEQ ID NO: 2662 - DNA, 415 bp, Zea mays
  misc_feature: Ceres CLONE 277045-F
  misc_feature: Encodes the peptide sequence at SEQ ID NO. 2663
  misc_feature (221)..(221): n is a, c, t, g, unknown, or other
  misc_feature (344)..(344): n is a, c, t, g, unknown, or other
  misc_feature (363)..(363): n is a, c, t, g, unknown, or other
  misc_feature (410)..(410): n is a, c, t, g, unknown, or other
aktttagttggtgctggtgctggtggaggaagaagcagcgcmsagggttggcagggatgggtcgcggcggcgggatggggaaccagttcaacgtgggcatcgcggtgcaggcggactgggagaaccgcgagttcatctccaacatctccctcaacgtccgacgcctcttcgacttcctcctcagattcgaagctacgacgaagagcaagctggcaagtttnaacgagaagctggacatcctagagcggaastggaggtgcttaaagtccaagtgggcagcgcgacgaccaacccttccgtcttcaactaggaatcgcgggtttatatgtttaaataaataaatntaggtatgaatkttgcttntaccaacgaattctggtcgctatcaatcatgtaatgtaatgtaatgnatttt

SEQ ID NO: 2663 - protein, 94 aa, Zea mays
  misc_feature: Ceres CLONE 277045-F
  misc_feature (55)..(55): Xaa is any aa, unknown, or other
  misc_feature (65)..(65): Xaa is any aa, unknown, or other
MGRGGGMGNQFNVGIAVQADWENREFISNISLNVRRLFDFLLRFEATTKSKLASXNEKLDILERXWRCLKSKWAARRPTLPSSTRNRGFICLNK

SEQ ID NO: 2664 - DNA, 191 bp, Zea mays
  misc_feature: Ceres CLONE 277055-F
  misc_feature (141)..(141): n is a, c, t, g, unknown, or other
acatatccgttgtggcagcagccttcgtgcaggcatggcgagctcatcttgtgcactgctgggtctggcctgcttcgtgctcctggcggcggcagscgccacgcatacaaggtcggcggcgacaatggctgggccgtcggnacgccaccgccgagtcgttcaacacctgggcgggagaagaccagcttcca

SEQ ID NO: 2665 - DNA, 129 bp, Zea mays
  misc_feature: Ceres CLONE 277081-F
  misc_feature: Encodes the peptide sequence at SEQ ID NO. 2666
  misc_feature (51)..(51): n is a, c, t, g, unknown, or other
  misc_feature (96)..(96): n is a, c, t, g, unknown, or other
agaacgatctcaatctccctagcaatctctagcagcagatcctcgtgcganaagcgctasccccttcgtactgtcccgattgcccgcacgaagcanabggcgaggaagtccactggcggcaagcgccaa

SEQ ID NO: 2666 - protein, 43 aa, Zea mays
  misc_feature: Ceres CLONE 277081-F
  misc_feature (17)..(17): Xaa is any aa, unknown, or other
  misc_feature (20)..(20): Xaa is any aa, unknown, or other
  misc_feature (32)..(32): Xaa is any aa, unknown, or other
  misc_feature (33)..(33): Xaa is any aa, unknown, or other
RTISISLAISSSRSSCXKRXPLRTVPIARTKXXARKSTGGKRQ

SEQ ID NO: 2667 - DNA, 476 bp, Zea mays
  misc_feature: Ceres CLONE 277113-F
  misc_feature: Encodes the peptide sequence at SEQ ID NO. 2668
  misc_feature (122)..(122): n is a, c, t, g, unknown, or other
  misc_feature (310)..(310): n is a, c, t, g, unknown, or other
  misc_feature (350)..(350): n is a, c, t, g, unknown, or other
  misc_feature (446)..(446): n is a, c, t, g, unknown, or other
ctaacgctctccgccgccacttctcctccggcatcgacgaggcgasscagcgcccgagtccctctccctgctcccacgacccatggcggcggatatggcgtacgcgccgccgatgaaggcgngcaaggccgggttcgaggctggcatgatggatccgcagcacaggatccgcatcacgctctcctccaagagcgtcaagaacctcgagaaagtctgcggggatctggtgaagggcgccaagggtaaggagctcaaggtcaatggccccgtgcggatgcctaccaaggtgctccacatcaccaccaggaantctccctgtggagaaggtaccaacacctgggatcgctttnagatgaggattcacaagagggtgatcgatctcgtcagtacaccagacgttttcaagcagatcacctcgatcactatttaaccaggtgtcgaggttnaggtgactatcagtgacgcttaatatggta

SEQ ID NO: 2668 - protein, 115 aa, Zea mays
  misc_feature: Ceres CLONE 277113-F
  misc_feature (28)..(115): Pfam Name: Ribosomal_S10 Pfam Description: Ribosomal protein S10p/S20e
  misc_feature (14)..(14): Xaa is any aa, unknown, or other
  misc_feature (76)..(76): Xaa is any aa, unknown, or other
  misc_feature (90)..(90): Xaa is any aa, unknown, or other
MAADMAYAPPMKAXKAGFEAGMMDPQHRIRITLSSKSVKNLEKVCGDLVKGAKGKELKVNGPVRMPTKVLHITTRXSPCGEGTNTWDRFXMRIHKRVIDLVSTPDVFKQITSITI

SEQ ID NO: 2669 - DNA, 483 bp, Zea mays
  misc_feature: Ceres CLONE 277115-F
  misc_feature: Encodes the peptide sequence at SEQ ID NO. 2670
  misc_feature (413)..(413): n is a, c, t, g, unknown, or other
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacagcaggccacgtgccggttgcctcaaggcggcctacgttcaggtccacgctgtgctctccgcggcgcaggagctgcccggcgactgcggcctctcgctntcctacaacatcacccccgacatcgactgcgacaagatcgaattaagggatactgttcccttaccagaat

SEQ ID NO: 2670 - protein, 128 aa, Zea mays
  misc_feature: Ceres CLONE 277115-F
  misc_feature (28)..(115): Pfam Name: Tryp_alpha_amyl Pfam Description: Protease inhibitor/seed storage/LTP family
MKTTSSGIAVVLLVAMLAVHSALADISCSDVLNDLSPCLPFLQGKAAKPSESNNQCCDGVRALYAAADTRPDSRPRAGCLKAAYVQVHAVLSAAQELPGDCGLSLSYNITPDIDCDKIELRDTVPLPE

SEQ ID NO: 2671 - DNA, 198 bp, Zea mays; identical to SEQ ID NO: 767
  misc_feature: Ceres CLONE 277116-F
  misc_feature: Encodes the peptide sequence at SEQ ID NO. 2672
  misc_feature (139)..(139): n is a, c, t, g, unknown, or other

SEQ ID NO: 2672 - protein, 66 aa, Zea mays; identical to SEQ ID NO: 768
  misc_feature: Ceres CLONE 277116-F
  misc_feature (30)..(30): Xaa is any aa, unknown, or other
  misc_feature (47)..(47): Xaa is any aa, unknown, or other

SEQ ID NO: 2673 - DNA, 485 bp, Zea mays
  misc_feature: Ceres CLONE 277117-F
  misc_feature: Translation starting site: 179
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaacgttgtaggctgctcctgtgtcgtcgtcaaggactacggtgaagaatctgagggccttaacatagt

SEQ ID NO: 2674 - DNA, 260 bp, Zea mays
  misc_feature: Ceres CLONE 277175-F
  misc_feature: Encodes the peptide sequence at SEQ ID NO. 2675
  misc_feature (163)..(163): n is a, c, t, g, unknown, or other
  misc_feature (211)..(211): n is a, c, t, g, unknown, or other
  misc_feature (235)..(235): n is a, c, t, g, unknown, or other
ctccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaagcactttacggccccgtcctccgtccgncgcgttctcatgtccgccgggctgtcgacggagctccgccacaagtanaacgtgcgctccatcccgatccgnaagacgacgaggtgcaggtcgtgcg

SEQ ID NO: 2675 - protein, 57 aa, Zea mays
  misc_feature: Ceres CLONE 277175-F
  misc_feature (41)..(41): Xaa is any aa, unknown, or other
MKRNPRVTSSRRKCRKHFTAPSSVRRVLMSAGLSTELRHKXNVRSIPIRKTTRCRSC

SEQ ID NO: 2676 - DNA, 174 bp, Zea mays
  misc_feature: Ceres CLONE 277188-F
  misc_feature: Encodes the peptide sequence at SEQ ID NO. 2677
acctgttctccaccagccccggagtcgacacgtgcgccacaccatagggcagggccagggagcccggcgacttccatctccatggccgagtgcgaggagctggtggagagcggcggcgccgaggaggacatgccccgcgtcgtggccgccctcgccggcatcctggagcgcgtc

SEQ ID NO: 2677 - protein, 31 aa, Zea mays
  misc_feature: Ceres CLONE 277188-F
MAECEELVESGGAEEDMPRVVAALAGILERV

SEQ ID NO: 2678 - DNA, 220 bp, Zea mays
  misc_feature: Ceres CLONE 277219-F
  misc_feature: Encodes the peptide sequence at SEQ ID NO. 2679
  misc_feature (37)..(37): n is a, c, t, g, unknown, or other
  misc_feature (202)..(202): n is a, c, t, g, unknown, or other
  misc_feature (209)..(209): n is a, c, t, g, unknown, or other
  misc_feature (211)..(211): n is a, c, t, g, unknown, or other
aagcacaagcacaaccaaaagcaaagaagagacgaanttcgatcgatctcagcaactaagcaggtaggtaggcatgghggccgagaaggagggcgcggtggtgaccaagggccacgacgaggggatgaaggcggcggcggcgctgctggaggagttcgggctcccgccggggctgctgccgctggaggacgtgacggaggtngggttcntncgggccacc

SEQ ID NO: 2679 - protein, 49 aa, Zea mays
  misc_feature: Ceres CLONE 277219-F
  misc_feature (2)..(2): Xaa is any aa, unknown, or other
  misc_feature (46)..(46): Xaa is any aa, unknown, or other
MXAEKEGAVVTKGHDEGMKAAAALLEEFGLPPGLLPLEDVTEVGFXRAT

SEQ ID NO: 2680 - DNA, 483 bp, Zea mays
  misc_feature: Ceres CLONE 277237-F
  misc_feature: Encodes the peptide sequence at SEQ ID NO. 2681
  misc_feature (218)..(218): n is a, c, t, g, unknown, or other
  misc_feature (244)..(244): n is a, c, t, g, unknown, or other
  misc_feature (458)..(458): n is a, c, t, g, unknown, or other
atcacaagcaaaagcaacaaggcagcagcacaagcaagaaccacacctcctcccttcgcctgtgatcatgtcgtcttgctgcggcggcaagtgcgggtgcggctccagctgctcctgcggcasggatgcaacggctgcggtatgtaccctgacgtggagaccgccgccaccagcagcgtcaagaccacggtcctcgccgcgccgaccaccaaggccancccggcgcttcgaggcggccaccganggcggcggctgcgactgcaacacctgcaagtkcggcaccagctgcggctgctcctgctgcagctgcaactgagctggcccggcccggcgattgcgcacgagaktcgagatgaggaggacgacgacgaggcgtataaatataatagcggcgtccagtaaataagatccctgtcaacttcacccgccattatccatggtcgctcgctcctcgcctncgtctcctggtcctggggttcgtct

SEQ ID NO: 2681 - protein, 82 aa, Zea mays
  misc_feature: Ceres CLONE 277237-F
  misc_feature (1)..(81): Pfam Name: Metallothio_2 Pfam Description: Metallothionein
  misc_feature (19)..(19): Xaa is any aa, unknown, or other
  misc_feature (51)..(51): Xaa is any aa, unknown, or other
  misc_feature (59)..(59): Xaa is any aa, unknown, or other
  misc_feature (70)..(70): Xaa is any aa, unknown, or other
MSSCCGGKCGCGSSCSCGXDATAAVCTLTWRPPPPAASRPRSSPRRPPRPXRRFEAATXGGGCDCNTCKXGTSCGCSCCSCN

SEQ ID NO: 2682 - DNA, 228 bp, Zea mays
  misc_feature: Ceres CLONE 277240-F
  misc_feature: Encodes the peptide sequence at SEQ ID NO. 2683
  misc_feature (138)..(138): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggccaaggccgtcgggcgancgaagaagtcggtgtcgcggtcctccagggccgggctgcagttccccgtcagccgcgtcgggcgtgacctcaaaaagggccggtacgcgc

SEQ ID NO: 2683 - protein, 43 aa, Zea mays
  misc_feature: Ceres CLONE 277240-F
  misc_feature (6)..(6): Xaa is any aa, unknown, or other
  misc_feature (22)..(22): Xaa is any aa, unknown, or other
MDVSGXAVRRRRARRGQGRRAXEEVGVAVLQGRAAVPRQPRRA

SEQ ID NO: 2684 - DNA, 438 bp, Zea mays
  misc_feature: Ceres CLONE 277258-F
  misc_feature: Translation starting site: 70
  misc_feature (198)..(198): n is a, c, t, g, unknown, or other
  misc_feature (346)..(346): n is a, c, t, g, unknown, or other
  misc_feature (355)..(355): n is a, c, t, g, unknown, or other
  misc_feature (389)..(389): n is a, c, t, g, unknown, or other
  misc_feature (393)..(393): n is a, c, t, g, unknown, or other
  misc_feature (403)..(403): n is a, c, t, g, unknown, or other
acagcatctcaagccaccatcgaccttcaagtctcgctacgtagcagtgcaataaaaaaagcagccgcaatggcgagcagcaccatggccctctcctccacggctttcgcsgcaagscgtgaacgtgccgtcgtcgtccgccttcgsaaggcccgcgtgacgatgcgcaagayggcggcgaaggccaagccagcgggncgtccgggagcccgtggtacgccccgaccgcgtgctgtacctgggcccactgtccggcgagccaccgagctacctgacgggcgakttcccgggcgactacggctgggacaccgcggggctgtcggcggacccggagacgttcgccaanaaccggganctggaggtgatccactcccgctgggcccatcctnggcncgctcggctncgtcttccccgagctgctcgcccgcaacggcgtca

SEQ ID NO: 2685 - DNA, 499 bp, Zea mays
  misc_feature: Ceres CLONE 277283-F
  misc_feature: Encodes the peptide sequence at SEQ ID NO. 2686
aacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcactcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagc

SEQ ID NO: 2686 - protein, 124 aa, Zea mays
  misc_feature: Ceres CLONE 277283-F
MRECISIHIGQAGIQVGNACWELYCLEHGTQADGQMPGDKTIGGGDDAFNTFFSETGAGKHVPRAVFVDLEPTVIDEVRTGTYRQLFHPEQLISGKEDAANNFARGHYTIGKEIVDLCLDRIRK

SEQ ID NO: 2687 - DNA, 493 bp, Zea mays
  misc_feature: Ceres CLONE 277300-F
  misc_feature: Encodes the peptide sequence at SEQ ID NO. 2688
  misc_feature (195)..(195): n is a, c, t, g, unknown, or other
acctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctctccatcacccacctcgtgtacgtctc

SEQ ID NO: 2688 - protein, 98 aa, Zea mays
  misc_feature: Ceres CLONE 277300-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRWRRRRPCRASARGAARSLHHPPRVRL

SEQ ID NO: 2689 - DNA, 166 bp, Zea mays
  misc_feature: Ceres CLONE 277364-F
atcgcagtcgcaacgaagcccccccacacacaaaaaagcaaaagcatcatcacaataatggcccgcgcgtgcgtgttcctcgtggtgctcctcctggccgccgtcgcgtgggccgtttgcgggggctgcgcgcgtggatgtcgtggagggcaggtccatggcgtcc

SEQ ID NO: 2690 - DNA, 134 bp, Zea mays
  misc_feature: Ceres CLONE 277379-F
acacgcacaccgcgacccagtccagagccagtacgtgcgaagtagcacgcacgctgctggtccgcgtacsagacgacggtcaggtcggccggtgcttttcagtttggaataatgacggcgacgacgacgacagc

SEQ ID NO: 2691 - DNA, 399 bp, Zea mays
  misc_feature: Ceres CLONE 277476-F
  misc_feature (110)..(110): n is a, c, t, g, unknown, or other
  misc_feature (294)..(294): n is a, c, t, g, unknown, or other
  misc_feature (324)..(324): n is a, c, t, g, unknown, or other
  misc_feature (374)..(374): n is a, c, t, g, unknown, or other
aaccccaccacaacccagcgccggcagtcgcstcatcgatcgatcgccggaaaactaacccctaacgatgtctggagccggcgaggaggacaagaagcccgcggaggggncgccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcmgttcgcggcgagcagacccctgatgagctgganatggatgacggcgacgagatcgacgccatncttcaccagaccggagcagcgttcctagcaccacctaaaagcctcgtttnctctccgtcctgcgtagtactaaac

SEQ ID NO: 2692 - DNA, 397 bp, Zea mays
  misc_feature: Ceres CLONE 277489-F
  misc_feature: Encodes the peptide sequence at SEQ ID NO. 2693
  misc_feature (251)..(251): n is a, c, t, g, unknown, or other
  misc_feature (289)..(289): n is a, c, t, g, unknown, or other
  misc_feature (345)..(345): n is a, c, t, g, unknown, or other
atataatttgtstctcgtgcctcgttgcgtctttgtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctasttgcgtaasaatcaagaagatggaggtatctcagcactccaagtacttctgcgagttttgtgggaagtttcctgtnaagaggaaagcagttggaatttggggatccaaggactntgggaaggtcaaggctggcggtgcttacaccatgaacactgctagtgcagtcactntcaggagcacgattcgtcgcttgagagagcagactgaagcatgatttagctt

SEQ ID NO: 2693 - protein, 91 aa, Zea mays
  misc_feature: Ceres CLONE 277489-F
  misc_feature (2)..(90): Pfam Name: Ribosomal_L37ae Pfam Description: Ribosomal L37ae protein family
  misc_feature (21)..(21): Xaa is any aa, unknown, or other
  misc_feature (24)..(24): Xaa is any aa, unknown, or other
  misc_feature (59)..(59): Xaa is any aa, unknown, or other
  misc_feature (78)..(78): Xaa is any aa, unknown, or other
MTKRTKKAGIVGKYGTRYGAXCVXIKKMEVSQHSKYFCEFCGKFPVKRKAVGIWGSKDXGKVKAGGAYTMNTASAVTXRSTIRRLREQTEA

SEQ ID NO: 2694 - DNA, 123 bp, Zea mays
  misc_feature: Ceres CLONE 277498-F
artagaaatcgaccgagcgaatccctcgcatcgcattcgcagcctttgctgattcacaccaccgcgaaaccccagcagccgcatcgatggcgcctaagggagaagaagccggctgcgaagaag

SEQ ID NO: 2695 - DNA, 429 bp, Zea mays
  misc_feature: Ceres CLONE 277508-F
  misc_feature: Translation starting site: 324
  misc_feature (268)..(268): n is a, c, t, g, unknown, or other
  misc_feature (305)..(305): n is a, c, t, g, unknown, or other
  misc_feature (365)..(365): n is a, c, t, g, unknown, or other
atccagtcgcatctccctctccgaaatcaaggtagcgtacaccgctgcagtttctagagccctctctgccactcgtgatcccactagtcacaatgcctgcyctcgccaagcccgcctcccgcaccgccaagcccgccgcggctccgaagccgaagcctgccgccgccaagccgargccaccgctggtgcctcccacccgccttacttcgagatgatcaaggaggctatcacggcgctcaaggagaggaccggctccagctcgcaagcnatcgccaagtattgggggacaacacggcgcgtctctnccggccaacttcaagaagatgctttccatccagctccgtgggtccgcagccaagggcaanctcktgaaggtcaaggcttcgtacaagctctcggacgccgccaataaggcatcccccaagacca

SEQ ID NO: 2696 - DNA, 220 bp, Zea mays
  misc_feature: Ceres CLONE 277532-F
  misc_feature: Encodes the peptide sequence at SEQ ID NO. 2697
  misc_feature (44)..(44): n is a, c, t, g, unknown, or other
  misc_feature (141)..(141): n is a, c, t, g, unknown, or other
aacgctctccgccgccacttctcctccggcatcgacgaggcganscagcgcccgagtccctctccctgctcccacgacccatggcggcggatatggcgtacacgcccgatgaagggcaaggccgggttcgaggctggcatnatggatccgcagcacaggatccgcatcacgctctcctccaagagcgtcaagaacctcgagaaagtctgcggggatctgg

SEQ ID NO: 2697 - protein, 37 aa, Zea mays
  misc_feature: Ceres CLONE 277532-F
  misc_feature (11)..(11): Xaa is any aa, unknown, or other
MKGKAGFEAGXMDPQHRIRITLSSKSVKNLEKVCGDL

SEQ ID NO: 2698 - DNA, 465 bp, Zea mays
  misc_feature: Ceres CLONE 277546-F
  misc_feature: Pfam Name: Ribosomal_L6e Pfam Description: Ribosomal protein L6e
  misc_feature (187)..(187): n is a, c, t, g, unknown, or other
  misc_feature (333)..(333): n is a, c, t, g, unknown, or other
  misc_feature (420)..(420): n is a, c, t, g, unknown, or other
atttttcgaccgccgccgcccccagtccccgatccgaagctgtgcctcgtaccatttcgatccaatggcgccgacgtcgaagctgtcgacgggcatcaagcgcgcttcsstcgcacacgtaccatcgccgtgggctgtgggccatcaaggcaagaacggcggcgcttccccaaggccgacaaggccncgccgccgtggaacccaagttctaccctgccgacgacgtcaagccccgcgtttcccagcaccctcaagcctaagcctaccaagctcaggtcgagcatcacgcctgggacggtgctgatcctcctcgcagggcgcttcatggggaanagagtggtktttctcaagcagctcaagtctggcctgctccttatctctgggcctttcaagatcaatggagtaccgatccgccgtgtnaaccagacctatgtcattgctacatcaaccaaagttgacatctct

SEQ ID NO: 2699 - DNA, 236 bp, Zea mays
  misc_feature: Ceres CLONE 277561-F
  misc_feature (107)..(107): n is a, c, t, g, unknown, or other
acaacaccagaatccgcgaatcacagacgcgtctatctcagcttgctgcactgcactaccctgccctgccatcatatcgtacgtgagcccggccgagcgagavsggnagaggcatggctgctccgaagctcgcgacgctggcgctggccgtgctcctggcggcgaccgtggtggctcccccggccgcggtgcgcgcgsattgtcgtgctccaccgtgtacagcacgctgatgccgt

SEQ ID NO: 2700 - DNA, 219 bp, Zea mays
  misc_feature: Ceres CLONE 277585-F
gaccgcagcaatccgccgcccttggccgtgcccgtgctgccgtactcgtaatccgtgaggaaagcgtccgcgctccgggccccgcgccgatagttccttcaagggagcgacgacgcgcgtcgatggagacggtggaggaggacgtggaggagtacagctggcgggaggtggtgctgccgcactcgtccccgtggttcccggcgcgcaaccggagctcga

SEQ ID NO: 2701 - DNA, 395 bp, Zea mays
  misc_feature: Ceres CLONE 277593-F
  misc_feature (248)..(248): n is a, c, t, g, unknown, or other
  misc_feature (251)..(251): n is a, c, t, g, unknown, or other
  misc_feature (328)..(328): n is a, c, t, g, unknown, or other
  misc_feature (372)..(372): n is a, c, t, g, unknown, or other
atcaactcgcaattccgcattcgttccaactcctgagcactttctcctcgtccccgacaagccaatcgaagccgagatacggccatggactccaccggcaccgagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcangtncggcaccggcgcccccgtctacctcgccgctgtcctcgaatacctcgccgctgaggttctggagctcgctggtaatnctcccagggacaacaagaagactcgcattattccgcgccacgtncttctggcgatccggaacgacga

SEQ ID NO: 2702 - DNA, 130 bp, Zea mays
  misc_feature: Ceres CLONE 277608-F
  misc_feature (52)..(52): n is a, c, t, g, unknown, or other
acacgcacaccgsdacccaktccagagccagtacgtgcgacaggcacgcacnctgctggtccgcgtacsagacggacggtcaggtcggccggtgcttttsagtttggaataatgacggcgacgacgacga

SEQ ID NO: 2703 - DNA, 203 bp, Zea mays
  misc_feature: Ceres CLONE 277609-F
  misc_feature (55)..(55): n is a, c, t, g, unknown, or other
  misc_feature (163)..(163): n is a, c, t, g, unknown, or other
  misc_feature (196)..(196): n is a, c, t, g, unknown, or other
ttcgcaaacbctcctaccccattccgccgcccgccccgcgaccccgaggaggaangcaagatgaagacgatcctggcgtcggagmwatggacatcccggagcgtcacagtgacgktggcggcaagctggtgacggtggagggcccccgcggaagctcacccgnaacttcaagcacctcaacctcgacttccagctncaggagg

SEQ ID NO: 2704 - DNA, 167 bp, Zea mays
  misc_feature: Ceres CLONE 277611-F
  misc_feature (105)..(105): n is a, c, t, g, unknown, or other
  misc_feature (135)..(135): n is a, c, t, g, unknown, or other
agcaacagccaacatatctcctcgcattttccttgcaaccgattgcbtatccccctcccaacccaagaccgatggcgcccaaggccgagaagaagcccgcggcanagaagccggcggaggaggagcccgyggcgnagaagacgaccgccgggtaagaakcccaaggc

SEQ ID NO: 2705 - DNA, 109 bp, Zea mays
  misc_feature: Ceres CLONE 277643-F
acgcacaccgcgacccagtccagagccagtacgtgcgamggcacgcacgctgctggtccgcgtacsagacgacggtcaggtcggccggtgcttttcagtttggaataat

SEQ ID NO: 2706 - DNA, 117 bp, Zea mays; identical to SEQ ID NO: 2403
  misc_feature: Ceres CLONE 277653-F

SEQ ID NO: 2707 - DNA, 429 bp, Zea mays
  misc_feature: Ceres CLONE 277654-F
  misc_feature: Translation starting site: 84
  misc_feature (50)..(50): n is a, c, t, g, unknown, or other
  misc_feature (107)..(107): n is a, c, t, g, unknown, or other
  misc_feature (119)..(119): n is a, c, t, g, unknown, or other
  misc_feature (168)..(168): n is a, c, t, g, unknown, or other
  misc_feature (171)..(171): n is a, c, t, g, unknown, or other
  misc_feature (221)..(221): n is a, c, t, g, unknown, or other
  misc_feature (229)..(229): n is a, c, t, g, unknown, or other
  misc_feature (239)..(239): n is a, c, t, g, unknown, or other
  misc_feature (260)..(260): n is a, c, t, g, unknown, or other
  misc_feature (282)..(282): n is a, c, t, g, unknown, or other
  misc_feature (324)..(324): n is a, c, t, g, unknown, or other
  misc_feature (338)..(338): n is a, c, t, g, unknown, or other
  misc_feature (381)..(381): n is a, c, t, g, unknown, or other
ctgaagtttcggcggcggcgtaggtagcggcggtctcaaccccaggcganctcggctccggtcacccgtcgatccacgcaaccatgtcgaggaggaagaccagggancccaatgagganaacgttacccttggacccactgtccgtgaaggagagtttktstttggtnttnctcacatctttacatccttcaatgacaccttcattcatgtcactgatttntctggganggaaactttngttcggatcactggtggcatnaaggttaaggctgatcgtgatnagtcgtctccttatgctgctatgcttgckgctcaagatgttncacagcgttgcaangagctcggtatcaccgcgctgcacattaagcttcgtgcaactngaggcaacaagabcaagacccctggacctggtgctcagtctgctctca

SEQ ID NO: 2708 - DNA, 440 bp, Zea mays
  misc_feature: Ceres CLONE 277661-F
  misc_feature: Encodes the peptide sequence at SEQ ID NO. 2709
atgaaacggaccattgaatgtgctcaaggcttctttcctccagaatcccccatctgagcaagggcgccgtcggctagcgccgcagcattgacgtggacgccgaccctctccggcagccgcttgcwgcgcgtcccttccccgctcccgcgcatggactgcgcaaagaggagggcggtggcggacctccacaacgagctgatggtggagatcttctcgcgcgtgcccgtcaaagacctccgccgttgcacgtgcgtgtgcaaatcttggtgcaacatcatcaccgaccccctcaacggcaagaagctgccccagaccctggaaggcttcttccaaggcgtcgtcggagggcctcacagctacggccaattcaccagcctgtcggggagcggagaacgcgtgcctccggtcgacccttccttctccttcatcacggcagtctg

SEQ ID NO: 2709 - protein, 96 aa, Zea mays
  misc_feature: Ceres CLONE 277661-F
  misc_feature (7)..(54): Pfam Name: F-box Pfam Description: F-box domain
MDCAKRRAVADLHNELMVEIFSRVPVKDLRRCTCVCKSWCNIITDPLNGKKLPQTLEGFFQGVVGGPHSYGQFTSLSGSGERVPPVDPSFSFITAV

SEQ ID NO: 2710 - DNA, 132 bp, Zea mays
  misc_feature: Ceres CLONE 277665-F
acacgcacaccgcgacccagtccagagccagtacgtgcgamgccacgcacgctgctggtccgcgtacsagacgacggtcaggtcggccggtgcttttcagtttggaataatgacggcgacgacgacgacagc

SEQ ID NO: 2711 - DNA, 255 bp, Zea mays
  misc_feature: Ceres CLONE 277669-F
  misc_feature (19)..(19): n is a, c, t, g, unknown, or other
  misc_feature (164)..(164): n is a, c, t, g, unknown, or other
aaccgagacaccgcgtgcnaaccaagcagaccacagcaagaagcgtagtcgtcgccggaaggaaaggcgcggasaagatgtcgtggcaggcgtacgtcgatgagcacctgatgtgcgagatcgaaggacaacatctcagcgccgccgccatcgtcggtcacgvncaagckcttgggcgcagtccgagagcttccccgagttaaagcctgaggaggttkctggtatcataaaggactttgatgaacctggtactct

SEQ ID NO: 2712 - DNA, 446 bp, Zea mays
  misc_feature: Ceres CLONE 277677-F
  misc_feature: Encodes the peptide sequence at SEQ ID NO. 2713
  misc_feature (307)..(307): n is a, c, t, g, unknown, or other
  misc_feature (309)..(309): n is a, c, t, g, unknown, or other
  misc_feature (354)..(354): n is a, c, t, g, unknown, or other
atcgactcccagatctctatccccctctgccctgtcctcactctctcgagcgcgttgtggcggatgtcctcgtcggcgcgtttcgatctccgggcctcgtcgcatcagttgcagccgccgccgtcgcacgccagcatgagcagcgacgggggcgcgttcgcaaacgcgagaacctggagcactgcgcccggtacctgaaccagacgctcgtcaccttcggattcccggcatctctcgacctcttcgccaccgatccggtctcgattgcaagaacttgtaactgcatctatgcgctgctgcagcasancnagagggacattgagttcagggagtctacaaatgaccagcggcasngatgcaatctgatatctcacggctggaactaagatagagagaatggatgctcaattagcagcgaaagatcggagagctagccactcttactc

SEQ ID NO: 2713 - protein, 127 aa, Zea mays
  misc_feature: Ceres CLONE 277677-F
  misc_feature (101)..(101): Xaa is any aa, unknown, or other
  misc_feature (102)..(102): Xaa is any aa, unknown, or other
  misc_feature (103)..(103): Xaa is any aa, unknown, or other
  misc_feature (117)..(117): Xaa is any aa, unknown, or other
  misc_feature (118)..(118): Xaa is any aa, unknown, or other
RLPDLYPPLPCPHSLERVVADVLVGAFRSPGLVASVAAAAVARQHEQRRGRVRKRENLEHCARYLNQTLVTFGFPASLDLFATDPVSIARTCNCIYALLQXXXRDIEFRESTNDQRXXCNLISHGWN

SEQ ID NO: 2714 - DNA, 262 bp, Zea mays
  misc_feature: Ceres CLONE 277681-F
  misc_feature (126)..(126): n is a, c, t, g, unknown, or other
gcagccgcaaccaggcaagcaagcgggasccgccaactcgtgcctctcggcagcggcgtctgaactctgaaccgaccgaccgaccgaccgttccgttccgttcaccccaccatggaggcgccgcgngaccggggcccatggagctggacgccccacctcccgccgccgccgccgcgattttcctcccgccggcagckacaagcacaaggacggggaagggggatacgctktgacgggccatatcatctccaccaccatcggc

SEQ ID NO: 2715 - DNA, 492 bp, Zea mays
  misc_feature: Ceres CLONE 277698-F
  misc_feature: Encodes the peptide sequence at SEQ ID NO. 2716
agaagcatcacacactaatcaacaagcaggaccagctagctagctcctctcactgctatcacccgcccagccatctcgctgaaagagaaaagcgcmscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttccttaccagaatccatacgacg

SEQ ID NO: 2716 - protein, 119 aa, Zea mays; identical to SEQ ID NO: 566
  misc_feature: Ceres CLONE 277698-F
  misc_feature (28)..(115): Pfam Name: Tryp_alpha_amyl Pfam Description: Protease inhibitor/seed storage/LTP family

SEQ ID NO: 2717 - DNA, 368 bp, Zea mays
  misc_feature: Ceres CLONE 277734-F
  misc_feature: Encodes the peptide sequence at SEQ ID NO. 2718
  misc_feature (99)..(99): n is a, c, t, g, unknown, or other
aaaattaccaaaccctaccccttcgccgcgaccgcgatcccccacatcgttggcgatgagctcctcctccaacagcgggaagaagccggcgcccgcbknccgcggggggcccaccatccgcacgctcgccgacataaaccgtggccctgccggtttcccaggtgccggasgcagcagcgatgacgacgagccccaggagtactacaccggcggcgagaagagtggaatgcttgttcaagatccaacaagaagaaatgacgtggatgcaatatttgaacaagcaagacaggcgggcgctatccatggaatgcccccttttctggtggcgagtcttccagctctaggagctttactgggactggccgact

SEQ ID NO: 2718 - protein, 104 aa, Zea mays
  misc_feature: Ceres CLONE 277734-F
  misc_feature (15)..(15): Xaa is any aa, unknown, or other
  misc_feature (39)..(39): Xaa is any aa, unknown, or other
MSSSSNSGKKPAPAXRGGPTIRTLADINRGPAGFPGAGXSSDDDEPQEYYTGGEKSGMLVQDPTRRNDVDAIFEQARQAGAIHGMPPFLVASLPALGALLGLAD

SEQ ID NO: 2719 - DNA, 436 bp, Zea mays
  misc_feature: Ceres CLONE 277753-F
  misc_feature (234)..(234): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcgtacctcaaaaagggccggtacgcgcasygtanggcacgggtccccccgtctacctcgccgccgtcctgcgagtacctcgcggccgaggtgctcgagctcgccggcaacgcscaagggacaacaagaagacgcgcatcattccgcgccacgtgctcctcgccatccgcaacgacgaggagstcggcaagctgctggccggcgtcaccatcgcccacggsgcgtcctccccaacat

SEQ ID NO: 2720 - DNA, 443 bp, Zea mays
  misc_feature: Ceres CLONE 277800-F
  misc_feature: Encodes the peptide sequence at SEQ ID NO. 2721
  misc_feature (378)..(378): n is a, c, t, g, unknown, or other
gttcatctgcagtgcacgaacaatcgagccagcaacataaacgatcgaggcgcggtggccgttagcaaccgcagcaagcatgaataactcgcgcgctctagtgttggtgctcctgctgctggccatcgccatggcgagctgcaggctctcgctccccgcccacgagagcagcaccagcctcgcggacaccctcggccgcgacctgcgggctccatcgccagggccgccggcaacctcttcataccggacggtggctggcgcgccgcgaacgtcaccgccgacgcagaggcaaagaacctgagggccgtggcgtcccggagcggcggcccgcaccaggaagtcctccggcggcggcgcgggctgcgtcacgccgggggngtgccggaagaggcgggtcatctgcggcaagaggtgctacgacggcgcctcgtcgmgcgccgccg

SEQ ID NO: 2721 - protein, 73 aa, Zea mays
  misc_feature: Ceres CLONE 277800-F
MNNSRALVLVLLLLAIAMASCRLSLPAHESSTSLADTLGRDLRAPSPGPPATSSYRTVAGAPRTSPPTQRQRT

SEQ ID NO: 2722 - DNA, 228 bp, Zea mays
  misc_feature: Ceres CLONE 277814-F
  misc_feature (137)..(137): n is a, c, t, g, unknown, or other
atacatttcgactctcaactcccaaggtccctttttttttctcgatctggaagcgccgcagtagcagccatggacgtgagcggasaggcggtaaggcgaagaagggcgcggcgggkytgcwawtgycggcgggcgancgaagaagtcggtgtcgcggtcctccagggccgggctgcagttccccgtcagccgcgtcgggcggtgacctcaaaaagggccggtacgcgc

SEQ ID NO: 2723 - DNA, 483 bp, Zea mays
  misc_feature: Ceres CLONE 277842-F
gacccatctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcaccgcgaccgcccctacggccactgctcgtcgccggcctcgcaagtaccccaagaaggtggtccgcaggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaascgccaaggcgcgcctcgaggagaggttcaagaccggcaagaacaggtggttctttaccaagctccgcttctagatggtcggcgtcccgaa

SEQ ID NO: 2724 - DNA, 375 bp, Zea mays
  misc_feature: Ceres CLONE 277853-F
  misc_feature: Encodes the peptide sequence at SEQ ID NO. 2725
  misc_feature (17)..(17): n is a, c, t, g, unknown, or other
  misc_feature (78)..(78): n is a, c, t, g, unknown, or other
  misc_feature (167)..(167): n is a, c, t, g, unknown, or other
  misc_feature (261)..(261): n is a, c, t, g, unknown, or other
  misc_feature (366)..(366): n is a, c, t, g, unknown, or other
tcacacactcgactctnctctctcgcatccgcagcctttcgagctctactccaccccctcgatctcgaagcgcacagncagcagtcaggcggccatggacgcgagctgcaccggagccggcgggaaggcgaagaagggcgcggccgggcgcaaggccggcgggcganggaagaagtcggtgacgaggtccgtcaaggccgggctgcagtttcccgtcggccgcatcgggcggtacctgaagaagggccggtacgcgcascngtcggcacgggcgcccccgtctacctggccgccgtcctcgagtacctggccgccgaggtgctggagctggccggcaacgctgccaaggacaacaagaagacccgnatcatccgg

SEQ ID NO: 2725 - protein, 93 aa, Zea mays
  misc_feature: Ceres CLONE 277853-F
  misc_feature (25)..(25): Xaa is any aa, unknown, or other
  misc_feature (55)..(55): Xaa is any aa, unknown, or other
  misc_feature (56)..(56): Xaa is any aa, unknown, or other
  misc_feature (91)..(91): Xaa is any aa, unknown, or other
MDASCTGAGGKAKKGAAGRKAGGRXKKSVTRSVKAGLQFPVGRIGRYLKKGRYAXXSARAPPSTWPPSSSTWPPRCWSWPATLPRTTRRPXSS

SEQ ID NO: 2726 - DNA, 422 bp, Zea mays
  misc_feature: Ceres CLONE 277860-F
  misc_feature: Translation starting site: 82
  misc_feature (315)..(315): n is a, c, t, g, unknown, or other
  misc_feature (417)..(417): n is a, c, t, g, unknown, or other
atccaaactcacagcacgctagctcttcagaacttgcggacgaaagactgaccgccgtacacgstagcagatcgatcgaccatggcgtcgtcctctcttctcctcctcgccgccgtcgccctcttcgcggcctccgcagacgcgccaccttcaacgtcatcaaccgctgcaagaacacgctgtggccggccgccctccccggcggcggcgcgcgctggacccgggcaagacgtggaccgtgcaggtgccggcgggcmggcgcacgcgcgggtgtgggcgcgcacggggtgcagcttcgacggcagcggccgcggngacgtgccagacgggggactgcggcggcgcgctggcgtgcaccgtgtccgggagaacccccgcgacgctggccgagtacacgctcaacaggaacggccggantacat

SEQ ID NO: 2727 - DNA, 493 bp, Zea mays
  misc_feature: Ceres CLONE 277864-F
  misc_feature: Encodes the peptide sequence at SEQ ID NO. 2728
gtgatttttstgggtgaacttttcccggcctccgctccggccagatcggcgcgggtgaaccccagcccctaccgatccggatccgtccccatcgcctcgtgtgttttccgtcgagtattttagcgtgagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggcggtgttttcttagtgaacattcatttcccgccagattaccccttcaaacctccaaaggtttctttcaagacaaaggtcttccatcctaatatcaacagcaatggaagtatatgccttgacattctcaaagagcagtggagccctgctctgacaatttctaaggtcctgctctccatctgctccctgctgaccgaccccaacccggacgaccctcttg

SEQ ID NO: 2728 - protein, 119 aa, Zea mays
  misc_feature: Ceres CLONE 277864-F
  misc_feature (5)..(119): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 96864
  misc_feature: Useful for making plants with modulated light quality sensitivity
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPL

SEQ ID NO: 2729 - DNA, 371 bp, Zea mays
  misc_feature: Ceres CLONE 277939-F
  misc_feature: Encodes the peptide sequence at SEQ ID NO. 2730
  misc_feature (320)..(320): n is a, c, t, g, unknown, or other
cagatcccatccacccctcgctattaaagcagcccaggygccgccgccgccgctcacccaccaatccacagcgacacccgaccccgccgtcgcgatgaggccggcgctgctcaagtccacggccgagctcctccgccgcagccgcgtacgcctcctcggccaacccggagcggaaggtggccatcctgggcgctgcgggcggcatcgggcagccgctctccctcctcatgaagctcaacccgctcgtytcctccctctccctctatgatatcgccgggatccccggtttgcggccgastctcccacatcaactcccccgncctggtgaaggggttcatgggggacgaccagctcggggaggcgctcgaggg

SEQ ID NO: 2730 - protein, 48 aa, Zea mays
  misc_feature: Ceres CLONE 277939-F
  misc_feature (24)..(24): Xaa is any aa, unknown, or other
MKLNPLVSSLSLYDIAGIPGLRPXLPHQLPRPGEGVHGGRPARGGARG

SEQ ID NO: 2731 - DNA, 295 bp, Zea mays
  misc_feature: Ceres CLONE 277945-F
  misc_feature: Translation starting site: 63
  misc_feature (98)..(98): n is a, c, t, g, unknown, or other
  misc_feature (99)..(99): n is a, c, t, g, unknown, or other
  misc_feature (237)..(237): n is a, c, t, g, unknown, or other
acacagcaagccagcagagcagaaagcagccgcagccccagcccccacaagacgaggcaacaatggcgctagaagcagccaccgccccccgcgcacdnntcgccgcgtgcctcgtcctgctggtcctcggcggcggcaccggcccgtcgtcggtgctgcgcggcgccggggcgaggccggcgggcagtgctgcgcagctgaaccgcctcctggstgccgcgcgtacccggtgcccgnygcgccggaccccagcgcggactgctgcagcgcgctgagcgcggttgtcgcacgagtg

SEQ ID NO: 2732 - DNA, 187 bp, Zea mays
  misc_feature: Ceres CLONE 277948-F
  misc_feature (56)..(56): n is a, c, t, g, unknown, or other
  misc_feature (115)..(115): n is a, c, t, g, unknown, or other
abacacacacaacacagcagagagattactacgatccaacagttctagagcaaganagaggaagacacaccgcagagttagcaggctaataacttgcaggagcagcaggaatggnggcgacsgtcgctctcttgccttctcctcgccgtgcttctggcaggagtggccgctgccacgccttcgacga

SEQ ID NO: 2733 - DNA, 412 bp, Zea mays
  misc_feature: Ceres CLONE 277961-F
  misc_feature: Encodes the peptide sequence at SEQ ID NO. 2734
aaggacgagcgctttttcgtgcccgctggccattgccgctgctcacgagcctcccgccccgcgctgccctgccctctgcggctctgcccaacgagccccaggagagccaggtaaaggagccgtcaaaagcccccgccgaggagagcacgcaaggacatggcgtcaaccgttaccttcagcccagttagcacccaagctgggttgatccataagccaaggaaccttggagccacaagctacgctggcttaaaggtgccgagctttggctctgaatcatcattcttgggtaggaacgcatcccttcgggcggctgttactacaaggatcgtgcccaaggcaaaatctggatctcagatatcgccacaggcatcttacaaggtggcgctgctcggtgctgctggtggcataggtc

SEQ ID NO: 2734 - protein, 85 aa, Zea mays
  misc_feature: Ceres CLONE 277961-F
  misc_feature: SWISSPROT Homolog: EC 1.1.1.37 Malate dehydrogenase
MASTVTFSPVSTQAGLIHKPRNLGATSYAGLKVPSFGSESSFLGRNASLRAAVTTRIVPKAKSGSQISPQASYKVALLGAAGGIG

SEQ ID NO: 2735 - DNA, 121 bp, Zea mays
  misc_feature: Ceres CLONE 277974-F
  misc_feature (46)..(46): n is a, c, t, g, unknown, or other
atctcagactcagggagagacgagagaagtggacacctcgcctgcntggactcgtctaattctagtatacagaaaamagcagaagagatacggggatgtctaagacggcgggcgtcggcag

SEQ ID NO: 2736 - DNA, 483 bp, Zea mays
  misc_feature: Ceres CLONE 277979-F
  misc_feature: Encodes the peptide sequence at SEQ ID NO. 2737
gtttgtgtccttagggtttagggttctctgctcattcgttcgccacctcgccccaagacgtctcgctagggtttcgccacagccgccgccatgcctcgccgcaagcttaggaaggtccgcggctcacgcccggctccacatgctgctccagtgaggaacccaccacagcctgcgcgctaggctcgtcctccagctcctgttcgtgatggtggtggtggctccattcttggaggaattgggtccaccattgcttaaggtatgccatttggtacgagtagtgccatggcaacagggctgttgatgctgtaatgggtctccggactgttcggcatgagattgttatctcagaagctgctgctgctgcccctcctgctccagtgatgaacgctaatgcttgcagcatccattctaaggctttccaagattgtcttaacaactatggcagtgagatcagcaagtgccagttctaccttgacatgttga

SEQ ID NO: 2737 - protein, 58 aa, Zea mays
  misc_feature: Ceres CLONE 277979-F
MGLRTVRHEIVISEAAAAAPPAPVMNANACSIHSKAFQDCLNNYGSEISKCQFYLDML

SEQ ID NO: 2738 - DNA, 360 bp, Zea mays
  misc_feature: Ceres CLONE 278101-F
  misc_feature: Encodes the peptide sequence at SEQ ID NO. 2739
tmataatcggctatcctgtcagtttccctctcccctcccgaaaccggattccgtaccgaatctggtctcgccttggagccgaggytgcacgcggttcgtcctgcggccatggatcgacgaggagcacgaggtgtacggacaggagatccccgttgacggcgaggacgtcgacatgtctgccggcgacgacgcaccaagcttcaggagctcgatcgagatcgaagcgccggctcaaggagatcgaggaggaagccgccgcgctccgsagatgcaggctcaaggtccgccaaggatatcgcaagatcccaatgcaaccacatctcgaaaacaaagaggagatcggattctcggtcggtattc

SEQ ID NO: 2739 - protein, 118 aa, Zea mays
  misc_feature: Ceres CLONE 278101-F
  misc_feature (88)..(88): Xaa is any aa, unknown, or other
NRLSCQFPSPLPKPDSVPNLVSPWSRGCTRFVLRPWIDEEHEVYGQEIPVDGEDVDMSAGDDAPSFRSSIEIEAPAQGDRGGSRRAPXMQAQGPPRISQDPNATTSRKQRGDRILGRY

SEQ ID NO: 2740 - DNA, 515 bp, Zea mays
  misc_feature: Ceres CLONE 278125-R
cattgggaccgggcccccctcgaggcgacggacgaatttttttttttttttttgctcaaccccctttaactattgaacgaacatgttgtctttttatagcattcacaccataaaacatagcaggtttaaacatcccaccaacagcacgcaaattatttgtacgcaacccccagaggctttgcgttaaacaaacttgcttaggggcctccaagttttaccaaggaaatgggaaaaaaaagttcctggcaaattcctaaccggaattggtccccgaaaaaaaaaaggttccccaaaaattggtctttttgaagggggggcccccgaaaaatttggggccccccccccgagggggggagaaaaaaaaaaaacaggccccccggggggggggggccccccctttgtggggaaaaaaaaccacccccccggggggggaaaaccccccccccccccggggggggggggggcccccccccccccccccgggggggggaaaaaaaaaaaatttttgtggcaaa

SEQ ID NO: 2741 - DNA, 173 bp, Zea mays
  misc_feature: Ceres CLONE 278151-F
atatgatccgcatacccccattccccgaagccgagctcatccaatccagtcgcctgattgcattgggatccatggcaagctcgccgtcctcctcctcctcgccgtggccgcgtccgccacagtgccggcgcacgccgcgataccccgactgagatcaagctcatcaaaggcac

SEQ ID NO: 2742 - DNA, 349 bp, Zea mays
  misc_feature: Ceres CLONE 278163-F
  misc_feature: Encodes the peptide sequence at SEQ ID NO. 2743
  misc_feature (140)..(140): n is a, c, t, g, unknown, or other
  misc_feature (141)..(141): n is a, c, t, g, unknown, or other
  misc_feature (222)..(222): n is a, c, t, g, unknown, or other
actctcctccttcctccaccgccgccaacgtcgcctggcggccgtctgcagctccgcgcctctgctcggaagttgttggtgaaggtttcttgaagctgagaagatggtgctgaagacagaactctgccgcttcacgcaannaagatttatcctgggaaaggcatccgatttatccgtgctgattctcaggtttttcctttttgccaactcaaaatgcaagcnctacttccacaaccgccttaagcctgcaaagcttacctggacagcaatttacaggaagcagcacaagaaggatatccatgctgaggctgtcaagaakaggcgccgcgccarcaagaagccatactcg

SEQ ID NO: 2743 - protein, 82 aa, Zea mays
  misc_feature: Ceres CLONE 278163-F
  misc_feature (3)..(73): Pfam Name: Ribosomal_L24e Pfam Description: Ribosomal protein L24e
  misc_feature (13)..(13): Xaa is any aa, unknown, or other
  misc_feature (40)..(40): Xaa is any aa, unknown, or other
  misc_feature (72)..(72): Xaa is any aa, unknown, or other
  misc_feature (77)..(77): Xaa is any aa, unknown, or other
MVLKTELCRFTQXRFILGKASDLSVLILRFFLFANSKCKXYFHNRLKPAKLTWTAIYRKQHKKDIHAEAVKXRRRAXKKPYS

SEQ ID NO: 2744 - DNA, 445 bp, Zea mays
  misc_feature: Ceres CLONE 278166-F
  misc_feature: Encodes the peptide sequence at SEQ ID NO. 2745
  misc_feature (2)..(2): n is a, c, t, g, unknown, or other
  misc_feature (279)..(279): n is a, c, t, g, unknown, or other
  misc_feature (297)..(297): n is a, c, t, g, unknown, or other
  misc_feature (308)..(308): n is a, c, t, g, unknown, or other
  misc_feature (320)..(320): n is a, c, t, g, unknown, or other
  misc_feature (335)..(335): n is a, c, t, g, unknown, or other
  misc_feature (352)..(352): n is a, c, t, g, unknown, or other
  misc_feature (384)..(384): n is a, c, t, g, unknown, or other
  misc_feature (404)..(404): n is a, c, t, g, unknown, or other
anaaccctagcgccccgcccgtyctgccgccgccgcagccgccatcgcacggccatgggtatcgatctcgtagccggcggccgcaacaagaagaccaagcgcacggcsccaagtccgacgatgtctacctcaagctcctcgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtnatcagatcgccgtgattntgggcaccgtnaccgacgacaanaggatcagcgaggtnccggcgataaaggtctncgcgctcaggttcactgagacagcgaggccangatcatcaatgctggcgganagtgcctcaccttcgaccagctcgcgctccgtgccccactt

SEQ ID NO: 2745 - protein, 147 aa, Zea mays
  misc_feature: Ceres CLONE 278166-F
  misc_feature (28)..(145): Pfam Name: Ribosomal_L18e Pfam Description: Eukaryotic ribosomal protein L18
  misc_feature (36)..(36): Xaa is any aa, unknown, or other
  misc_feature (93)..(93): Xaa is any aa, unknown, or other
  misc_feature (99)..(99): Xaa is any aa, unknown, or other
  misc_feature (106)..(106): Xaa is any aa, unknown, or other
  misc_feature (117)..(117): Xaa is any aa, unknown, or other
  misc_feature (128)..(128): Xaa is any aa, unknown, or other
  misc_feature (134)..(134): Xaa is any aa, unknown, or other
NPSAPPVLPPPQPPSHGHGYRSRSRRPQQEDQAHGXKSDDVYLKLLVKLYRFLVRRTKSNFNAVILKRLFMSKTNRPPLSMRRLVRFMEGKGXQIAVIXGTVTDDXRISEVPAIKVXALRFTETARPXSSMLAXSASPSTSSRSVPH

SEQ ID NO: 2746 - DNA, 469 bp, Zea mays
  misc_feature: Ceres CLONE 278177-F
  misc_feature: Pfam Name: Ribosomal_S10 Pfam Description: Ribosomal protein S10p/S20e
  misc_feature (44)..(44): n is a, c, t, g, unknown, or other
  misc_feature (258)..(258): n is a, c, t, g, unknown, or other
  misc_feature (347)..(347): n is a, c, t, g, unknown, or other
  misc_feature (350)..(350): n is a, c, t, g, unknown, or other
  misc_feature (362)..(362): n is a, c, t, g, unknown, or other
  misc_feature (368)..(368): n is a, c, t, g, unknown, or other
aacgctctccgccgccacttctcctccggcatcgacgaggcganscagcgcccgagtccctctccctgctcccacgacccatggcggcggatatggcgtacgcgcgccgatgaaggcggcaaggccgggttcgaggctggcatgatggatccgcagcacaggatccgcatcacgctctcctccaagagcgtcaagaacctcgagaaagtctgcggggatctggtgaagggcgccaagggtaaggagctcaaggtcaanggccccgtgcggatcctaccaaggtgctccacatcaccaccaggaagkctccctgtggaraaggtaccaacacctgggatcgcttttanatnaggattcacaanagggtnatcgatctcgtcagtacaccagacgttgtcaagcagatcacctcaatcaccattaaccaagtgtcsaggtttaggtgactatcagtgacgcttaatatggt

SEQ ID NO: 2747 - DNA, 282 bp, Zea mays
  misc_feature: Ceres CLONE 278178-F
  misc_feature: Translation starting site: 165
  misc_feature (189)..(189): n is a, c, t, g, unknown, or other
  misc_feature (227)..(227): n is a, c, t, g, unknown, or other
attcgttgcagtagtcgcagctgacggacgactgaaccaccgacagacaacatggccgcctccgcctccaccgtctccggcctcgcsgcggcctccctggccagccgcccgggttctccaccagcttcacgcggggcagccgggtgtcggcgaggaaccccctgatgagcaggaacctggagaggaatngcaggatcacctgcatgacgtttccccgggacttgctncggagggacctgagcgtcatcggcttcgggctcatcggctggatgggggccgtcc

SEQ ID NO: 2748 - DNA, 353 bp, Zea mays
  misc_feature: Ceres CLONE 278193-F
  misc_feature: SWISSPROT Homolog: EC 5.2.1.8 Peptidylprolyl isomerase
  misc_feature (248)..(248): n is a, c, t, g, unknown, or other
  misc_feature (254)..(254): n is a, c, t, g, unknown, or other
  misc_feature (301)..(301): n is a, c, t, g, unknown, or other
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctggsccacggacgaccactccctccacaacsccttcagcacctacggcgaggtcctcgagtccaagatcatcctcgatcgggagacgcagaggtcccgcggnttcggnttcgtcaacttctccacggaggaggcgatgcggaacscatcgagggnatgaacggcaaggagctggacggccgcaaaatcagcgtcaacgaggcacagt

SEQ ID NO: 2749 - DNA, 412 bp, Zea mays
  misc_feature: Ceres CLONE 278231-F
  misc_feature (348)..(348): n is a, c, t, g, unknown, or other
acgaccacacaccaccgctccacacacaagaagagagccgagagctagctacctagcacgcgatggcgatggcgatggcgatgtccgcttccaagatgatggcggtcgcggccgcgccctgctagccctggccctggcgtgtcgaccgccgaggcaaggaacatcaagacgacgacgacggcggcgacggagaagaaggacgacgcggtggtgcagccgcagaccttcccgcccttcgaccgcctcggcgcgggcgcgtccccggcgtccggtggcctccccggcacctcgtcgggcggcasakcattccagcgttcascatgccgggcagcggagcagcagcctccncggcggtcgttcttgcccggcagcagcggcagcatcggcagcatgccctcttcagcggcggctc

SEQ ID NO: 2750 - DNA, 143 bp, Zea mays
  misc_feature: Ceres CLONE 278282-F
  misc_feature (74)..(74): n is a, c, t, g, unknown, or other
actctctctccccatccgcgccagtccaaccaagtcagcacccgcgcgcgscaaggagttcacgcccatggcangcaccaacatggcgtcggccacctcgcggttcatgctggccgcgggcgtgcccactgccagtagcggca

SEQ ID NO: 2751 - DNA, 491 bp, Zea mays
  misc_feature: Ceres CLONE 278336-F
  misc_feature: Encodes the peptide sequence at SEQ ID NO. 2752
  misc_feature (135)..(135): n is a, c, t, g, unknown, or other
  misc_feature (431)..(431): n is a, c, t, g, unknown, or other
atcgaacaccaatggcattcttgcattgaaggaaccttccctccacctccaccgcccgagagcgagcssccggacggggttttggttgggcatggctgcccggcgatgctccaagtggtgatcctcgccgcggtnctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacggtttaggaagtaatgttagttttccgactacgtctcgatcggttagagttagtgtggccactggcaagttcgnatgcttagtttgatgagtgaaagacttgtgtcattcaataaatggatgattaatcaaaaa

SEQ ID NO: 2752 - protein, 147 aa, Zea mays
  misc_feature: Ceres CLONE 278336-F
  misc_feature (23)..(23): Xaa is any aa, unknown, or other
  misc_feature (144)..(144): Xaa is any aa, unknown, or other
IEHQWHSCIEGTFPPPPPPESEXPDGVLVGHGCPAMLQVVILAAVLLLPFLSVPGAEAQTKKFCLTQFAIASQACAILPPTSPEHHHHHHDDEDNDEDNDEDEDEDEDNDEDEDEDNDDGLGSNVSFPTTSRSVRVSVATGKFXCLV

SEQ ID NO: 2753 - DNA, 473 bp, Zea mays
  misc_feature: Ceres CLONE 278414-F
  misc_feature: Translation starting site: 67
  misc_feature (74)..(74): n is a, c, t, g, unknown, or other
  misc_feature (130)..(130): n is a, c, t, g, unknown, or other
  misc_feature (136)..(136): n is a, c, t, g, unknown, or other
  misc_feature (149)..(149): n is a, c, t, g, unknown, or other
  misc_feature (311)..(311): n is a, c, t, g, unknown, or other
  misc_feature (364)..(364): n is a, c, t, g, unknown, or other
  misc_feature (454)..(454): n is a, c, t, g, unknown, or other
asaacacgacctggggggttcagatcggatcggaagcttccataagtttccatcgggcttcgcggtatggsatnccgcaaggsgtcttcgtacgccgtcgcgcacttctcgcgctcgcctctgtcgccgncgttgnagggsaggtcttnttccaggagaagttcgaagatggctgggaaagtcggtgggtcaagtccgagtggaagaaggatgagaacatggctggtgaatggaaccacacctcgggaaaatggaatgggagatgccgaggacaaaggtattcaaacctccgaggattacaggttctatgncatttcagccgaataccctgagttcagcaacaaggataagaccctggtgctgnagttctctgtgaagcacgagcagaagcttgactgcggtggtggctamgtcaagttgctgggtggtggtgatgtagaccagaagaaayyyngtggagacacatcttacag

SEQ ID NO: 2754 - DNA, 321 bp, Zea mays
  misc_feature: Ceres CLONE 278416-F
  misc_feature (203)..(203): n is a, c, t, g, unknown, or other
aggatttgcaacccatttctctcctcgactcccacaacacggtccgtacggtaaagagagagaaggtgggagtggaatcgacaggggaaaaccaagcctgcgtttcagagacaactcaggcggcgcgatggcgatggcggcgctgcgacsgaggggaggcgcctcctcctctcccccaccgtccccaacccgtcttcggcggncgcttccgctgcggtgacsgatcctccgccatgtcgcaaccggacgatcggctccacttggtgcacgttctatttcaactcaagttcgtgaggaaccggatgaagagtatcaaaaaca

SEQ ID NO: 2755 - DNA, 209 bp, Zea mays
  misc_feature: Ceres CLONE 278448-F
ctagcattcaatcacgccgagctcgccggaacaagcccaacccgagcccaagcccgctcgggcccagccgatccggcggctcctcaccagtacaatcsgggtaccgcggmtgctagcctgatcgggtccccacggtcgatgggttcgcccgggttcgccaatggcagacgcggcgactatgtgaggatccggagaggcggaggtggcgt

SEQ ID NO: 2756 - DNA, 482 bp, Zea mays
  misc_feature: Ceres CLONE 278457-F
  misc_feature: Encodes the peptide sequence at SEQ ID NO. 2757
asggacgcttcgctctagtcggaaggtttcgaggaactcccgggctcgaggagatcggggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtc

SEQ ID NO: 2757 - protein, 139 aa, Zea mays
  misc_feature: Ceres CLONE 278457-F
  misc_feature (24)..(139): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCG

SEQ ID NO: 2758 - DNA, 138 bp, Zea mays
  misc_feature: Ceres CLONE 278464-F
acacgcacaccgcgacccagtccagagccagtacgtgcgavgcacgcacgctgctggtccgcgtacsagacgacggtcaggtcggccggtgcttttcagtttggaataatgacggcgacgacgacgacagccgccggc

SEQ ID NO: 2759 - DNA, 238 bp, Zea mays
  misc_feature: Ceres CLONE 278541-F
  misc_feature: Pfam Name: GST_N Pfam Description: Glutathione S-transferase, N-terminal domain
  misc_feature: SWISSPROT Homolog: EC 2.5.1.18 Glutathione transferase
  misc_feature (92)..(92): n is a, c, t, g, unknown, or other
  misc_feature (93)..(93): n is a, c, t, g, unknown, or other
  misc_feature (140)..(140): n is a, c, t, g, unknown, or other
  misc_feature (152)..(152): n is a, c, t, g, unknown, or other
acgcaacaaagccgaggtaaagcagggagcatcttgagtgttcgacagtgagccatggagaagacgtccgagagcgccataccgccggcggnnccccgctgatgctgttcgggtcgtgggcgagctcgtacacgcaccgncagctggcgctnggcycaagggctggagtacgactacgtggaggaggacctggggaacaagagcsacgagctgctgcgccacaaccccgtccacaaga

SEQ ID NO: 2760 - DNA, 202 bp, Zea mays
  misc_feature: Ceres CLONE 278558-F
  misc_feature (90)..(90): n is a, c, t, g, unknown, or other
  misc_feature (92)..(92): n is a, c, t, g, unknown, or other
atcacccaaaacacaagtagggttaggaaggcggcggccagcggcgagagcgcgagaggaggaggggtcggccatgacggggaaggcgansnagaagcacacagcgaaggagatcgccgcgaagattcgacgcggcgacgacgaaccggggcggcggcaaggcgggcaggcggaccggctggggcaggacaagggcgggcac

SEQ ID NO: 2761 - DNA, 376 bp, Zea mays
  misc_feature: Ceres CLONE 278565-F
  misc_feature (134)..(134): n is a, c, t, g, unknown, or other
  misc_feature (230)..(230): n is a, c, t, g, unknown, or other
atacatttcgactctcaactcccaaggtcccttttttttctcgatctggaagcgccgcagtagcagccatggacgtgagcggacaggcggtaaggcgaagaagggcgcggcggggcgcaaggccggcgggcrancgaagaagtcggtgtcgcggtcctccagggccgggctgcagttccccgtcagccgcgtcgggcgtacctcaaaaagggccggtacgcgcasygtanggcacgggtgccccgtctacctcgccgccgtcctggagtacctcgcggccgaggtgctcgagctcgccggcaacgscaagggacaacaagaagacgcgcatcattccgcgccacgtgctcctcgccatccgcaacgacgaggagct

SEQ ID NO: 2762 - DNA, 1080 bp, Zea mays
  misc_feature: Ceres CLONE 278643-R
ttgggtccggggccccccctcgaggtcgacggtatcgataagcttttttttttttttttttgtaattcaaccattccaaaccaacttattgataattaaaactaataagtgtagagacatgaaagcatagaaaatacagggtccagcatgttacctccgataatgataagtcatgtaggttctacgcccatcaagcccttgtatagtataacaaaaaccaactcaaaccacatcaacggcccgcgaccaatccttctggcgaatgcctttcattcacaatatagttggatatagagtaagggtgcgctcccaaaggccaaggatgttcttggtggccgttattcttgcccagagaaatcggctcctcctccatatttaaagtgggactcggctgttagaatttgtttttagtttttcgaaaccgtatcccataatccttgtgtcttccaaatattcttctttacgggttgggaaatcttaagaaacccgccacgttggggggggggagcgatgctgatatgtagtgaatgtgctttctttaaaactcttcgtctctttccttggagttgtttgctattagagagtgtttaatgaatgcgtgagtagttctgaggtgttctaataattgtagaggctcaacacttctttttccctaccatgtctttctctcctagtgattccgggagatgcgcgagccctagataatttcccctttggcgcatcgcgcgctttccttctctcctcatcgtgatgcgaatgtaccttcgtcctcgtttcgggccctctcgaaagaaaattctgcccttctctttcatgtcgttcgtggtaacgtcttatatgttccgtgcgccttgtggtctgtctccggatggaggccgtttcataagacccttcgttgagaaatatttcgtttttggtacttaagctcgcgttcttatcttcttcctcttgacattatgaaaacgcggtgacttctttatagggccgacgtatggggtattatcttttcccgttagcagtccggctgtcttattatggatagctctcctagatcgtctgtggctgatcggttgttcgttg

SEQ ID NO: 2763 - DNA, 300 bp, Zea mays
  misc_feature: Ceres CLONE 278657-F
  misc_feature: Translation starting site: 107
  misc_feature: Pfam Name: Ribosomal_L4 Pfam Description: Ribosomal protein L4/L1 family
  misc_feature: SWISSPROT Homolog: EC 2.7.7.6 DNA-directed RNA polymerase
  misc_feature (123)..(123): n is a, c, t, g, unknown, or other
acccttttccaccccgccgccgaagccaccgtgcygctagctyhccgccgccgcaaaatggccgcctccggcgacccctggttaccgtgagaccctggasggcgacatggccacsgactccgncggtgttccgctggcggacgtcctccgcgcaccgatccgcccggacatcgttcgcttcgtccacaagctcctgtcctgcaacagccgccaaccctatgcggtgtcgcgtcgsccggacaccagacctccgcggagtcctggggcacggggcgtcggtatcccgtatcccccgcgttc

SEQ ID NO: 2764 - DNA, 228 bp, Zea mays
  misc_feature: Ceres CLONE 278667-F
  misc_feature (138)..(138): n is a, c, t, g, unknown, or other
ctccatttcgactttcgagcgcagaaacgagagggccggagcagccgcagtcccggcgatcccgcsccggtcgccctcatacttcctcgtcactgccttcgtttctctttccaacaatcaasatgagccgtggcgtangcgggtggtggtcaaagttctctgggttactctttggaagcbgtgagccccccaaaccagcagtggcaccagctgtaagtgctccacctg

SEQ ID NO: 2765 - DNA, 491 bp, Zea mays
  misc_feature: Ceres CLONE 278684-F
  misc_feature: Translation starting site: 234
  misc_feature: SWISSPROT Homolog: EC 2.7.10.2 Non-specific protein-tyrosine kinase
  misc_feature (166)..(166): n is a, c, t, g, unknown, or other
  misc_feature (392)..(392): n is a, c, t, g, unknown, or other
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggntcgccggcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtnggctcccgaggagcaccccgtcctcctcaccgaggcgcccctgaaccccaaggctaacagggagaagatgacccagatcatgttcgagaccttcaacac

SEQ ID NO: 2766 - DNA, 476 bp, Zea mays
  misc_feature: Ceres CLONE 278686-F
  misc_feature: Translation starting site: 181
  misc_feature (139)..(139): n is a, c, t, g, unknown, or other
attactgtgcctttatcttcaacccaaaccatccattaccatattcctaagctatcatggtgcaccggacttccatagccgatgtgcatgtkatgtgcatggatctaagcccaaagawacccaacaaggccagcgccandcgggcggastaactacgactggtcccccgccgatctgcccatgctcggcgttgctccattggtgccgccaagctctgcctcaccgccggagtcttgccctacccagctactccgactctgccaagatcgcctacgtcctccaaggcaaaggtatattcggcgtggttctcccggagcgaccaaggagaaggtcatctccgtcaaggaaggcgacgcgctggcgctccccttcggcgtcgtcacctggtggcacaacaacgccgacgccgctatctccgacctcgtggtgctcttcctcggcgacacttccacgggccacaagccgggccagttcac

SEQ ID NO: 2767 - DNA, 148 bp, Zea mays
  misc_feature: Ceres CLONE 278733-F
  misc_feature (97)..(97): n is a, c, t, g, unknown, or other
aawacgaaaggdctgccctaacctcgtgcagtcgtgcccgcttgtktcacttgctcgccttcacccctcgccgccgccgctgtcgccatcgcaagcnacgatgctcgacatcaacttgttccgcactgacaagggcagcaacccggac

SEQ ID NO: 2768 - DNA, 2037 bp, Zea mays
  misc_feature: Ceres CLONE 278744
  misc_feature: Encodes the peptide sequence at SEQ ID NO. 2769
aagatccgatctccctctctctccccaatcctccccgcctccccctaccaaatcagcaccacccaaggcgcatccgagccacggccgcgcaatgccgccctctgtcgatgcaatgccggcccccggcgacgccgcgggcgccggcgacgtgcgcatgatctcctccaaggagctccgcgctcacgcttccgccgacgacctctggatctccatctccggcgacgtgtacgacgtcacgccctggctcccccaccacccgggcggcgacctcccgcttctcaccctggcggggcaggacgccaccgacgccttcgccgcctaccacccgccctcggcgcgcccgctcctccgccgcttcttcgttggccgcctctctgactacgccgtctcccccgcgtccgccgactaccgccgcctcctcgcgcagctatcctccgcgggcctcttcgaacgcgtcggccccacccccaaggtccagctcgtcctgatggccgtcctcttctacgccgcgctgtacctcgtcctcgcatgcgccagcgcctgggcgcacctcctcgcggggggtctcattggcttcgtctggatccagtccggctggatgggccacgactcgggccaccaccgcatcaccggccatccggtcctcgaccgcgtcgtgcaggtgctctccgggaactgcctcaccggcctcagcatcgcctggtggaagtgtaaccacaacacgcaccacatcgcctgcaacagcctggaccatgacccggacctccagcacatgccgctctttgccgtctcccccaagctgttcggcaacatatggtcctacttctaccaacggaccctggcgttcgatgccgcctcgaaattcttcatcagctaccagcactggaccttctacccggtaatgtgcatcgccaggataaatcttctcgcgcagtccgccctgttcgttctcacggagaagagggtgccgcagcggttgcttgagatcgcgggggtcgccacattctgggcttggtacccgttgctggtggcttccctgccgaattggtgggagagggtcgcgtttgtgcttttcagcttcaccatctgcgggattcagcacgtccaattctgcctgaaccacttctcgtccgacgtgtatgtcgggccacccaagggcaatgactggtttgagaagcagacggcaggcacgctcgacatcctgtgctctccttggatggattggttccacggtggcctgcagttccagattgagcaccatctgtttccccgcctacctcggtgccaccttcgcaaggttgcaccggccgtccgcgacctttgcaagaagcatgggctcacttattctgcagccacattctggggtgcaaatgtgcttacatggaagacactcagggctgctgcattgcaggccaggaccgctacaagtggtggtgctccgaagaatttggtatgggaggctgtgaacacccatggataaatgggatgaagatacgggctaatggcaacttctggtgttcagcttggtgcccatgtgattgtctggatgcctttcagttatttagagatattgatcattcaacctgcctgagtcaggttggaattttcgtgttgacaagtggctgtctatccagttggagagttcatgcttcaatagtctggttgttcacgagatgttctgttctccctatcacggtaactatatgatgatgatccttgctttaattcatgaacacttgtttcaagattatgtccattacattttgcttgcattgtcaagattgtggattcttggtgttcatgacgttgtaatgttaatgaacggctggtaacgccatgtggtactggtacccctgtattttcagttgctgtggcaccttggctctctctttgaaaaaccagtatgtatatgacaatgatcaatttattcatattcctacttcattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2769 - protein, 462 aa, Zea mays
  misc_feature: Ceres CLONE 278744
  misc_feature (157)..(411): Pfam Name: FA_desaturase Pfam Description: Fatty acid desaturase
  misc_feature (22)..(95): Pfam Name: Cyt-b5 Pfam Description: Cytochrome b5-like Heme/Steroid binding domain
  misc_feature (170)..(426): SWISSPROT Homolog: EC 1.14.19.3 Linoleoyl-CoA desaturase
  misc_feature (21)..(105): SWISSPROT Homolog: EC 1.7.1.3 Nitrate reductase (NADPH)
MPPSVDAMPAPGDAAGAGDVRMISSKELRAHASADDLWISISGDVYDVTPWLPHHPGGDLPLLTLAGQDATDAFAAYHPPSARPLLRRFFVGRLSDYAVSPASADYRRLLAQLSSAGLFERVGPTPKVQLVLMAVLFYAALYLVLACASAWAHLLAGGLIGFVWIQSGWMGHDSGHHRITGHPVLDRVVQVLSGNCLTGLSIAWWKCNHNTHHIACNSLDHDPDLQHMPLFAVSPKLFGNIWSYFYQRTLAFDAASKFFISYQHWTFYPVMCIARINLLAQSALFVLTEKRVPQRLLEIAGVATFWAWYPLLVASLPNWWERVAFVLFSFTICGIQHVQFCLNHFSSDVYVGPPKGNDWFEKQTAGTLDILCSPWMDWFHGGLQFQIEHHLFPRLPRCHLRKVAPAVRDLCKKHGLTYSAATFWGANVLTWKTLRAAALQARTATSGGAPKNLVWEAVNTHG

SEQ ID NO: 2770 - DNA, 433 bp, Zea mays
  misc_feature: Ceres CLONE 278747-F
  misc_feature: Translation starting site: 89
  misc_feature (173)..(173): n is a, c, t, g, unknown, or other
  misc_feature (232)..(232): n is a, c, t, g, unknown, or other
  misc_feature (357)..(357): n is a, c, t, g, unknown, or other
  misc_feature (418)..(418): n is a, c, t, g, unknown, or other
ctctagccaaaaccctagcagccgcccggtgctccctctctgcagatctcccttcgcagccscgaggaaccccttcacagcgcggaagatggctgaacaggaggccccagtcgtggttgaggcaccaaccccagttcttggsgagcctatggacttgatgactgctctgcvcntcgtgatgaagaagtcaagtgcctcatgatggacttgtgaagggtctccgtgaggctgncaaggccatcgagaagcacgccgctcagctttgcstgcttgctgaggactgtgaccagccagattatstcaagctggtgaaggcactctgcgcggasacaatgttcacctggtcagtgttcctgncgctaagacccttggcgagtgggctgggctttgcaagattgactctgsagggcaaggcaangaaggttgtaggctg

SEQ ID NO: 2771 - DNA, 123 bp, Zea mays
  misc_feature: Ceres CLONE 278786-F
  misc_feature (20)..(20): n is a, c, t, g, unknown, or other
ctcaaacaaaaaccctagcngccgcgccgccccgctccctagtggtgctccttccccaaccactgcagctccgtcccggcggccccaagagttgcggcgaagatgaacgtgaagggcggcacg

SEQ ID NO: 2772 - DNA, 488 bp, Zea mays
  misc_feature: Ceres CLONE 278790-F
  misc_feature: Encodes the peptide sequence at SEQ ID NO. 2773
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcaknttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtg

SEQ ID NO: 2773 - protein, 134 aa, Zea mays
  misc_feature: Ceres CLONE 278790-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLDISNAAVTRWRRRRPCRASARGAARSRPSPTS

SEQ ID NO: 2774 - DNA, 126 bp, Zea mays
  misc_feature: Ceres CLONE 278800-F
ctaactccgctgggccaccactttgabcgccgcctcccttcccctccgctactgctccttcccaccccactcccccgcagagcgcggcggcggcggcgaggtcgtacccacatcggcgagcggcgg

SEQ ID NO: 2775 - DNA, 217 bp, Zea mays
  misc_feature: Ceres CLONE 278806-F
  misc_feature (159)..(159): n is a, c, t, g, unknown, or other
atcgcataattttyctcggcggcgtcgcatctcaccggcggcgggctgcggcggcaaccggagcgatggcgagctcgtctgtggcggcggacatggagctggaccgccccaacctggaggactacctcccggccgaatcgctcccgcagaggggcccangaatctycatctgcgcgatctgcttgaaawctcgccggtgctaacaaggcaaccggtg

SEQ ID NO: 2776 - DNA, 308 bp, Zea mays
  misc_feature: Ceres CLONE 278838-F
  misc_feature: Encodes the peptide sequence at SEQ ID NO. 2777
  misc_feature (121)..(121): n is a, c, t, g, unknown, or other
  misc_feature (196)..(196): n is a, c, t, g, unknown, or other
  misc_feature (263)..(263): n is a, c, t, g, unknown, or other
aatccattctcacaaaagctgttctgacagccctacataggatatgttcgcctttccaaaggkaaaacagagatagaatcctacctctctagcatggcgaccggcgacgaggcggagacgncggtgcgggcgtctgaggagttgcgggactggtccgacatgacgccagtgtgtcttgccgaagcgttctcgcggntggcgctggaggacctgtkgcgcggcgccatgccgtgctgtcgctcctggcgggacsgcgcgctcgnccgggactcttcgcggtgcttgacctcgagccgggtttgctgagt

SEQ ID NO: 2777 - protein, 70 aa, Zea mays
  misc_feature: Ceres CLONE 278838-F
  misc_feature (10)..(10): Xaa is any aa, unknown, or other
  misc_feature (35)..(35): Xaa is any aa, unknown, or other
  misc_feature (41)..(41): Xaa is any aa, unknown, or other
  misc_feature (54)..(54): Xaa is any aa, unknown, or other
  misc_feature (57)..(57): Xaa is any aa, unknown, or other
MATGDEAETXVRASEELRDWSDMTPVCLAEAFSRXALEDLXRGAMPCCRSWRDXALXRDSSRCLTSSRVC

SEQ ID NO: 2778 - DNA, 379 bp, Zea mays
  misc_feature: Ceres CLONE 278850-F
  misc_feature: Encodes the peptide sequence at SEQ ID NO. 2779
  misc_feature (211)..(211): n is a, c, t, g, unknown, or other
  misc_feature (255)..(255): n is a, c, t, g, unknown, or other
  misc_feature (336)..(336): n is a, c, t, g, unknown, or other
  misc_feature (376)..(376): n is a, c, t, g, unknown, or other
aggcaacaataaaggcggggtcgaagaggagcttggagcttggaccgacccgagccccatcgagcgagagaggaaataatgggtgaagaggccagctgcaacgccaccggccgatgcaggccgccaccaacgccaggccggccaaggagaacggccgcgcaccggctgtggcggaggtggtggcccagaagcggccgctgacccccggctncagggcatctccgacgccatccgcgtstgccgcacttccccaancacggcatcatgttcaacgacatcaccacgctkctgcttcgccccagggtgttcaaggacgccgtcgacctgttcgtcgancgctaccgcgtgatcgcatcgacgccgtcccgggatttangcc

SEQ ID NO: 2779 - protein, 37 aa, Zea mays
  misc_feature: Ceres CLONE 278850-F
  misc_feature: SWISSPROT Homolog: EC 2.4.2.7 Adenine phosphoribosyltransferase
  misc_feature (24)..(24): Xaa is any aa, unknown, or other
MFNDITTLLLRPRVFKDAVDLFVXRYRVIASTPSRDL

SEQ ID NO: 2780 - DNA, 471 bp, Zea mays
  misc_feature: Ceres CLONE 278880-F
  misc_feature: Translation starting site: 109
  misc_feature: Pfam Name: PTPLA Pfam Description: Protein tyrosine phosphatase-like protein, PTPLA
  misc_feature (219)..(219): n is a, c, t, g, unknown, or other
  misc_feature (221)..(221): n is a, c, t, g, unknown, or other
  misc_feature (231)..(231): n is a, c, t, g, unknown, or other
  misc_feature (272)..(272): n is a, c, t, g, unknown, or other
  misc_feature (314)..(314): n is a, c, t, g, unknown, or other
  misc_feature (350)..(350): n is a, c, t, g, unknown, or other
  misc_feature (372)..(372): n is a, c, t, g, unknown, or other
gcttttactagatcatcagtagccagctcaggagccgagcctggtcarggtagccaagcccatcccggtcctctcccggcgtcttctccctccgcaccggctccggcgatggcgggcgtcggctccgcgctgcgtcggctctacctctccgtctacaactgggtcgtcttcttcggattggcgcaggtgctgtactacgcggtcctgacgctgcgtttnancgggcacaangccgtctacgccgccgtcgatagccgctgcagttcgcgcanacagccgccatcatggagatcgttcatgggctcgtagggttngtgagtctccggtctctgcaactcttccacagattngatccaggttgttccttacgtngggtgtcttgtggagttttcctgagacccagtcacaccttcttgttactaccctggtcataagctggtctatcactgagatcatcagatactctttctt

SEQ ID NO: 2781 - DNA, 490 bp, Zea mays
  misc_feature: Ceres CLONE 278934-F
  misc_feature: Encodes the peptide sequence at SEQ ID NO. 2782
acggacccttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaa

SEQ ID NO: 2782 - protein, 142 aa, Zea mays; identical to SEQ ID NO: 1303
  misc_feature: Ceres CLONE 278934-F
  misc_feature (24)..(142): Pfam Name: Calreticulin Pfam Description: Calreticulin family

SEQ ID NO: 2783 - DNA, 202 bp, Zea mays
  misc_feature: Ceres CLONE 278987-F
  misc_feature: Encodes the peptide sequence at SEQ ID NO. 2784
  misc_feature (6)..(6): n is a, c, t, g, unknown, or other
  misc_feature (20)..(20): n is a, c, t, g, unknown, or other
  misc_feature (122)..(122): n is a, c, t, g, unknown, or other
ccccantccccatagactknagcctgagctgcgacgtgagcgctcgccgctccgcatcgccgtcccagtcccacaccccgcctchvagcctgccccagcgtaatggcgcatcgcaggccgtnctcgcggccgttgtcctcgccgcgctgttcccgctcgccctctctcgcgggctgggcttggtgcacgggcatgtgcggcc

SEQ ID NO: 2784 - protein, 66 aa, Zea mays
  misc_feature: Ceres CLONE 278987-F
  misc_feature (2)..(2): Xaa is any aa, unknown, or other
  misc_feature (6)..(6): Xaa is any aa, unknown, or other
  misc_feature (28)..(28): Xaa is any aa, unknown, or other
PXPIDXSLSCDVSARRSASPSQSHTPPXSLPQRNGASQAVLAAVVLAALFPLALSRGLGLVHGHVR

SEQ ID NO: 2785 - DNA, 1548 bp, Zea mays
  misc_feature: Ceres CLONE 279012
  misc_feature: Encodes the peptide sequence at SEQ ID NO. 2786
aaacgctagtacctcgccccaaaaccctagtcctcagaggcccccatcgcctaggcgtcggagtgtttggaaacgcgacaaactacagcggctcggatcccgatgcctgctgcttctctgcagggtgacggtatgaagatagcaacaacaacaaagtgctgcctccccctcgcccagcagcagggagcagccatgccaggggaccacggctccaagggcgacatctccttcgccggacgcttcacggccagcgccatagcagcatgcttcgcagagatatgtaccatcccgctcgacacggccaaggtcaggctccagctgcagaagaacgtcgtcgccgccgccgcctccggggacgccgcgccagcgctccccaagtaccgcggcctgctcggaaccgccgccaccatcgctagggaggaaggggccgcagcgctctggaagggcatcgtcccgggcctccaccgacagtgcatctacggggggctacgcattggcctctacgagcctgtcaaatccttctacgtcggcaaagaccatgttggggatgtccctttgtccaagaagatagccgccggcttcacaactggtgccatcgctatcagcatcgccaaccctactgaccttgtcaaggtcaggctccaggccgagggcaagcttgcgcctggtgtgccacgccgctacactggcgcaatggatgcttattccaagattgctagacaggaaggggttgccgctctgtggactggccttggaccaaatgtagcgcggaatgctatcatcaatgctgctgagttggccagttatgatcaagtcaagcagacaattttgaaactccctgggttcaaagatgatgtggtcacccacctttttgctggacttggtgctggtttctttgctgtttgtgttggttccccagttgatgtggttaagtcgagaatgatgggtgactcagcctacaaaagcactctcgattgttttgtgaagacgctaaagaatgatggccctttggcattttacaaaggcttcctgccaaactttgcaagactgggatcttggaatgtgattatgttcttgacattggagcaggttcaaaagctgtttgtgaggaaagcgacaagctgaagatagagtttttgcagtcaggtggcgtacaattgacgcacagggtttttcttctatagacaaaaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgctctagttcagtgggcatctgttgttgcatgtttgggatggatttaatgtttcgttttttttccttgtactgactgatcggtaacgatcactgtgtgtgaagtgcttgattgttatgtggtatcatgagaatgaataaacataataatggagctgttttttttaaaataaaaaaaaaaaaaaaa

SEQ ID NO: 2786 - protein, 340 aa, Zea mays
  misc_feature: Ceres CLONE 279012
  misc_feature (251)..(338): Pfam Name: Mito_carr Pfam Description: Mitochondrial carrier protein
  misc_feature (151)..(246): Pfam Name: Mito_carr Pfam Description: Mitochondrial carrier protein
  misc_feature (42)..(145): Pfam Name: Mito_carr Pfam Description: Mitochondrial carrier protein
MPAASLQGDGMKIATTTKCCLPLAQQQGAAMPGDHGSKGDISFAGRFTASAIAACFAEICTIPLDTAKVRLQLQKNVVAAAASGDAAPALPKYRGLLGTAATIAREEGAAALWKGIVPGLHRQCIYGGLRIGLYEPVKSFYVGKDHVGDVPLSKKIAAGFTTGAIAISIANPTDLVKVRLQAEGKLAPGVPRRYTGAMDAYSKIARQEGVAALWTGLGPNVARNAIINAAELASYDQVKQTILKLPGFKDDVVTHLFAGLGAGFFAVCVGSPVDVVKSRMMGDSAYKSTLDCFVKTLKNDGPLAFYKGFLPNFARLGSWNVIMFLTLEQVQKLFVRKATS

SEQ ID NO: 2787 - DNA, 404 bp, Zea mays
  misc_feature: Ceres CLONE 279032-F
  misc_feature: Encodes the peptide sequence at SEQ ID NO. 2788
  misc_feature (71)..(71): n is a, c, t, g, unknown, or other
  misc_feature (109)..(109): n is a, c, t, g, unknown, or other
  misc_feature (110)..(110): n is a, c, t, g, unknown, or other
  misc_feature (196)..(196): n is a, c, t, g, unknown, or other
  misc_feature (323)..(323): n is a, c, t, g, unknown, or other
  misc_feature (324)..(324): n is a, c, t, g, unknown, or other
accagacagacagaggagaggagaaagggcaaaaggcaacaccgcccgckacgaccacgatggcagcctcnctccaagtccaagccgcggccaccttgatgcaaccggnnaagatcggcggccgggcgccgtccgcctcgctgccgtcgtccctcccgtcgtcgcaactcgccagggcgttcggcgtcgacgcggncgccgccaggatcacgtgctccctccagtccgacgtcagggacgtcccagcaagtgcgtcgacgccgccaagctcgccggcttcgcgctcgccacctcggcgctcctcgtctcgggcgcgacgcggnnggcacgcccaagaggctgacctacgacgagatccagagcaagacgtacctggaggtgaagggcacgggcacggcgaacca

SEQ ID NO: 2788 - protein, 115 aa, Zea mays
  misc_feature: Ceres CLONE 279032-F
  misc_feature (17)..(17): Xaa is any aa, unknown, or other
  misc_feature (46)..(46): Xaa is any aa, unknown, or other
  misc_feature (89)..(89): Xaa is any aa, unknown, or other
MAASLQVQAAATLMQPXKIGGRAPSASLPSSLPSSQLARAFGVDAXAARITCSLQSDVRDVPASASTPPSSPASRSPPRRSSSRARRGXHAQEADLRRDPEQDVPGGEGHGHGEP

SEQ ID NO: 2789 - DNA, 300 bp, Zea mays
  misc_feature: Ceres CLONE 279048-F
  misc_feature: Translation starting site: 31
  misc_feature: SWISSPROT Homolog: EC 3.2.1.14 Chitinase
  misc_feature (4)..(4): n is a, c, t, g, unknown, or other
  misc_feature (95)..(95): n is a, c, t, g, unknown, or other
aagnccaccaccagcagttctgagctagctatggcgatgatgatgagagcattggcagcagcggccatcctggcacggcgtttgbktcggacganccgagcccccgcagtgcgcgccaactccaccacggcgctctgcccctactgcctgtkctgcagcaaatggggcttctgcggcasaccgaagcctactgcggcaacggctgccagagccagtgcgaccgctgcaacgccaccgtcgcgtccatcgtcacgcgggactcttcgacgagctgctgctgcaccgcaacgacctcaggtg

SEQ ID NO: 2790 - DNA, 214 bp, Zea mays
  misc_feature: Ceres CLONE 279050-F
  misc_feature (99)..(99): n is a, c, t, g, unknown, or other
adatatctctcaccagtyaccacctcccctcagcttctccccacctttggtcaggcaggctcaggcaaaggaggcggccaacagggacgagcgatabcncaaggtcatctgcttcctggtgctcgcatccctgctcctcgccgtcgcctttcccgtgtctgctctgcggcasagtgaagaagggcggcggcggcggaggaggaggcggaggcag

SEQ ID NO: 2791 - DNA, 197 bp, Zea mays
  misc_feature: Ceres CLONE 279085-F
  misc_feature: Encodes the peptide sequence at SEQ ID NO. 2792
  misc_feature (20)..(20): n is a, c, t, g, unknown, or other
ctagagttttagtgccagcntgccaggccagccaccaacctcctcctcttccgcatcgcatcgagagcggggctgtacagtgcgagactctactgctcgatcgccatggccgccgcgctcaggtgcccggcatccgtcaggtctcgggccccgccgccgcggtccgccaaggtgcgccaggcgtccagagtcgtagc

SEQ ID NO: 2792 - protein, 30 aa, Zea mays
  misc_feature: Ceres CLONE 279085-F
MAAALRCPASVRSRAPPPRSAKVRQASRVV

SEQ ID NO: 2793 - DNA, 262 bp, Zea mays
  misc_feature: Ceres CLONE 279094-F
  misc_feature: Encodes the peptide sequence at SEQ ID NO. 2794
  misc_feature (144)..(144): n is a, c, t, g, unknown, or other
aaccgagacgggaggagaccagcagcagcccatccgaccccccgcctcctcctcctcctcctcccgggttcgcgtgaggctgtgtgctgctgggaggcggcgcgghcgtcggcsattgggaggcggagaagaagccgccggcgntgtccgacgtgggcgcgtgggcgatgaacgtcgtcagctccgtcagcctcatcatggccaacaagcagctcatgtcctcctccggctacgctttcgccttcgccaccacgctgaccgg

SEQ ID NO: 2794 - protein, 31 aa, Zea mays
  misc_feature: Ceres CLONE 279094-F
MNVVSSVSLIMANKQLMSSSGYAFAFATTLT

SEQ ID NO: 2795 - DNA, 421 bp, Zea mays
  misc_feature: Ceres CLONE 279116-F
  misc_feature: Translation starting site: 90
  misc_feature: SWISSPROT Homolog: EC 5.2.1.8 Peptidylprolyl isomerase
  misc_feature (270)..(270): n is a, c, t, g, unknown, or other
  misc_feature (342)..(342): n is a, c, t, g, unknown, or other
gtgctctctcagaggtgggctggcttctksctccccctcttaccaagtcctcctcgggttagggttccttagggttttgtggaggggcgatggcggcggctgatgtggagtaccgttgcttcgtcggcgggcttgcctgggccaccagcaacgagtcgctggaaatgccttcgcctcctactgcgagatcctcgactccaaggtcatcaccgaccgggagacggggaggtctcgcggcttcggcttcgttaccttctcctccgagaactnhatgctcgacgctakhvgagaacatgaacggcaaggagctcgacggccgtaacatcaccgttaaccaggccnagtcccgtggcggtggcggtggcggcggtggctacggcggcggtcgcggcggcggcggctatggtggcgggcgcgtgac

SEQ ID NO: 2796 - DNA, 475 bp, Zea mays
  misc_feature: Ceres CLONE 279117-F
  misc_feature: Encodes the peptide sequence at SEQ ID NO. 2797
aagatttcgctaatggaaagccaaacacctttctttcatggcaccatcgatcagggacgccagcccagctgctgcaaaggaggtactcatgcagcggtgatgagcgaggaggccccaaggaggagttcctgtgctgcccaccaccaccacctctgaaaagggcccggatggatacgagagcatgcagggaagccatggagtcagtgatgcgaggactactgctgggggagggggactgtactgcatcgatgattacatgcaagccatggccgtgggctggagaataaaggaggagggcctcatcagatggcagaggagagatgcggctgctgctacgccttccaatctccaagccatgggatgtttggtgcaagaatctggcccctttaagcaggtacgccgaccagaagcacaccgtcttggttctgcgctgaagcarcaggacggcgacgactccagcaaagaggacggaaac

SEQ ID NO: 2797 - protein, 98 aa, Zea mays
  misc_feature: Ceres CLONE 279117-F
MQGSHGVSDARTTAGGGGLYCIDDYMQAMAVGWRIKEEGLIRWQRRDAAAATPSNLQAMGCLVQESGPFKQVRRPEAHRLGSALKQQDGDDSSKEDGN

SEQ ID NO: 2798 - DNA, 311 bp, Zea mays
  misc_feature: Ceres CLONE 279121-F
  misc_feature: Translation starting site: 26
  misc_feature: SWISSPROT Homolog: EC 1.1.1.288 Xanthoxin dehydrogenase
  misc_feature (216)..(216): n is a, c, t, g, unknown, or other
aggttggttaactaggaacgcagccatggcaagcagtgccgtcatcgtccctgcctctccaagaaagttggagggaaaggtggccgtgatcactggcggggcgagcgggataggggagcgcacggcccggctgttcgtggagcacggcgcccacgtcgtgtggccgacatccaggacgaggccggcgcgcgcgtctgscgattctcggcggggttnccgccagctacgtccactgcgacgtcaccagcgaggacgacgtcgcggccgcggttggaccacgccgtgcgaacgttcggcgcgctggacatcat

SEQ ID NO: 2799 - DNA, 406 bp, Zea mays
  misc_feature: Ceres CLONE 279122-F
  misc_feature: Encodes the peptide sequence at SEQ ID NO. 2800
  misc_feature (115)..(115): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (148)..(148): n is a, c, t, g, unknown, or other
  misc_feature (307)..(307): n is a, c, t, g, unknown, or other
  misc_feature (367)..(367): n is a, c, t, g, unknown, or other
attctaaataccacaaatcaaagttgctttgcgatggtgagcagcagcatggacacgacgagtgacaagcgtgcgtcatccatgctggcccctaaccctggcaatgccacgatsntcgcccttggccacgccttcscgcagcannntntcatgcaggactacgtcgtcgasgcttcatgaagaacaccaactgtgacgacccggagctcaaggagaagctcaccagactctgcaagacgacgaccgtgagactcggtacgtggtgatgtcggatgagatcctcaagaactacccggagctggcccangaggggctgccgacgatgaaccagcgtctggacatctcgaacgcggcggtgacsagaatngcgacggaggcgtccctgtcgtgcgtccgctcgtkgggc

SEQ ID NO: 2800 - protein, 47 aa, Zea mays
  misc_feature: Ceres CLONE 279122-F
  misc_feature (14)..(14): Xaa is any aa, unknown, or other
  misc_feature (34)..(34): Xaa is any aa, unknown, or other
  misc_feature (46)..(46): Xaa is any aa, unknown, or other
MSDEILKNYPELAXEGLPTMNQRLDISNAAVTRXATEASLSCVRSXG

SEQ ID NO: 2801 - DNA, 978 bp, Zea mays
  misc_feature: Ceres CLONE 279144-R
  misc_feature (374)..(374): n is a, c, t, g, unknown, or other
attgattacagaagtaatccatagtttatatataatatatgttcgagacacttttggtatgataaaattatatttacatatgactcatagtcatcggtgatctagatcctaaataaaccaataggcaaaacaaatatccatatgcagcaagcccttgcatcttcatagtgttccaggttcataacttggatgcattactgttgttttttttgttttagtgatgaagaaattgtagcttggagtccttcacgtcgtggttgtggtggattgctcttggagagctcaactagggtagttctatgcaactcagggttgcaaaggttgagcatattatctccaaaaacaatagaccaacgaaggttttgttgtgaagntccacaaagaatggtacaacgggtaatttggtttgaatgacccagttgcgtgctttgaacctaatcgggggttcccctaacccccctcaaagttgggggcgcccgtttaaccccccgccctagaaaaaatgcagaaaaacctggcgtcatccaacttaaatagtgtataagaaaatgaagagataacccctcgacataataattcaataagtggggggggtctaacagccccgagagattggtggaagaagaattattgttttcttggcatgaaaggtgcgtgaaagaaagatctagaaaagggtggtgcgcttggcatgccccagcatcataacaagataagtccgagcactgtgctccaaaaaagactgttgtggaactccaaacacgacaaatgtggtgcgtgagagtgggtgaagagaagttacaccacacctgcaaatgcgtgggtagaacaagatagtctgataggcagttgacagttacgtcggcgcccactttgtaagacacacagcgcgcgtccctatggttgcggacggctgtggcaaacaacatgtcttggcgtatgtgcgaagaacagtgctgtacggttagttccatcacc

SEQ ID NO: 2802 - DNA, 716 bp, Zea mays
  misc_feature: Ceres CLONE 279149
  misc_feature: Encodes the peptide sequence at SEQ ID NO. 2803
agccgcatcccttctttcattcgccgccgccgcctgctctctgctgccgtcgccatggggagaaggcctgcggcggcgatggggagcgaccaggagacggagaagaagaagaccccggtggcgctaatgcccatcgcgaagcccctcgcaggaaagaagctctgcaagcggaccctcaagctcgtgcgacgagcctctgaggccaagtgcctcaagcgcggagtcaaagaggtagtcaagagcattcgtcgcgggaacaaagggttgtgtgtgattgctggaaatatttctcctattgatgtgattacacacgttccaatactatgtgaggaatttaatgttccttacatatatgttccatcaaaagaggatcttgcgaccgcaggaaccactaagaggccaacttgttgcgtcctggttctgaccaaaccaaacaagggggagctcagtgacgaggtgaaggataaactgaagtcagactatgaccaagttgtaacggaagttgctgaggctacatctgcaatgttctaaggaccattcagggaccacatcatctgagaatcatgcagctacattcttggcgtactatgtaacctgatccctgtcagtctgccctgcttgcgtgaaccgcaccagtatgctttgcatggtggctggagggatatgactatatgagtttacctatatattatggacttaaaaaaaaaaaaaaaaaa

SEQ ID NO: 2803 - protein, 158 aa, Zea mays
  misc_feature: Ceres CLONE 279149
  misc_feature (38)..(132): Pfam Name: Ribosomal_L7Ae Pfam Description: Ribosomal protein L7Ae/L30e/S12e/Gadd45 family
MGRRPAAAMGSDQETEKKKTPVALMPIAKPLAGKKLCKRTLKLVRRASEAKCLKRGVKEVVKSIRRGNKGLCVIAGNISPIDVITHVPILCEEFNVPYIYVPSKEDLATAGTTKRPTCCVLVLTKPNKGELSDEVKDKLKSDYDQVVTEVAEATSAMF

SEQ ID NO: 2804 - DNA, 119 bp, Zea mays
  misc_feature: Ceres CLONE 279230-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacggcgt

SEQ ID NO: 2805 - DNA, 489 bp, Zea mays
  misc_feature: Ceres CLONE 279232-F
  misc_feature: Encodes the peptide sequence at SEQ ID NO. 2806
  misc_feature (382)..(382): n is a, c, t, g, unknown, or other
  misc_feature (384)..(384): n is a, c, t, g, unknown, or other
  misc_feature (385)..(385): n is a, c, t, g, unknown, or other
  misc_feature (483)..(483): n is a, c, t, g, unknown, or other
ctccgtgcatgcaccgttgccgatcgtcgtcctcctccccactccccagaggccaagccaaaggtccagcaatggcgaggtctccccggcttctcgcgctgctgctggctgtcgtctggatatgcggcgcggccctagtagcgcgtcccgacccgatgctcgagaggttccagcagtggatgggcaggcacggccgggctgtacgctgacgccggagagaagcagaggcggctcgaggtgtaccggagaacgtcgagctggtcgagaccttcaactccatgggcaacgggtacaggctggccgacaacaagttcgccgacctgacgaacgaggagttcagggccaagatgctgggcttcggacggcctcgcagcggaggcgnanngccactccacagcgccgagcaccgtggcttgtattggaagtggactgatgggtcgtcagggttattctgatctaccgaaaagcgtggactggcgatanaaggga

SEQ ID NO: 2806 - protein, 45 aa, Zea mays
  misc_feature: Ceres CLONE 279232-F
MARSPRLLALLLAVVWICGAALVARPDPMLERFQQWMGRHGRAVR

SEQ ID NO: 2807 - DNA, 173 bp, Zea mays
  misc_feature: Ceres CLONE 279239-F
ccctcacagtcacagacacacaccgctgcttcaagaaaccaccgagagcccaaccgcacaggcaggagagagagcagggagccagggacagtagcgtggggccggggagcaacgatggaggggaaggaggaggacgtgcgcctgggcscaacaagttctcggagcgtcaccca

SEQ ID NO: 2808 - DNA, 478 bp, Zea mays
  misc_feature: Ceres CLONE 279244-F
  misc_feature: Encodes the peptide sequence at SEQ ID NO. 2809
aacgaagagagggaaaacaagtgtggaagagggaaaactggaaaaggcacagcaaaccgagaaaatggcggctcggcgtgggcgagagtgggacggggacgagcagggcgcggcgctgccaacgccggckccctcggcggccgttcgtctgccttctcagctccgctggagacctagccgccggcgccttcgtaggctccctcgtcggatacggaaaaggtttgatcacaaaccaaggcacgaaggcttgtcttagcattgctggatcttctgcaaagacatttgctgctcttgctggtgtccaaagtttcatcatgtgcttgctaagaagactgcgtgggaaagatgacatgatcaatgcgggtatggcaggttgttgcacaggcattgctcagctttccaggttgcgccccaggcaatgttccacagctgtgtcaccttcgcagcatttctcatgcataatggacgggtctcagca

SEQ ID NO: 2809 - protein, 158 aa, Zea mays
  misc_feature: Ceres CLONE 279244-F
  misc_feature (43)..(150): Pfam Name: Tim17 Pfam Description: Tim17/Tim22/Tim23 family
  misc_feature (43)..(43): Xaa is any aa, unknown, or other
RREGKQVWKRENWKRHSKPRKWRLGVGESGTGTSRARRCQRRXPRRPFVCLLSSAGDLAAGAFVGSLVGYGKGLITNQGTKACLSIAGSSAKTFAALAGVQSFIMCLLRRLRGKDDMINAGMAGCCTGIAQLSRLRPRQCSTAVSPSQHFSCIMDGSQ

SEQ ID NO: 2810 - DNA, 456 bp, Zea mays
  misc_feature: Ceres CLONE 279259-F
  misc_feature: Translation starting site: 287
ctctccgtgctttctcagaggcgggttggcttctcctcccccaccggttcgtgttcaggttctggttcgtgggcgagagggaagagatggcggcgtcggacgttgagtaccgttgcttcgttggcggcctcgctgggccaccgacgaccactccctcaacaacgccttcagcacctacggcgaggtcctagtcgaagatcatcctggatcgggagacgcagaggtcccgcggcttcggcttcgtcaccttctccacggaggacgcgatgcgcacgccatcgagggcatgaacggcaaggagctcgacggccgcaacatcaccgttaacgaggcccagtcccgcggcggccgcgtaggcgsggttggcggatacggtggcgggcgccgtgatggaggcggctacggcggtggcggtggcggctacggaggtggtcgttgaggctactgcggcggcgg

SEQ ID NO: 2811 - DNA, 452 bp, Zea mays
  misc_feature: Ceres CLONE 279264-F
atcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgc

SEQ ID NO: 2812 - DNA, 322 bp, Zea mays
  misc_feature: Ceres CLONE 279270-F
  misc_feature: Encodes the peptide sequence at SEQ ID NO. 2813
aacggaggggaaaggaaaaaatcaaacgagaaggaagccaccgctccccaatcgcytgtttgccttcccatcctcctcgtagatctccggcaccggcaccatgagctcctactccggcgaccgctcctcctcctccttgcgccccaccaacacctctttcgactcctacaagttcgacttcggcatcaactcctcccgctcctccggctctcgccccctccgcgaccagsccgggcgcgctaccaaccctccaacgaggcccaccaccggcgccacgtggatgcaccagcccgccagcgccaagccgtcgtggacccaccag

SEQ ID NO: 2813 - protein, 74 aa, Zea mays
  misc_feature: Ceres CLONE 279270-F
  misc_feature (44)..(44): Xaa is any aa, unknown, or other
MSSYSGDRSSSSLRPTNTSFDSYKFDFGINSSRSSGSRPLRDQXGRATNPPTRPTTGATWMHQPASAKPSWTHQ

SEQ ID NO: 2814 - DNA, 328 bp, Zea mays
  misc_feature: Ceres CLONE 279312-F
  misc_feature: Encodes the peptide sequence at SEQ ID NO. 2815
  misc_feature (142)..(142): n is a, c, t, g, unknown, or other
acaaccaagctcgatccatctcactctccgctggtcgctcactcttgcagctccacccttcactcagtcttagtctcttattagctctaggctctagctagccgcgccactccttcgtgtagccatcagccttctcatcgcnaccaatggccactgccgaggtccagaccccgaccgtcgtggcggccgaggaagcgcccgtggtggagaccccgccgccggccgtcgtgcccgaggagtctgcccccgccgaggccgaggccgagscgagggtgctgctcctgctgatcccgaggagcttcccgcggccgagcagcaggcagccgcg

SEQ ID NO: 2815 - protein, 60 aa, Zea mays
  misc_feature: Ceres CLONE 279312-F
  misc_feature (41)..(41): Xaa is any aa, unknown, or other
MATAEVQTPTVVAAEEAPVVETPPPAVVPEESAPAEAEAEXRVLLLLIPRSFPRPSSRQP

SEQ ID NO: 2816 - DNA, 479 bp, Zea mays
  misc_feature: Ceres CLONE 279324-F
  misc_feature: Translation starting site: 139
  misc_feature: Pfam Name: REF Pfam Description: Rubber elongation factor protein (REF)
  misc_feature (178)..(178): n is a, c, t, g, unknown, or other
  misc_feature (393)..(393): n is a, c, t, g, unknown, or other
gttcttccagcgacrragcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcbnaggagagggaggttatggtggagcagcagcagccgaggagggccccgaagctgaggtacctggacttcgtcrtggggcggctgccaggccgcggtgtgcctcgctgggctctacggcctcgccaaggaccacgccggcccgctccgccccagcgttgacgccgtcgagtctgccgtgaagggcgtcgttagccccgtctacgaccgcttcggcgnctgcctctcgacgtcctcgccttcgtcgaccgcaagtggacgacacggtgcacgaggtggacaagcacctcccgggcgcgctgaag

SEQ ID NO: 2817 - DNA, 442 bp, Zea mays
  misc_feature: Ceres CLONE 279364-F
  misc_feature: Encodes the peptide sequence at SEQ ID NO. 2818
atttggccttccgcctccacctgtacacgcctccgccacccgacaaactactcaataaccctagctaaacccccacgccgccgcgcacctcctccgccggcggatggacagcctcaggggagtcaagttgccgggcgtgccgaaggcgggagtgcgctcgtgaaggtggcgctgctcggcggcgcgggggctctacgccgtcctcaacagcttctacaacgtcgagggcggacaccgcgccatcgtcttcaaccgcctcgagggggatcaaggacaaggtgtaccccgaagaactcacctgatgatcccgtggatcgaaaggccgatcatctacgacgtccgcgcccgacccaacctcgtcgagagcacctccggaagccgcgacctccatatggtgagaattggtcttcgtgtccttactcgacccatgccagatcagcta

SEQ ID NO: 2818 - protein, 47 aa, Zea mays
  misc_feature: Ceres CLONE 279364-F
MIPWIERPIIYDVRARPNLVESTSGSRDLHMVRIGLRVLTRPMPDQL

SEQ ID NO: 2819 - DNA, 159 bp, Zea mays
  misc_feature: Ceres CLONE 279366-F
  misc_feature: Encodes the peptide sequence at SEQ ID NO. 2820
  misc_feature (65)..(65): n is a, c, t, g, unknown, or other
attcttccagcttccaggctctacgccgcttctagsccccgatacgcggcccggcccmaggcttncagcatggcgatgagctggatccgatcggttgttaggagggccctcatcgctccgaagccgcggggctcccgccagtttactgtcaccgccgcc

SEQ ID NO: 2820 - protein, 30 aa, Zea mays
  misc_feature: Ceres CLONE 279366-F
MAMSWIRSVVRRALIAPKPRGSRQFTVTAA

SEQ ID NO: 2821 - DNA, 433 bp, Zea mays
  misc_feature: Ceres CLONE 279402-F
  misc_feature: Translation starting site: 169
  misc_feature (193)..(193): n is a, c, t, g, unknown, or other
  misc_feature (375)..(375): n is a, c, t, g, unknown, or other
accccccattcgaacgccggagctcgacaaggacgaccgacgacgcacgcggagatccggcgkwaytgcaaattttgaaaactgaactgtaagatggcatcagcagagctttcccgtgagaaaatgtgtacatggcgamgtcgctgacaggcggagaggtacgaggagatggttgagttcatggagaaggtanccaagactgttgactcggaggagctcactgtggaggagcgaaacctcttgtctgttgcatacaagaacgtcattggagcccgccgcgcctcatggsattcatctcctccatcgagcagaaggaggagggccgaggcaattaggaccgagtaacactcatcaaggattatcgtggcaagattnagactgagctgaccaagatctgtgatggcatcctcaagctgcttgagacccatcttgt

SEQ ID NO: 2822 - DNA, 389 bp, Zea mays
  misc_feature: Ceres CLONE 279412-F
  misc_feature: Encodes the peptide sequence at SEQ ID NO. 2823
  misc_feature (177)..(177): n is a, c, t, g, unknown, or other
  misc_feature (316)..(316): n is a, c, t, g, unknown, or other
  misc_feature (373)..(373): n is a, c, t, g, unknown, or other
aaaaaatttcgaaacgagaggtgtctgcctatcacttgcgaagaaatcgcgaggggaacgtaacacctgacgagctgagcaggcaggcgtagtggccgagcgaaasatcctcgatctcgtcgtatcgtagctgccgccgctcagagcaatggagagagcggtgccagttcggaagtngcacaccaacacggccgaccttctctcctggtcggccacgggcctgacgcatctgcctcgccggccgcgtcctcccgccccagcctcaagccggccgcggggattacgccggcgatgttcggcgcgccggttcaccgancaggaggccgaggatctgagcaagagtgaaaggaaattttgctctggctcaaagttnaaagagatgggtggga

SEQ ID NO: 2823 - protein, 80 aa, Zea mays
  misc_feature: Ceres CLONE 279412-F
  misc_feature (10)..(10): Xaa is any aa, unknown, or other
  misc_feature (56)..(56): Xaa is any aa, unknown, or other
  misc_feature (75)..(75): Xaa is any aa, unknown, or other
MERAVPVRKXHTNTADLLSWSATGLTHLPRRPRPPAPASSRPRGLRRRCSARRFTXQEAEDLSKSERKFCSGSKXKEMGG

SEQ ID NO: 2824 - DNA, 487 bp, Zea mays
  misc_feature: Ceres CLONE 279415-F
  misc_feature (271)..(271): n is a, c, t, g, unknown, or other
aacaacagccctacaacttactgcttgctctagctagctagctgctcccggcccatatccactacacaagtaggctagcagcagcagcagcaatggcctcggtgacggttcccggccgtggccctcgtcctgctgctcgccgccagcgccttcctggccagcgaggtggcggcgtgcggcggctgcccgaaaccaactcctcctcctccatcgccaccaccgccgtcgcccaccagcacgccgtscctccgccaccgtccagctccggcgncaagtgccccaagaacgcgctgaaactgggcgtgtgcgcaacgtgctgggcctcgtcaaggtgtccatcggcaaggtgcccaccgactcgtgctgcccgctgctggacggcctcgcsacctggaggccgccgtctgcctctgcaccgcgctcaaggccaacgtgctcggcatcaacctcgacgtccccgtcaagctcaccctgctcctcaactact

SEQ ID NO: 2825 - DNA, 327 bp, Zea mays
  misc_feature: Ceres CLONE 279421-F
  misc_feature: Encodes the peptide sequence at SEQ ID NO. 2826
  misc_feature (74)..(74): n is a, c, t, g, unknown, or other
  misc_feature (126)..(126): n is a, c, t, g, unknown, or other
acgcaacawagcatcttgagtgttcgacagcgagccatggagaagacgtccgagaacgccatcccgccggcgcnccccgctgatgctgttcgggtcgtgggcgagctcgtacacgcaccgstcagnctggcgctgcggctcaagggcctggagtacgactacgtggaggaggacctggggaacaagagcgacgagctgctgcgccacaaccccgtccacaagaaggtgcccgtkctcgtccacgcggccgcgcgtctcccggagtccgtcattatcctccagtaccttgacgacgcctggccggagacccgcccgctgctccccgcc

SEQ ID NO: 2826 - protein, 97 aa, Zea mays
  misc_feature: Ceres CLONE 279421-F
  misc_feature (20)..(86): Pfam Name: GST_N Pfam Description: Glutathione S-transferase, N-terminal domain
  misc_feature: SWISSPROT Homolog: EC 2.5.1.18 Glutathione transferase
  misc_feature (13)..(13): Xaa is any aa, unknown, or other
  misc_feature (29)..(29): Xaa is any aa, unknown, or other
  misc_feature (30)..(30): Xaa is any aa, unknown, or other
MEKTSENAIPPAXPADAVRVVGELVHAPXXLALRLKGLEYDYVEEDLGNKSDELLRHNPVHKKVPVLVHAAARLPESVIILQYLDDAWPETRPLLPA

SEQ ID NO: 2827 - DNA, 251 bp, Zea mays
  misc_feature: Ceres CLONE 279426-F
  misc_feature: Encodes the peptide sequence at SEQ ID NO. 2828
  misc_feature (60)..(60): n is a, c, t, g, unknown, or other
  misc_feature (135)..(135): n is a, c, t, g, unknown, or other
  misc_feature (216)..(216): n is a, c, t, g, unknown, or other
  misc_feature (217)..(217): n is a, c, t, g, unknown, or other
actcgggtccatagttcaaaacgaaaccaagcaagcyttcggtcatggccccgcggcaangaatagcccgggagakgtcgacagckgcggccgccgatgtyatgttcatcccaagcgctggcatgggccacctcntcccattcttccgcttcatcgcggctctcgctgggcagacgtcgacatcyctgtggtgactgtccttcctaccgtttctgnngccgaggaggactacytcaccagcctcttcgctg

SEQ ID NO: 2828 - protein, 49 aa, Zea mays
  misc_feature: Ceres CLONE 279426-F
  misc_feature (6)..(6): Xaa is any aa, unknown, or other
  misc_feature (11)..(11): Xaa is any aa, unknown, or other
  misc_feature (31)..(31): Xaa is any aa, unknown, or other
MAPRQXIAREXSTAAAADVMFIPSAGMGHLXPFFRFIAALAGQTSTSLW

SEQ ID NO: 2829 - DNA, 450 bp, Zea mays
  misc_feature: Ceres CLONE 279444-F
  misc_feature (17)..(17): n is a, c, t, g, unknown, or other
  misc_feature (330)..(330): n is a, c, t, g, unknown, or other
cttccgctaccaccttnatccatcctgkygtcggtgtcttgcccccccagcgccgccgctccttcccccaccccgaagcgccgcctcttctgcctccgtcgacggtggtggtgctcctgatccccgccgttgaactggccataggagascaaagaggaaggggaggccgcgaggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgncttctgattcccactccccaaccctaacctcccccctgtagcacaccccacctctagctttgtaggtcctactatacttgcaacctctcccggatgactcgcttcgatctaccgccctcg

SEQ ID NO: 2830 - DNA, 507 bp, Zea mays
  misc_feature: Ceres CLONE 279463-F
  misc_feature: Translation starting site: 141
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtgttctctgct

SEQ ID NO: 2831 - DNA, 141 bp, Zea mays
  misc_feature: Ceres CLONE 279470-F
  misc_feature (120)..(120): n is a, c, t, g, unknown, or other
gcacaagcbccacagctcttgcactagctagagaccgaacagagagagattggagaaccatgatgaggtctggcttatctcgctatgtttccacctagccctggccatcacactggctgnaagttgttcctggccttgctc

SEQ ID NO: 2832 - DNA, 251 bp, Zea mays
  misc_feature: Ceres CLONE 279480-F
atccaaactcacagcacgctagctcttcagaacttgcggacgaaagactgaccgccgtacacgstagcagatcgatcgaccatggcgtcgtcctctcttctcctcctcgccgccgtcgccctcttcgcggcctccgcagacgcgccaccttcaacgtcatcaaccgctgcaagaacacgctgtggccggccgccctccccggcscggcgcgcgcttggacccgggcaagacgtggaccgtgcaggtgccgg

SEQ ID NO: 2833 - DNA, 219 bp, Zea mays
  misc_feature: Ceres CLONE 279510-F
acctttctcctctccttcattcctccccgtcccgcgtcgstcccacgccgccgcacctccgcggcagcttactcctcgccgtgacgtcggggaggcctctctcgggggagggctgcctgcctgcctggctgggtgtcagtcggccgtagaggaggaggggggcggaggagcttgatctggggcactgccccctcccctgcgccgtcgggatgtacatgc

SEQ ID NO: 2834 - DNA, 452 bp, Zea mays
  misc_feature: Ceres CLONE 279513-F2
  misc_feature (98)..(98): n is a, c, t, g, unknown, or other
gcaccaccaccgtcactcaacacagcacaggcagctcgagagagagagagagagaaagatgtcgtggttcgggcaccaccaccacaaccagccggctnccccggcgtcgggccccaaccaggtgttcaagatcttctgccgcgccaacgagaactactgcctggccgtccgcgacggcccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggacccaggaggacgcgtcggtgctgtggacggagagcaaggacgtgggcaaggggcttccgctgcatccgcatggtcaacaacacc

SEQ ID NO: 2835 - DNA, 452 bp, Zea mays; identical to SEQ ID NO: 2834
  misc_feature: Ceres CLONE 279513-F
  misc_feature: Encodes the peptide sequence at SEQ ID NO. 2836
  misc_feature (98)..(98): n is a, c, t, g, unknown, or other

SEQ ID NO: 2836 - protein, 150 aa, Zea mays
  misc_feature: Ceres CLONE 279513-F
  misc_feature (33)..(33): Xaa is any aa, unknown, or other
APPPSLNTAQAAREREREKDVVVRAPPPQPAGXPGVGPQPGVQDLLPRQRELLPGRPRRPVVLAPVNPKDDHQHWYKDMRFSTRVKDEEGMPAFALVNKATGLAIKHSLGQSHPVKLAPFSPDPGGRVGAVDGEQGRGQGASAASAWSTT

SEQ ID NO: 2837 - DNA, 447 bp, Zea mays
  misc_feature: Ceres CLONE 279527-F
  misc_feature: Encodes the peptide sequence at SEQ ID NO. 2838
agccgccgccagaccattcgtttctcgcgagcyatcgcttctgtaattctcaggcatccggaagawatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaatagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaagttatgttttgaagttcatgctaccttttaaagtacggattaccttgtgcctatgttcattatttttgcctttg

SEQ ID NO: 2838 - protein, 60 aa, Zea mays
  misc_feature: Ceres CLONE 279527-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKNSGEAEAEE

SEQ ID NO: 2839 - DNA, 160 bp, Zea mays
  misc_feature: Ceres CLONE 279541-F
  misc_feature (43)..(43): n is a, c, t, g, unknown, or other
  misc_feature (139)..(139): n is a, c, t, g, unknown, or other
agtcacacaccgctgcttcaagaaaccaccgagagcccaagcncdtcaaggcaggagagagagagagagagagcagggagagaagcgtggggccggggagcaaagatggaggggaaggaggaggacgtgcgcctgggsncaacaagttctcggagcggca

SEQ ID NO: 2840 - DNA, 487 bp, Zea mays
  misc_feature: Ceres CLONE 279608-F
  misc_feature: Encodes the peptide sequence at SEQ ID NO. 2841
  misc_feature (195)..(195): n is a, c, t, g, unknown, or other
  misc_feature (196)..(196): n is a, c, t, g, unknown, or other
  misc_feature (415)..(415): n is a, c, t, g, unknown, or other
aacctctagctgattgatctctggtttaccactctttccttccctccttcaattctaaataccataaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagnatggcgacggaggcgtccctgtcgtgcgtccgctcgtggggcggcgcgctctcgtccatcacccacctcgtg

SEQ ID NO: 2841 - protein, 57 aa, Zea mays
  misc_feature: Ceres CLONE 279608-F
  misc_feature: SWISSPROT Homolog: EC 2.3.1.95 Trihydroxystilbene synthase
  misc_feature (33)..(33): Xaa is any aa, unknown, or other
MSDEILKNYPELAQEGLPTMNQRLDISNAAVTXMATEASLSCVRSWGGALSSITHLV

SEQ ID NO: 2842 - DNA, 415 bp, Zea mays
  misc_feature: Ceres CLONE 279624-F
  misc_feature: Encodes the peptide sequence at SEQ ID NO. 2843
  misc_feature (69)..(69): n is a, c, t, g, unknown, or other
  misc_feature (108)..(108): n is a, c, t, g, unknown, or other
aatcgaaaaaggacactacgagaagaggaggttcatttccgcgtcgtctccgccagcagccccacccancacatggcagccatgcgggtggggcccacgccgccggcncgcggaccagatgcaggtggaccagccgctccccgctgcggccgcacacggcccgcggacgccaagcatgctggttctatgattgaagggaatgatccagtcacgggtcatataatctcaacaaccattggagggaagaatggagagcctaaaaagactatcagctacatggcagagagagttgtgggaactggatcattcggaatcgtcttccaggcaaaatgtctggagactggtgagactgttgctatcaagaaggttttgcaggacaagcgctacaagaacagggagctgcaaatcatgcgat

SEQ ID NO: 2843 - protein, 114 aa, Zea mays
  misc_feature: Ceres CLONE 279624-F
  misc_feature: SWISSPROT Homolog: EC 2.7.11.1 Non-specific serine/threonine protein kinase
MAAMRVGPTPPARGPDAGGPAAPRCGRTRPADAKHAGSMIEGNDPVTGHIISTTIGGKNGEPKKTISYMAERVVGTGSFGIVFQAKCLETGETVAIKKVLQDKRYKNRELQIMR

SEQ ID NO: 2844 - DNA, 473 bp, Zea mays
  misc_feature: Ceres CLONE 279642-F
  misc_feature: Translation starting site: 197
  misc_feature: SWISSPROT Homolog: EC 2.1.1.41 Sterol 24-C-methyltransferase
  misc_feature (135)..(135): n is a, c, t, g, unknown, or other
  misc_feature (185)..(185): n is a, c, t, g, unknown, or other
aattccactagattaccaccacctccacctcgtcgtctcccaccaccgccgagcgcgascctagcccgatctagccggcgsaggcaccagatcccgccgcccgckbtcccgggasggccccgccgaatccgccgntcctcgcactgcaacacgcccggaccacggtgcatttgatcggtccgggnccgcttacacgatgtccaagtcgggagcgctggatcttgcttctggcctcggagggaagatcaacaaggtggaagtyaaktcggccgtcgatgagtatgagaaatatcatggatactatggagggaaggaggaagcaaggaagtccaatatactgatatggttaataaatactatgatcttgccacttagcttctatggagtatggttggggtgaatccttcmattttgctcamagatggaatggagaatccttaccgtgaaagcatcaagcgacatgagcattttct

SEQ ID NO: 2845 - DNA, 344 bp, Zea mays
  misc_feature: Ceres CLONE 279683-F
  misc_feature: Translation starting site: 69
  misc_feature (181)..(181): n is a, c, t, g, unknown, or other
  misc_feature (320)..(320): n is a, c, t, g, unknown, or other
attcctcggagvgagaagccgccgccgcagcaatcacagcagcccggagaaagcccaggtccgacaagatgcagatcttcgtgaagacgctgacagggaagaccatcaccctcgcasstcsagagcagcgacaccatcgacaatgtcaagsccaagatccaggacaaggaagggatcccgncggaccagcagcggctgatctttgccgggaagcagctggaggatggccgcacccttgcsaactataacatcccaaaaggagtctacgcttcacctcgtgcttagstccgcggtggcatcattgagccctcgctgcaggnttccgctcgcaagtacaaccagga

SEQ ID NO: 2846 - DNA, 419 bp, Zea mays
  misc_feature: Ceres CLONE 279684-F
  misc_feature: Encodes the peptide sequence at SEQ ID NO. 2847
  misc_feature (95)..(95): n is a, c, t, g, unknown, or other
  misc_feature (313)..(313): n is a, c, t, g, unknown, or other
  misc_feature (318)..(318): n is a, c, t, g, unknown, or other
gcatcgctccctctcagcttcctcattggccatccttcgtcttccatggagaggctccttgccgcctactactcggcttcctattattgatcgcntcagtaggaagccatgcaactygtgctccagatcagtactggaagtctgctcttcccgacactcccatgccgagctccctctcccaactcctcaacaccccagctggcaagggcggcgtcggtggaggcagcagcggcaagaagcccggcggcaccacggtgggagttgggaaagggggagtgggcgttaacgttaaccctaccaaacccggcggcgnttaancaaccgttggcgttggcaaaggtggcgtcggcgtcggcgtcaatcccgggtacgcaagccgggtggcaccacggtgggcgttggcaagggcagggttggcg

SEQ ID NO: 2847 - protein, 103 aa, Zea mays
  misc_feature: Ceres CLONE 279684-F
  misc_feature (39)..(39): Xaa is any aa, unknown, or other
IAPSQLPHWPSFVFHGEAPCRLLLGFLLLIASVGSHATXAPDQYWKSALPDTPMPSSLSQLLNTPAGKGGVGGGSSGKKPGGTTVGVGKGGVGVNVNPTKPGG

SEQ ID NO: 2848 - DNA, 228 bp, Zea mays
  misc_feature: Ceres CLONE 279693-F
  misc_feature: Encodes the peptide sequence at SEQ ID NO. 2849
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggygcwaggycggcgggcgancgaagaagtcggtgtcgcggtcctccagggccgggctgcagttccccgtcagccgcgtcgggcgtacctcaaaaagggccggtacgcgc

SEQ ID NO: 2849 - protein, 76 aa, Zea mays
  misc_feature: Ceres CLONE 279693-F
  misc_feature (30)..(30): Xaa is any aa, unknown, or other
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (47)..(47): Xaa is any aa, unknown, or other
THTFRLSTPKVPFFFSIWKRRSSSHGRERXGGKAKKGAAGXXXGGRXKKSVSRSSRAGLQFPVSRVGRTSKRAGTR

SEQ ID NO: 2850 - DNA, 87 bp, Zea mays
  misc_feature: Ceres CLONE 279696-F
atgctcttcgccccctcgcgcttaccgctgccggcctcccgactcgccgcctccgctagctccgggctctccaatggcctccatgct

SEQ ID NO: 2851 - DNA, 152 bp, Zea mays
  misc_feature: Ceres CLONE 279697-F
  misc_feature (128)..(128): n is a, c, t, g, unknown, or other
ttcaacctctagctgattgatctctggtttacactctttccttccctccttcaattctaaataccacaaatcaaagttcgtttgcgatgstgagcagcagcatggacacgacgagtsacaaacgctgngtcatccatgctggctcctaaccc

SEQ ID NO: 2852 - DNA, 432 bp, Zea mays
  misc_feature: Ceres CLONE 279728-F
  misc_feature: Encodes the peptide sequence at SEQ ID NO. 2853
  misc_feature (137)..(137): n is a, c, t, g, unknown, or other
  misc_feature (388)..(388): n is a, c, t, g, unknown, or other
atcgaacaccaatggcattcttgcattgaaggaaccttccctccacctccaccgcccgatgagcgagctggccggacggggttttggttgggcatggctgcccggcgatgctccaagtggtgatcctcgccgcggtnctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgagggacaatgacgacgatagckgcggtggcggcgaccgcggtngcccccccgcgaccaaggcaagaagagcgacgtcgtcagtaaac

SEQ ID NO: 2853 - protein, 82 aa, Zea mays
  misc_feature: Ceres CLONE 279728-F
MLQVVILAAVLLLPFLSVPGAEAQTKKFCLTQFAIASQACAILPPTSPEHHHHHHDDEDNDEDNDEDEDEDEDNDEDEDEGQ

SEQ ID NO: 2854 - DNA, 470 bp, Zea mays
  misc_feature: Ceres CLONE 279744-F
  misc_feature: Encodes the peptide sequence at SEQ ID NO. 2855
gkacgcttcgctctagtcggaaggtttcgaggaactcccgggctcgagggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagata

SEQ ID NO: 2855 - protein, 136 aa, Zea mays
  misc_feature: Ceres CLONE 279744-F
  misc_feature (24)..(136): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPD

SEQ ID NO: 2856 - DNA, 456 bp, Zea mays
  misc_feature: Ceres CLONE 279747-F
  misc_feature: Translation starting site: 62
  misc_feature: Pfam Name: Fibrillarin Pfam Description: Fibrillarin
  misc_feature (354)..(354): n is a, c, t, g, unknown, or other
  misc_feature (388)..(388): n is a, c, t, g, unknown, or other
cacgaawacyctaaacchdcgctacccccggcggctacaagctcttcgtcggttcagcaccatgaggccaccggctagaggaggacgtggtgggaggggtggcaggttcgatggcggcggcgtgggggcggcggcggcggccgtgggtttggcggtggtagaggcgggagakgggacaggggagggagaggtggcaggacccccagaggcggccgtggcggcggtggcaggggtggccgcggcggtggcatgaagggcgggacaaggccgtcgtggtggcgcacaagcacgccggtgtcttcatctccaagtccaaggaggatgcgctctgcaccaagaacatggtcccggganattccgtgtacgagagaagcgtgtctccgttcanaattatgattgaacaaaattcgaatacagggtgtggaaccccttccgttccaagctggctgctgctgt

SEQ ID NO: 2857 - DNA, 339 bp, Zea mays
  misc_feature: Ceres CLONE 279767-F
attttcaaaggtagagatctctccgccgccgccgccgctatgcctccctccccatcctccggcgcgggctccgctcgccgtccggctccgcgtccgcctcggcctccaacccaaccccatcctggtgggagtccgtgtcgcaggcgcgctcccgcatcctagctctctcctccatcctgccggccccggcctcccacgacgtcgcggcgctggccgacgccgaccgcccggygcgcgckctcctccgctcacccactgcctacgcggcgctctctgacgcactgcgggcgggtggcggcgcgatgaccctgcctgccactggctctacgacacgctcct

SEQ ID NO: 2858 - DNA, 199 bp, Zea mays
  misc_feature: Ceres CLONE 279776-F
  misc_feature (31)..(31): n is a, c, t, g, unknown, or other
  misc_feature (32)..(32): n is a, c, t, g, unknown, or other
  misc_feature (54)..(54): n is a, c, t, g, unknown, or other
ctatcttcgcatctggcacgagcagccaagnnaataaaagtagagcggcgagcncgaccggcctgggcactctttcggccgagcgtamcagcaggtcgtcgtcgtcgtcgtcgtcgcagcacccggccggctagcatggccacgaggaggcagtggtggtggtggtgcctgctgctgctggcggcgtggtgctgcgccg

SEQ ID NO: 2859 - DNA, 122 bp, Zea mays
  misc_feature: Ceres CLONE 279795-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacggcgacgt

SEQ ID NO: 2860 - DNA, 494 bp, Zea mays
  misc_feature: Ceres CLONE 279870-F
  misc_feature: Encodes the peptide sequence at SEQ ID NO. 2861
  misc_feature (67)..(67): n is a, c, t, g, unknown, or other
aaaaccctaacactcatcacgccgccactgatctgctctgttgctggtgactaggagcagtagcgangagggattctggatggccaagtcgaagaaccacacggcgcataaccagtcgttcaaggcgcacaagaacggcatcaagaagcccaagcgccacctccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaattgatgtgtcgttttc

SEQ ID NO: 2861 - protein, 60 aa, Zea mays
  misc_feature: Ceres CLONE 279870-F
  misc_feature (3)..(42): Pfam Name: Ribosomal_L29e Pfam Description: Ribosomal L29e protein family
MAKSKNHTAHNQSFKAHKNGIKKPKRHLQTSTKGMDPKFLRNLRYSRKGNKKSGEAESEE

SEQ ID NO: 2862 - DNA, 248 bp, Zea mays
  misc_feature: Ceres CLONE 279880-F
  misc_feature: SWISSPROT Homolog: EC 3.6.3.14 H(+)-transporting two-sector ATPase
  misc_feature (60)..(60): n is a, c, t, g, unknown, or other
  misc_feature (99)..(99): n is a, c, t, g, unknown, or other
akattttbagatcagaaccaaactcggctcgagagagatcgcatacgcctgcctgcywtncacctccccttttccttcctcttcgccccagcgacgcgnccgcccggagaccgagcgaggcaggcaactaaccaccgagaggcagggacaggaacaggaagccggavaagatgtcgtcggtgttcagcggcgatgagacggcccccttcttcggcttcctcggcgccgcsccgccctcgtcttctcat

SEQ ID NO: 2863 - DNA, 205 bp, Zea mays
  misc_feature: Ceres CLONE 279884-F
  misc_feature (45)..(45): n is a, c, t, g, unknown, or other
attcaaaatcgatcccgaccttccgctcccgcaagadaggagganaaaaggaacagaggaagcgamgacaagcagtcagaggcggccgcgcagcccgccgcagtagcgacacgcaaccccccttcccctatcacgccacccgactccacggaggagcgagaccgcgcgccgcagatccttggtcgccgctaggttccggcgagat

SEQ ID NO: 2864 - DNA, 324 bp, Zea mays
  misc_feature: Ceres CLONE 279891-F
  misc_feature: Encodes the peptide sequence at SEQ ID NO. 2865
  misc_feature (60)..(60): n is a, c, t, g, unknown, or other
  misc_feature (257)..(257): n is a, c, t, g, unknown, or other
  misc_feature (297)..(297): n is a, c, t, g, unknown, or other
ccatccccgttccccaacccccccaaagccgagagccatcccgcccgcagccgcaaccangcaagcaagcgggagccgccaactcgtgcctctcggcagcggcgtctgaactctgaaccgaccgaccgttccgttcacccccaccatggaggcgccgcgtgaccggggcccatggagctggacgccccacctcccgccgccgccgsgattttcctcccgccggcagckacaagcacaaggtggacggggaagggganacgctgtacgggccatatcatctccaccaccatcggcggnaagaacggcgaccccaagcgaccatca

SEQ ID NO: 2865 - protein, 51 aa, Zea mays
  misc_feature: Ceres CLONE 279891-F
  misc_feature: SWISSPROT Homolog: EC 2.7.11.1 Non-specific serine/threonine protein kinase
  misc_feature (12)..(12): Xaa is any aa, unknown, or other
  misc_feature (29)..(29): Xaa is any aa, unknown, or other
MELDAPPPAAAXIFLPPAATSTRWTGKGXRCTGHIISTTIGGKNGDPKRPS

SEQ ID NO: 2866 - DNA, 224 bp, Zea mays
  misc_feature: Ceres CLONE 279923-F
  misc_feature: Encodes the peptide sequence at SEQ ID NO. 2867
  misc_feature (81)..(81): n is a, c, t, g, unknown, or other
  misc_feature (117)..(117): n is a, c, t, g, unknown, or other
  misc_feature (190)..(190): n is a, c, t, g, unknown, or other
acacacgccgacgcgaaccaaccaaccagctggtagtaggttcgccgcgctgacgatgatgcctcgccgcgcccttctctncgccgcggtgctcctcgcggcctccgccgccgcgtnctccgggttccacctgggaggggacgagagcggtctcgtgaggggtgtgctcgccgcgctccgsagcgaccgnaggccgaggacgccgctcgcttcgccgtcgccca

SEQ ID NO: 2867 - protein, 56 aa, Zea mays
  misc_feature: Ceres CLONE 279923-F
  misc_feature (9)..(9): Xaa is any aa, unknown, or other
  misc_feature (21)..(21): Xaa is any aa, unknown, or other
MMPRRALLXAAVLLAASAAAXSGFHLGGDESGLVRGVLAALRSDRRPRTPLASPSP

SEQ ID NO: 2868 - DNA, 225 bp, Zea mays
  misc_feature: Ceres CLONE 279925-F
  misc_feature (107)..(107): n is a, c, t, g, unknown, or other
  misc_feature (165)..(165): n is a, c, t, g, unknown, or other
atcacacactcgactctcctctctcgcatccgcagcctttcgagctctactccaccccctcgatctcgaagcgcmsagcagcagtcaggcggccatggacgcgagcncmscggagccggcggaaggcgaagaagggcgcggccgggcgcaaggccggcgggcgangggaagaagtcggtgacgaggtccgtcaaggccgggctgcagtttcccgtcggccgcatc

SEQ ID NO: 2869 - DNA, 850 bp, Zea mays
  misc_feature: Ceres CLONE 279940-R
  misc_feature (1)..(1): n is a, c, t, g, unknown, or other
  misc_feature (643)..(643): n is a, c, t, g, unknown, or other
  misc_feature (684)..(684): n is a, c, t, g, unknown, or other
  misc_feature (710)..(710): n is a, c, t, g, unknown, or other
  misc_feature (742)..(742): n is a, c, t, g, unknown, or other
  misc_feature (757)..(757): n is a, c, t, g, unknown, or other
naaaattcgattgggtaccgggccccccctcgaggtcgacggtatcgatattttttttttttttttttctttttttttttttttttttttttttttttttttttttttgcagcagctctattgctcttgcatattaaataaaatgactgtttgtgggaactgcatcccgtaatggaacatctcagatccgaaaattaaacatgacctcatgttgagttgagtttgctcttctacgattatatagagaaaaacctcggtatcctcagctcagatttcgtctttctgaagaaagtaattctttttttcctcggccaaaaaattttccccgggggggttttttttttcccccaaaaaaaaacccaaatttgtgtgcaaaaaaaaaaaatttccccgggcggggggggggcaccccccccccccccccccggggggggggaaaaaaaaaaatatttttttttttttttttttggggggggagggggggcccccccctcccccctttctgtgggggggggggggggtttttcctccccaaaaaaaaaaaaaaaaaaaatattttttttgttttttttttatagcgccccccccccccccccccccccggaagggaaaaaaaaaaaaaaaaaaaaaaaaaaaaaaaaantttcgcgttttttctttttttttttttttttgtgtggttgntatacccgttcaaaacacaaaaaaanataaaaaattacttttttttttttgggggtgntgtttcttttcttcntttcccttaaaataaacgcaataaaaccacccaccccgccccgtgctggcgccgccggattaaccacaacaatcaccccattcctttttctta

SEQ ID NO: 2870 - DNA, 729 bp, Zea mays
  misc_feature: Ceres CLONE 279950-R
  misc_feature (20)..(20): n is a, c, t, g, unknown, or other
  misc_feature (21)..(21): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
attgtgtttttgcccccccnntatatataaaaggaaggacaactnttttcccnnnnnncccgattgggtaccgggccccccctcgaggtcgacggtatcgataagcttttttttttttttttttgcatgggcatgcatggtttggttttacttattttattattattatgctgatgatatagaccgcaagacagactctgaatatccaaagaagaagacgactaccactaccacgttggagctcgactgctctcactgtgaaatggaaacacttgttattcctctcccctcctgccatacattgcagcacgcgtgccagggccctgcttcaagcggagcacttggcttgggcgaggtggcaccggccgggcaagctgttgatgatgcccatggtgctgcaggcgcactcttgcgaaacggagctcagagtgctgcaccaatccgcgctggggtccggcgcgccgggcaccaaccacccccggcacgccaggaggcgggaaaactgcggcaggcaatgcccgccggcctgcgccccggtgccgcgcagcaccgacgacaggccgtgtgccgcctcctaggaaccagctagtactaggcaacctggcccaggattgtctcgggtgggacggtgcgctgtctttctaatcgcctattgtttgcgcgtcgccccttgttgggggggtcagtggagtcatgacaagcttgcattttccgggcactcgcctgtgg

SEQ ID NO: 2871 - DNA, 446 bp, Zea mays
  misc_feature: Ceres CLONE 279955-F
  misc_feature: Encodes the peptide sequence at SEQ ID NO. 2872
  misc_feature (311)..(311): n is a, c, t, g, unknown, or other
  misc_feature (328)..(328): n is a, c, t, g, unknown, or other
  misc_feature (377)..(377): n is a, c, t, g, unknown, or other
ctcgacctcccccagtcccccaccgaccaccgaccaccgacctcctttcccgcagcacgggcgcaccggcacgcggtttccactcgcttcgtccccgttcggatcgccctcagagtaacagtctagcagagcaagcatgtcgtcgtcggcggagaacgagccccacggtgacggtgaccgagcgcggaggcaaggacaagcacgaggacggcggcgacaaggagcagggcgccggcggcttcatcgacaaggtgaaggacttcatccacgacatcggcgagaagatcgaggaggtcgtcgggttcggcaancccacggccgacgtttncggcatccacatcccgcacatcagcctccaccgcgccgacctcgtcgtngacgttctcatcaaaaacccgaacccggtcccgatcccgctcgtggacatcgactacctcatcgacagc

SEQ ID NO: 2872 - protein, 148 aa, Zea mays
  misc_feature: Ceres CLONE 279955-F
  misc_feature (78)..(148): Pfam Name: LEA_2 Pfam Description: Late embryogenesis abundant protein
  misc_feature (103)..(103): Xaa is any aa, unknown, or other
  misc_feature (109)..(109): Xaa is any aa, unknown, or other
RPPPVPHRPPTTDLLSRSTGAPARGFHSLRPRSDRPQSNSLAEQACRRRRRTSPTVTVTERGGKDKHEDGGDKEQGAGGFIDKVKDFIHDIGEKIEEVVGFGXPTADVXGIHIPHISLHRADLVVDVLIKNPNPVPIPLVDIDYLIDS

SEQ ID NO: 2873 - DNA, 404 bp, Zea mays
  misc_feature: Ceres CLONE 279959-F
  misc_feature: Translation starting site: 21
  misc_feature: Pfam Name: Ribonuclease_T2 Pfam Description: Ribonuclease T2 family
  misc_feature: SWISSPROT Homolog: EC 3.1.27.1 Ribonuclease T(2)
  misc_feature (192)..(192): n is a, c, t, g, unknown, or other
  misc_feature (348)..(348): n is a, c, t, g, unknown, or other
attcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaaccgaccaccggcgtctcssnccgccgcgacttctacataacgggcttcaccgtcccttaacgcgaccaccgacgctgcagttgacggggatgcagcaacaaagttccttacgaccctaacctgattaccggcatccaaggcctgaatcagtactggagcaacatcaggtgccccancaacaacggggcagagcagctggaagaacgcctggaaaaggccggcgcctgatctt

SEQ ID NO: 2874 - DNA, 378 bp, Zea mays
  misc_feature: Ceres CLONE 279992-F
  misc_feature: Encodes the peptide sequence at SEQ ID NO. 2875
  misc_feature (139)..(139): n is a, c, t, g, unknown, or other
  misc_feature (313)..(313): n is a, c, t, g, unknown, or other
  misc_feature (330)..(330): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggccganggaagaagtcggtgacgaggtccgtgaaggccgggctccagttccccgtcggccgcatcgggcgctacctcaagaagggccgctacgscascgtcggcagcggtgcccccgtctacctcgcggccgtcctggagtacctcgccgctgaggtcctggagctcgccggcaacgctnccaaggacaacaataanacgcgcatcgtcccgcgccacgtgctgctggcgatccgcaacgackag

SEQ ID NO: 2875 - protein, 103 aa, Zea mays
  misc_feature: Ceres CLONE 279992-F
  misc_feature (31)..(103): Pfam Name: Histone Pfam Description: Core histone H2A/H2B/H3/H4
  misc_feature (25)..(25): Xaa is any aa, unknown, or other
  misc_feature (54)..(54): Xaa is any aa, unknown, or other
  misc_feature (55)..(55): Xaa is any aa, unknown, or other
  misc_feature (83)..(83): Xaa is any aa, unknown, or other
  misc_feature (88)..(88): Xaa is any aa, unknown, or other
MDATGTGAGGKAKKGAAGRKAAGRXKKSVTRSVKAGLQFPVGRIGRYLKKGRYXXVGSGAPVYLAAVLEYLAAEVLELAGNAXKDNNXTRIVPRHVLLAIRND

SEQ ID NO: 2876 - DNA, 123 bp, Zea mays
  misc_feature: Ceres CLONE 279997-F
  misc_feature (61)..(61): n is a, c, t, g, unknown, or other
  misc_feature (62)..(62): n is a, c, t, g, unknown, or other
atagccagcgccaaccccggaaaggcggaaacccatcgcaactaatccccaaccccaaaynnccaatccacccatcccctcctcatccactccgggcggccatggctgctccttcgccgccgc

SEQ ID NO: 2877 - DNA, 171 bp, Zea mays
  misc_feature: Ceres CLONE 280024-F
atcctccagacacgcgcacsaaggwtcgcattcgccaagcaacgtcgggtcggcggcgcgggggcgatggagacgcggcggccgsgcgcgtggaaacaaacgcttcgtcctcccgctcgbkctcctctgcctcgccgtgctgctccccggcgcgctgctcccgccgtccgc

SEQ ID NO: 2878 - DNA, 375 bp, Zea mays
  misc_feature: Ceres CLONE 280032-F
  misc_feature: Encodes the peptide sequence at SEQ ID NO. 2879
  misc_feature (198)..(198): n is a, c, t, g, unknown, or other
  misc_feature (287)..(287): n is a, c, t, g, unknown, or other
  misc_feature (309)..(309): n is a, c, t, g, unknown, or other
acgagccagtggaatcttaccgattcggcaaccgtgctaatcgatatccgtgcaattccacctcccgaaccgaatccctccaccgacccaaaccctagcgcgcacccttctccgtcgtcctttcctggcgcgcgggccggtgtcggagatgcgggcgctgctcgcggacggcgggatggcactggcggtgtcgcggancaacgagtcgtcgggtggcgctgcggtgtcgctagggccgttatcgtgggcgtcggattcccacgggggtactttacaacctggccttnatgctgccatcgctggcctttntggggttcctggcgtggcaggcgcggcggacttccgtagctcagctacggccgctctcacgtcgtt

SEQ ID NO: 2879 - protein, 75 aa, Zea mays
  misc_feature: Ceres CLONE 280032-F
  misc_feature (17)..(17): Xaa is any aa, unknown, or other
  misc_feature (47)..(47): Xaa is any aa, unknown, or other
  misc_feature (54)..(54): Xaa is any aa, unknown, or other
MRALLADGGMALAVSRXNESSGGAAVSLGPLSWASDSHGGTLQPGLXAAIAGLXGVPGVAGAADFRSSATAALTS

SEQ ID NO: 2880 - DNA, 454 bp, Zea mays
  misc_feature: Ceres CLONE 280052-F
  misc_feature: Encodes the peptide sequence at SEQ ID NO. 2881
  misc_feature (281)..(281): n is a, c, t, g, unknown, or other
  misc_feature (306)..(306): n is a, c, t, g, unknown, or other
  misc_feature (327)..(327): n is a, c, t, g, unknown, or other
  misc_feature (331)..(331): n is a, c, t, g, unknown, or other
  misc_feature (393)..(393): n is a, c, t, g, unknown, or other
  misc_feature (443)..(443): n is a, c, t, g, unknown, or other
ctctttccagccacctcactcttcactagcctctgctcctctgaaatggcggcggcgacttcctcttccacctacctcgccatcggccgcaaaaccctaagccccgccccctccgtagccacagccgccacctccgttctccttccccgccacgcagcacccattccttcgtcgccgcctccgcgaaccgccgccgsgccgtggctgcgaaggtctcgtcgccgtcggtcatcggcaccgccatgccgtcgctcgacttcgagacctccgtcttcaagaangaaaaggtgtccctggccggccatnaggagtatattgtgaggggtngganggatctgttcccgctgttaccggagccttcaagggaatcaaacagatcggtgtaatcggctngggctcgcagggtcctgcacaagctcagaacttgagagactcacttgttnatgcaaagtca

SEQ ID NO: 2881 - protein, 47 aa, Zea mays
  misc_feature: Ceres CLONE 280052-F
  misc_feature: SWISSPROT Homolog: EC 1.1.1.86 Ketol-acid reductoisomerase
  misc_feature (13)..(13): Xaa is any aa, unknown, or other
  misc_feature (22)..(22): Xaa is any aa, unknown, or other
  misc_feature (29)..(29): Xaa is any aa, unknown, or other
  misc_feature (30)..(30): Xaa is any aa, unknown, or other
MPSLDFETSVFKXEKVSLAGHXEYIVRGXXDLFPLLPEPSRESNRSV

SEQ ID NO: 2882 - DNA, 431 bp, Zea mays
  misc_feature: Ceres CLONE 280062-F
  misc_feature: Encodes the peptide sequence at SEQ ID NO. 2883
  misc_feature (150)..(150): n is a, c, t, g, unknown, or other
  misc_feature (193)..(193): n is a, c, t, g, unknown, or other
  misc_feature (198)..(198): n is a, c, t, g, unknown, or other
  misc_feature (269)..(269): n is a, c, t, g, unknown, or other
  misc_feature (321)..(321): n is a, c, t, g, unknown, or other
agcatctcaagccaccatcgaccttcaagtctcgctacgtagcagtgcaataaaaaaagcagccgcaatggcgagcagcaccatggccctctcctccacggccttcgcsgcaaggccgtgaacgtgccgtcgtcgtccgccttcggcagngcccgcgtgacgatgcgcaagacggcggggaaggccaagccgncgggncgttccgggagcccgtggtacggccccgaccgcgtgctgtacctgggcccactgtccggcgagccgcsaanctacctgacgggcgagttcccgggcgactacggctgggacaccgcggggctntcggcggacccggagacgttcgccaagaaccgggacctggaggtgatccactcccgcttggccatgctgggcgcgctcggctgcgtcttcccggagctgctcgcccgcaa

SEQ ID NO: 2883 - protein, 89 aa, Zea mays
  misc_feature: Ceres CLONE 280062-F
  misc_feature (33)..(89): Pfam Name: Chloroa_b-bind Pfam Description: Chlorophyll A-B binding protein
  misc_feature (11)..(11): Xaa is any aa, unknown, or other
  misc_feature (35)..(35): Xaa is any aa, unknown, or other
  misc_feature (36)..(36): Xaa is any aa, unknown, or other
MRKTAGKAKPXGRSGSPWYGPDRVLYLGPLSGEPXXYLTGEFPGDYGWDTAGLSADPETFAKNRDLEVIHSRLAMLGALGCVFPELLAR

SEQ ID NO: 2884 - DNA, 235 bp, Zea mays
  misc_feature: Ceres CLONE 280069-F
  misc_feature: SWISSPROT Homolog: EC 3.6.3.14 H(+)-transporting two-sector ATPase
  misc_feature (67)..(67): n is a, c, t, g, unknown, or other
  misc_feature (138)..(138): n is a, c, t, g, unknown, or other
  misc_feature (140)..(140): n is a, c, t, g, unknown, or other
  misc_feature (219)..(219): n is a, c, t, g, unknown, or other
agagatcgcatacgcctgcctgcccacccacctccccttttccttcctcttcgccccagcgacgcgnccgcccggagaccgagcgaggcaggcaactaaccaccgagaggcagggacaggaacaggaagccggaraangnatgtcgtcggtgttcagcggcgatgagacggcccccttcttcggcttcctcggcgccgccccgccctcgtcttctcatncatgggcgccgcgtac

SEQ ID NO: 2885 - DNA, 490 bp, Zea mays
  misc_feature: Ceres CLONE 280074-F
  misc_feature: Translation starting site: 304
  misc_feature (408)..(408): n is a, c, t, g, unknown, or other
  misc_feature (459)..(459): n is a, c, t, g, unknown, or other
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcancgaaggggagaggatgtggttcatcctctgaaggtttctctggaggatttntacaatggcacatcgaagaagctctctctgt

SEQ ID NO: 2886 - DNA, 208 bp, Zea mays
  misc_feature: Ceres CLONE 280082-F
  misc_feature: Encodes the peptide sequence at SEQ ID NO. 2887
  misc_feature (68)..(68): n is a, c, t, g, unknown, or other
  misc_feature (97)..(97): n is a, c, t, g, unknown, or other
  misc_feature (204)..(204): n is a, c, t, g, unknown, or other
atcgaacaccaatggcattcttgcattgaaggaaccttccctccacctccaccgccgabagcgagcsncggacggggttttggttgggcatggctgnccggcgatgctccaagtggtgatcctcgccgcggtcctccttctcccgttcctcagcgtgccgggcgccgaggcacagaccaagaagttctgcctcacgcagttcgncatc

SEQ ID NO: 2887 - protein, 69 aa, Zea mays
  misc_feature: Ceres CLONE 280082-F
  misc_feature (20)..(20): Xaa is any aa, unknown, or other
  misc_feature (23)..(23): Xaa is any aa, unknown, or other
  misc_feature (32)..(32): Xaa is any aa, unknown, or other
  misc_feature (68)..(68): Xaa is any aa, unknown, or other
SNTNGILALKEPSLHLHRRXRAXDGVLVGHGXPAMLQVVILAAVLLLPFLSVPGAEAQTKKFCLTQFXI

SEQ ID NO: 2888 - DNA, 339 bp, Zea mays
  misc_feature: Ceres CLONE 280107-F
  misc_feature: Encodes the peptide sequence at SEQ ID NO. 2889
  misc_feature (151)..(151): n is a, c, t, g, unknown, or other
  misc_feature (214)..(214): n is a, c, t, g, unknown, or other
  misc_feature (228)..(228): n is a, c, t, g, unknown, or other
aagcgttmsaaactagttagcggtcaccgggcgcccatggagcttgacgaggagacgacgttcttggacgagctcatgtcgctgcggcgggaggcggcggcggcggcgtccggcagtggcaagcagctgccgcctacacgggcggggcggnacaaggcatgatgatgggcgactcctcttctacggcgggacgacggatgccgccgcgactgcnaccagcggcggggnaatggaccagctctcgccgttccaccagcaggagccgctgcaggtgcaggcgcccccgcaccctcactcgcacgaggagttcaacttcgactgcctcagcgaggtttgcaa

SEQ ID NO: 2889 - protein, 36 aa, Zea mays
  misc_feature: Ceres CLONE 280107-F
MDQLSPFHQQEPLQVQAPPHPHSHEEFNFDCLSEVC

SEQ ID NO: 2890 - DNA, 330 bp, Zea mays
  misc_feature: Ceres CLONE 280114-F
  misc_feature: Encodes the peptide sequence at SEQ ID NO. 2891
  misc_feature (103)..(103): n is a, c, t, g, unknown, or other
  misc_feature (222)..(222): n is a, c, t, g, unknown, or other
atctccatccacctgtcctcgcgtctcccttcccagatccatcgaytcgttcggkccgccctcccgtcgtccccgttcgaaggtgcggcasccgggcagsagncgatttgattcgacatgaatcccgagtacgactaccttttcaaacttctgcttattggtgattctggtgttgggaaatcatgcttgcttctcagatttgcagacgattcttatttgganagctatatcagcaaattgggggttgatttcaaaattcgcacagtggagcaagatgggaagacataaamcttcaaatytgggatactgctgggcaagagcgcttcagga

SEQ ID NO: 2891 - protein, 56 aa, Zea mays
  misc_feature: Ceres CLONE 280114-F
  misc_feature (35)..(35): Xaa is any aa, unknown, or other
MNPEYDYLFKLLLIGDSGVGKSCLLLRFADDSYLXSYISKLGVDFKIRTVEQDGKT

SEQ ID NO: 2892 - DNA, 327 bp, Zea mays
  misc_feature: Ceres CLONE 280131-F
  misc_feature: Encodes the peptide sequence at SEQ ID NO. 2893
  misc_feature (22)..(22): n is a, c, t, g, unknown, or other
  misc_feature (138)..(138): n is a, c, t, g, unknown, or other
  misc_feature (228)..(228): n is a, c, t, g, unknown, or other
agtactagcagtagcactsgcncgcacaatggtggtttccctcgccgaataaatctcaccggtcgcgcttcttggcgtgttcctccgctcgcctggscttcgatctccagccctcgcgtgasgggttscggccgcggngccgtggtcatggcgacggaggagtgggagctgcgggaggaggacscctacgcctacgagttcgagtycgacctcgagaaccccttcacnagccccgccgacgagccgatcgccagtytcctcgacgccgagtgccaccacgcsccctctatctccgccgggcctcggccacccgccgcgccgccgccg

SEQ ID NO: 2893 - protein, 60 aa, Zea mays
  misc_feature: Ceres CLONE 280131-F
  misc_feature (13)..(13): Xaa is any aa, unknown, or other
  misc_feature (20)..(20): Xaa is any aa, unknown, or other
  misc_feature (37)..(37): Xaa is any aa, unknown, or other
MATEEWELREEDXYAYEFEXDLENPFTSPADEPIASXLDAECHHAPSISAGPRPPAAPPP

SEQ ID NO: 2894 - DNA, 168 bp, Zea mays
  misc_feature: Ceres CLONE 280142-F
atcactgccaaatcccccagaaaatcaacacctcccaattccacgctgccaccaactcgccgtcctccgcgccaagcaccaaagctccgatggcccgcacgaagcagacggcgcgcaagtctaacgggcggcaaggcgccccgcaagcatgctggcgaccaaggcggc

SEQ ID NO: 2895 - DNA, 457 bp, Zea mays
  misc_feature: Ceres CLONE 280147-F
  misc_feature: Encodes the peptide sequence at SEQ ID NO. 2896
  misc_feature (241)..(241): n is a, c, t, g, unknown, or other
  misc_feature (456)..(456): n is a, c, t, g, unknown, or other
aacataagaggaaaggggcgtttgctttatattcgttctaacctgcgatctccgtccatccagccgagaggtcgtgtgcgcgtggatctctgcgtggaagcgatgaagattacggcgctcctggtgctgaagccgtcgacctctggagccgggagctcctcgtccggcggcgagtcgggcccggagcggtggtgctcgcgaacgcattagacgtcagccacttcggctacttccagcgcancggcccgcgagttcatcgtcttcgttgcccgaaccgtcgytcagcgcacccagccaggccagcggagtccgtccagcacgaagaatacaaggtccactcccacaatagaaatgggctttgtgcggttgcatttcatggatgatcattatccggtacgagttgattttctcttctgaatcaggtttcttgatgagtaccagaaggcttatggggant

SEQ ID NO: 2896 - protein, 35 aa, Zea mays
  misc_feature: Ceres CLONE 280147-F
MKITALLVLKPSTSGAGSSSSGGESGPERWCSRTH

SEQ ID NO: 2897 - DNA, 524 bp, Zea mays
  misc_feature: Ceres CLONE 280153-F
  misc_feature: Encodes the peptide sequence at SEQ ID NO. 2898
  misc_feature (307)..(307): n is a, c, t, g, unknown, or other
  misc_feature (398)..(398): n is a, c, t, g, unknown, or other
  misc_feature (429)..(429): n is a, c, t, g, unknown, or other
  misc_feature (443)..(443): n is a, c, t, g, unknown, or other
  misc_feature (461)..(461): n is a, c, t, g, unknown, or other
  misc_feature (464)..(464): n is a, c, t, g, unknown, or other
  misc_feature (467)..(467): n is a, c, t, g, unknown, or other
  misc_feature (480)..(480): n is a, c, t, g, unknown, or other
  misc_feature (484)..(484): n is a, c, t, g, unknown, or other
acagcacaagaacactcctagctagctgaagatctcgagtgcaacgaaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggcaaccaagctgcgatcgtagagagcaaggccaagatcggcatcggtgccaccgtggttaacaactgggcagtgtatgacgggccanggccaggcggctaagctcgtcggccgtgcgcagggcttgcacatcctagccggcaactgggtcaactcattcaccctggtgttcgaggatnaaaggttcagtgggtccacgctttaagtgangggcataacggttnaaactggcgagtgggctnttnttnggggcacggccantttnctatggcgaacggcatcatctccaagaagttccacgagca

SEQ ID NO: 2898 - protein, 42 aa, Zea mays
  misc_feature: Ceres CLONE 280153-F
  misc_feature (4)..(4): Xaa is any aa, unknown, or other
  misc_feature (35)..(35): Xaa is any aa, unknown, or other
MTGXGQAAKLVGRAQGLHILAGNWVNSFTLVFEDXRFSGSTL

SEQ ID NO: 2899 - DNA, 495 bp, Zea mays
  misc_feature: Ceres CLONE 280160-F
  misc_feature: Encodes the peptide sequence at SEQ ID NO. 2900
  misc_feature (88)..(88): n is a, c, t, g, unknown, or other
  misc_feature (126)..(126): n is a, c, t, g, unknown, or other
  misc_feature (342)..(342): n is a, c, t, g, unknown, or other
  misc_feature (477)..(477): n is a, c, t, g, unknown, or other
gaatctctctcacctccccgaagcaatcgagcggggcagcgcgccaggwaggatcggaggagacgccatcaatcagcacttgcacgcncgcggtcggccgcagtggaggaagaagatgggcctgtnctcgtgctgctgccggtgcctggagctgctgtgctcggtcctcctcccgcccctcggcgtctgcctccgccaccgctgctgctccatggagttctggatcagcgtgctgctcaccatcctcggctacctccccggcgtcctctacgccgtctacgtcatctgctccgtcgacccccaccgccaccgcgacaacgacgactacgtctacgtcgcatnacgaagatggaccggtccccgtggtgctctggtccgtgtctctgctgctacctccgtccgctgtgttgtgtgcatctttttgtttmgtttagtaaactaaatccatcctgtggccttctgtaaactgtaaattantattcgaatctgacaatc

SEQ ID NO: 2900 - protein, 108 aa, Zea mays
  misc_feature: Ceres CLONE 280160-F
  misc_feature (8)..(59): Pfam Name: UPF0057 Pfam Description: Uncharacterized protein family UPF0057
  misc_feature (4)..(4): Xaa is any aa, unknown, or other
  misc_feature (76)..(76): Xaa is any aa, unknown, or other
  misc_feature (105)..(105): Xaa is any aa, unknown, or other
MGLXSCCCRCLELLCSVLLPPLGVCLRHRCCSMEFWISVLLTILGYLPGVLYAVYVICSVDPHRHRDNDDYVYVAXRRWTGPRGALVRVSAATSVRCVVCIFLFXLVN

SEQ ID NO: 2901 - DNA, 161 bp, Zea mays
  misc_feature: Ceres CLONE 280162-F
  misc_feature (16)..(16): n is a, c, t, g, unknown, or other
  misc_feature (80)..(80): n is a, c, t, g, unknown, or other
gttttctataaaaccncctgacccgacggctccgtccatcgtccatccgtatttccgtcacaactcacaacccgagcccnccaaacccgaagcagcaggagctcccctgaccttgctccgcctccgatcaaggaaaaggaagatgagctactacggccagc

SEQ ID NO: 2902 - DNA, 300 bp, Zea mays
  misc_feature: Ceres CLONE 280163-F
  misc_feature: SWISSPROT Homolog: EC 3.2.1.14 Chitinase
  misc_feature (92)..(92): n is a, c, t, g, unknown, or other
agcactcagaccaccaccagcagttctgagctagctatggcgatgatgatgagagcattggcagcagcggccatcctggcacggcgtttgcnttcggcacgagccgagcccccgcagtgsgcgccaactccaccacggcgctctgcccctactgcctgtgctgcagcaaatggggcttctgcggcagcaccgaagcctactgcggcaacggctgccagagccagtgcgaccgctgcaacgccaccgtcgcgtccatcgtcacgcggggastcttcgacgagctgctgctgcaccgcaacg

SEQ ID NO: 2903 - DNA, 412 bp, Zea mays
  misc_feature: Ceres CLONE 280171-F
  misc_feature (264)..(264): n is a, c, t, g, unknown, or other
  misc_feature (327)..(327): n is a, c, t, g, unknown, or other
  misc_feature (384)..(384): n is a, c, t, g, unknown, or other
attatttcaattatctcaaagcctgtgcgtctgcccctttccagctttcctctcaaacggagaratgtactcggatcagatctccaccgggcgcaaskctccatccatgaccgccttgacggcgacctccctgccggcacggcgccggcggccgtgtccgtcacacggtgtccaagaggcaacgacagatagatgaaaaatggaagcatgatctgtatcgggaagatgatgamscagcttcaaaatcaacagatccgaagattntccgattraagcttcagaggcgaagttttcaacaagattttaccagcacaagaagttctggtntscgtgatctacgtgagaagctatctggtataatgaacccacagccatcraatgctnacccaccaaagccamagccaaaggccag

SEQ ID NO: 2904 - DNA, 383 bp, Zea mays
  misc_feature: Ceres CLONE 280172-F
  misc_feature: Translation starting site: 89
  misc_feature: SWISSPROT Homolog: EC 1.1.1.14 L-iditol 2-dehydrogenase
  misc_feature: SWISSPROT Homolog: EC 1.1.1.9 D-xylulose reductase
  misc_feature (119)..(119): n is a, c, t, g, unknown, or other
  misc_feature (261)..(261): n is a, c, t, g, unknown, or other
gtgccagtgctctcatctgcgtacacggtctccctcttcctgtcagtagtagagtgagagtgaggcagcgagtaggatacaaggggaaatggggaagggagcgcaagggagcgatgcgncggtggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcangatgtgcactacctcagggagatgcgcatcgsactttcgtggtgaaggagccgatggtgatcgggcacgattgcgcgggcgtggtcgaggaggtgggcgccggcgtaatgcacctttccgtg

SEQ ID NO: 2905 - DNA, 473 bp, Zea mays
  misc_feature: Ceres CLONE 280176-F
  misc_feature: Translation starting site: 303
  misc_feature: SWISSPROT Homolog: EC 5.2.1.8 Peptidylprolyl isomerase
  misc_feature (396)..(396): n is a, c, t, g, unknown, or other
gtgctttcttagaggtgggttggcttctcctccccctccggttcgggttcgggttcgtgaggttctccgggggttcgggttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacscatcgagggcatgaacggcaaggagctggacggccgcaacatcaccgtcaacgaggcccagtcccgcggcggccgtggagggagtggtgtactaatcagcaatntctcaaaccattcaacctctttgttgtcatcaatggaaatcgctacttatgtgtgccaaaaaaataaaaaaaaaagc

SEQ ID NO: 2906 - DNA, 491 bp, Zea mays
  misc_feature: Ceres CLONE 280183-F
  misc_feature: Translation starting site: 82
  misc_feature: Pfam Name: ATP-synt Pfam Description: ATP synthase
  misc_feature: SWISSPROT Homolog: EC 3.6.3.14 H(+)-transporting two-sector ATPase
acggtaaagagagagaaggtgggagtggaatcgacaggggaaaaccaagcctgcgttttcakagacaactcaggcggcgcgatggcgatggcggcgctgcgacgcgagggtgaggcgcctcctcctctcccccaccgtccccaacccgtcttcggcggccgcttccgctgcggtgacsgatcctccgccatgtcgcaaccggagatggctccacttggtgcacgttctatttcaactcaagttgtraggaaccggatgaagagtatcaaaaacatccagaagatcacaaaggctatgaagatggttgcagcatcaaagcttcgggctgttcagacgaggactgaaaattcacgcggcgttgtggcagccgttcaccgcccttcttggggacgctcctagtgttgatgtcaagaagaatgtgattgtggccattacctctgataagggactctgtggtggtatcaattcaacctcggtgaaagttascaggg

SEQ ID NO: 2907 - DNA, 365 bp, Zea mays
  misc_feature: Ceres CLONE 280191-F
  misc_feature: Encodes the peptide sequence at SEQ ID NO. 2908
  misc_feature (286)..(286): n is a, c, t, g, unknown, or other
  misc_feature (344)..(344): n is a, c, t, g, unknown, or other
  misc_feature (359)..(359): n is a, c, t, g, unknown, or other
gggagggtgacagggcgtgtcctcgaccgcgagggaatgggatcggagggacgggcctggaaacggcgcgggcatggccgccggcagcgctatggcggcggggtagaggcgaaasgkaccaccacggctgtktcggccgcggcccccgsaggttcccacgtcggcggcctccgtcgacatctcgctgccgctcctgaagatgtcgcctcgcatcatagctctctgcaaggaattggtcgaagggtggtcgtcgattgacagctcgctcttctccatcgagaccgtntccgggggcatcacgaatctattcctgaaggtttctgtcaaagaagacaacggcaatnagtcttctgttactnttcggt

SEQ ID NO: 2908 - protein, 55 aa, Zea mays
  misc_feature: Ceres CLONE 280191-F
  misc_feature (49)..(49): Xaa is any aa, unknown, or other
  misc_feature (54)..(54): Xaa is any aa, unknown, or other
MSPRIIALCKELVEGWSSIDSSLFSIETVSGGITNLFLKVSVKEDNGNXSSVTXR

SEQ ID NO: 2909 - DNA, 192 bp, Zea mays
  misc_feature: Ceres CLONE 280214-F
  misc_feature (2)..(2): n is a, c, t, g, unknown, or other
  misc_feature (44)..(44): n is a, c, t, g, unknown, or other
  misc_feature (128)..(128): n is a, c, t, g, unknown, or other
tntcttcttcccgtcgagacccaaccataccagcggcgccgcangaacgaggaggcggattagattggccggactacctcgacacctccactgcaaccatgggtatctcacgtgattcgatgcacaanckccgggccaccgttggaaacagaagacgtggcgcaagawgcgaaagtatragcttggccgcca

SEQ ID NO: 2910 - DNA, 408 bp, Zea mays
  misc_feature: Ceres CLONE 280245-F
  misc_feature (136)..(136): n is a, c, t, g, unknown, or other
  misc_feature (137)..(137): n is a, c, t, g, unknown, or other
  misc_feature (139)..(139): n is a, c, t, g, unknown, or other
  misc_feature (149)..(149): n is a, c, t, g, unknown, or other
actgtgcctttatcttcaacccaaaccatccattaccatattcctaagctatcatggtgcaccggacttccatagccgatgtgcatgtgatgtgcatggatctaagcccaaagaaacccaacaaggccagckccanncnggcggastanctacgactggtcccccgccgatctgcccatgctcggcgttgcctccattggtgccgccaagctctgcctcaccgccggagtcttgccctacccagctactccgactctgccaagatcgcctacgtcctccaaggcaaaggtatattcggcgtggttctcccggagcgaccaaggagaaggtcatctccgtcaaggaaggcgacgcgctggcgctccscttcggcgtcgtcacctggtggcacaacaacgccgacgccgc

SEQ ID NO: 2911 - DNA, 441 bp, Zea mays
  misc_feature: Ceres CLONE 280246-F
  misc_feature: Encodes the peptide sequence at SEQ ID NO. 2912
acggacaactctacccctccgcctcgaccctgaccccccacctcgtcggcgatgagttcctcttccaacggcgggaagaagccggctcccggsgcggccgcaggggtcccgccatccgcacgctcgctgacataagccgtgggcccaccggcttcccaggtgccggasgcgacacggcabbatcgacgacgagccacaggaatactacaccggtggcgagaagagtggaatgcttgttcaagatccaacaagaagaaatgatgtggatgcgatatttgaacaagccagacaagcgggtatcaaaggaatgcctcctcctcttgatggcgagtcttccagctctaggagctttacagggactggccgacttcttacaggggagacaatatcatctgctgcacctcaggaaccagtaccaattcgagtacgccacaatataca

SEQ ID NO: 2912 - protein, 70 aa, Zea mays
  misc_feature: Ceres CLONE 280246-F
MLVQDPTRRNDVDAIFEQARQAGIKGMPPPLDGESSSSRSFTGTGRLLTGETISSAAPQEPVPIRVRHNI

SEQ ID NO: 2913 - DNA, 843 bp, Zea mays
  misc_feature: Ceres CLONE 280265-R2
  misc_feature: Pfam Name: DS Pfam Description: Deoxyhypusine synthase
  misc_feature: SWISSPROT Homolog: EC 2.5.1.46 Deoxyhypusine synthase
  misc_feature (657)..(657): n is a, c, t, g, unknown, or other
cgtgagcattcctctcgtgtggacaatcgtgtgtctgtatttcaataaattatgtggtgtaacaaaagtgatatcacccatctagcacagtatcaagtgaatatcgaaaaatgatggtatgtgtgtgccgcgagtcaccgaaaaaatttgcacatgatccctgtgcaagagaagtagatctcgtgctccaaaaggtcatttggagagttcaacaaaattctgttgcccattctctccacagaatcccattcagtgtgttcatttggagatatgaaccttacgtgaaagtgttgctgcaacaaaaagcgaaaaagctatacttgtatcgatgtgcatctttacaggttgtgctgaacccttaatcttgccccgtgagagtgcttcatcggtgtgtgctccagaatcgctaccatcaatctcttgaggcgtgaatatatacacagtataatctgcaccattgcagaacatattgatattgcatatatgatgctgtggaaggtctccaccaagaactataatccgtgtcttccttggtggtgcgtgtatggtttccctatttatcacgcgtatatcttgcacagtgtcaataataaggccgggatcacgcactgtgtgacagaacaccgtgtctcccagtgccccatcagacaagtggtnggcagtacacgggggatgatacttcttgtatgcccaataaagataagagtttttcattttttattttctttgccgaggcgctatatccctctttcaagggcgccccaaatatttctcaaaaatattgcctccttgtaacccatttgcgccaaaagagttgacatgtaaacctatttcctaaaatct

SEQ ID NO: 2914 - DNA, 643 bp, Zea mays
  misc_feature: Ceres CLONE 280265-R
  misc_feature: SWISSPROT Homolog: EC 2.5.1.46 Deoxyhypusine synthase
  misc_feature (643)..(643): n is a, c, t, g, unknown, or other
acaattggtgactcgtattcccctcgaggtcgacggtatcgataagcttttttttttttttttttgtaagcagatgtttcgtctacaaaaaaatcgtaagcagacgactcggatggacaatcgtatgtctgtatttcaataaattatctgttgtaacaaaaatgctatcaaccagctagtacagcatcaagtgaacatcgaagaatgatggcatgtggttgccgcgagtcaccgaaaaaatttgcacatgatccctgtgcaagtgaagtagacctcgtgctccaaaaggtcatttggagagttcaacaaaattctgttgcccattcactccaccgaatcccattcagtctgttcatttggagttatgaaccttacgtgcaaatgttgctgcaacaagaagcgggaaagcgatacttgcatcgcaatgcacctttacaggttttgctgaacccttaatcttgccccatgagactgcttcatcggggtgtgctccagaatcgctaccatcaaactcttgagccgtgttaatatacacagcataatctgcaccattgcggaacatattggcattgcatatatgatgctttggaaggcctccaccaagaactataatccctgtcttccttggtgttgcatggatggn

SEQ ID NO: 2915 - DNA, 97 bp, Zea mays
  misc_feature: Ceres CLONE 280268-F
atcacaacgacaaaatatctcgccgttcccatggacatcgacctcttccccgacatcgaccttgacgccctcctcgcctccttctccggcgaccccg

SEQ ID NO: 2916 - DNA, 255 bp, Zea mays
  misc_feature: Ceres CLONE 280275-F
  misc_feature: Encodes the peptide sequence at SEQ ID NO. 2917
  misc_feature (71)..(71): n is a, c, t, g, unknown, or other
  misc_feature (176)..(176): n is a, c, t, g, unknown, or other
  misc_feature (186)..(186): n is a, c, t, g, unknown, or other
ayatctcctcacttcacaccactcccgccattgttsctgcgcctttctgcaccgccacacacaccccgctncaatccaatggcgcctcgcaagccgtcctcgcggtcgtggtcctcgccgcgcttctcccgctcgccctctctcgcgggctgcggcttggccaccaccgcgcccanccgcacycknakgccgcacggtcacgcaccgctcggaggtggcgcgtggtcctcggcccacgccaccttctacggcggc

SEQ ID NO: 2917 - protein, 84 aa, Zea mays
  misc_feature: Ceres CLONE 280275-F
  misc_feature (12)..(12): Xaa is any aa, unknown, or other
  misc_feature (58)..(58): Xaa is any aa, unknown, or other
  misc_feature (61)..(61): Xaa is any aa, unknown, or other
  misc_feature (62)..(62): Xaa is any aa, unknown, or other
ISSLHTTPAIVXAPFCTATHTPLQSNGASQAVLAVVVLAALLPLALSRGLRLGHHRAXPHXXAARSRTARRWRVVLGPRHLLRR

SEQ ID NO: 2918 - DNA, 478 bp, Zea mays
  misc_feature: Ceres CLONE 280281-F
  misc_feature: Translation starting site: 237
  misc_feature (287)..(287): n is a, c, t, g, unknown, or other
  misc_feature (381)..(381): n is a, c, t, g, unknown, or other
  misc_feature (413)..(413): n is a, c, t, g, unknown, or other
atagatgcaagadaagaaaagagaagagcctctgtggatagtggtgggtgctggatcactgggcggasagcttctcatatcggatcgatcgattaattaatatatactataaacatacaatcaattacatacatatacgccaagagaagaggaacgccggcccgtttcacttgtytccttcctccgatccctcccggcggccggccggttcgggcgtttttccccttttgtttcccatggaggacgccaagatggggaacggcgccaccatccgcgcggtgctcgcnatcctccagtggtggggattcaacstcacgtcatcatcatcaacaagtggatcttccagaaactggagttcaagttcccctgacggtgtcgtgngtccacttcatatgttcctcatcggagwctanatcgcgatcaaagtcctygagaacgaagccgctgatcgaggtggcctcggaggaccggtggagga

SEQ ID NO: 2919 - DNA, 193 bp, Zea mays
  misc_feature: Ceres CLONE 280283-F
  misc_feature (34)..(34): n is a, c, t, g, unknown, or other
  misc_feature (164)..(164): n is a, c, t, g, unknown, or other
atctccctgtttaatcaatccttcaagcgcaacngcctcctcctcgtcgtccggtcgtgagaagggatggcgggccgtggcaaggctatcggcgctggcgscggaagaaggcaacgtcgaggagctccaaggccggactccagttccccgtcggcaggattgcnaggttcctcaaggcgggcaagtacgcgga

SEQ ID NO: 2920 - DNA, 167 bp, Zea mays
  misc_feature: Ceres CLONE 280293-F
asatccagttcctgtgccgtcctcctcctcctcctcctcctccattccggccctctcgcccgtccgtctcctgcccgttccctggtcggaccacgagagccccggactgcgttcacctctgccttttgttcacccctgcacgcattctctgccgctcttgtctcgtg

SEQ ID NO: 2921 - DNA, 891 bp, Zea mays
  misc_feature: Ceres CLONE 280294-R
  misc_feature: Translation starting site: 253
  misc_feature: Pfam Name: p450 Pfam Description: Cytochrome P450
  misc_feature: SWISSPROT Homolog: EC 4.2.1.92 Hydroperoxide dehydratase
  misc_feature (1)..(1): n is a, c, t, g, unknown, or other
  misc_feature (731)..(731): n is a, c, t, g, unknown, or other
ncgattggtgaccgggccccccctcgaggtcgacggcatcgatattttttttttttttttttctttttttttttttttttttttttttttttttttttaaaaattacaaaacattttctcgtacaatataatacatatttatacataagttgcaatacaagagcacttacctagtatcttattaaagggacgaaactaagaaatgggaccctgtcacgtactcacgtccaaacatatatccatccgcagccaatgacgacacgccgggtggttcactccctgcccggaccggaggtagctttggagaccctggtgaaaacgacactgctgccgagcaggtccttgccgatgtcggcggtgaaggtgtcctaacggaggaagagctcgacgaggaaaagcctgccaacgagcaccacaaagttcttgccggggcactgcttgttgcccacggtggggttctcggtctcgcggccgttggaccactagacgtactgcagcaacttgctgccctcctcgccgaggaaccggccgggcacgaactccttggccgtggcgccgaacacgcgggggtccttggtggcgcacggctggtatccgaacagcatctcgcccttcttcacctggaacacggcgtcggggctctggacctgcaggtctttcttggcgtggacgtactggaacttgacgggcggatccaggagctaagactccccacgaccgacttggccagntccatcttctccacgccgcgagggtgaacttgccgccgggctcgagcacggggactcgaatctcagccagcagccgctcggggagcttctcgacgtcgctggcgactttggccacgatgcccgggaacacacctggaggccgccgtaactgttgaaagtg

SEQ ID NO: 2922 - DNA, 220 bp, Zea mays
  misc_feature: Ceres CLONE 280296-F
  misc_feature (138)..(138): n is a, c, t, g, unknown, or other
actcatacatttcgactctcaactcccaaggtccctttttttttctcgatctggaagcgccgcagtagcagccatggacgtgagcggagaggcggtaaggcgaagaagggcgcggcggggcgaaggccggcgggcgancgaagaagtcggtgtcgcggtcctccagggccgggctgcagttccccgtcagccgcgtcgggcgtacctcaaaaagggccgg

SEQ ID NO: 2923 - DNA, 407 bp, Zea mays
  misc_feature: Ceres CLONE 280317-F
  misc_feature: Encodes the peptide sequence at SEQ ID NO. 2924
  misc_feature (131)..(131): n is a, c, t, g, unknown, or other
  misc_feature (280)..(280): n is a, c, t, g, unknown, or other
gcatcgatctgacggcctttctacgcgcaacgacgaagcttcgcgaatcccctccttccttcggcctcaccttcttattctccgccgaacaagtcttagacgcctaatccgtagtttacatcccgaasggnaagggtgatccaggccgaccatggcttacgtcgagagaggtgttgtgaaagacaagcggactatatggcgactgagcataatctcagacttctttcgggctattgtcaacttcatcagaatcttctttgacaaactgttctcagtgganaaaactgacagctacaagaaagggtatggtgctggtaagaagtgggatggtggagctggtggtggtggtgggcggggccattatggaggtggaggtggtggatttggcgggcggaggtggaggtggt

SEQ ID NO: 2924 - protein, 85 aa, Zea mays
  misc_feature: Ceres CLONE 280317-F
  misc_feature (43)..(43): Xaa is any aa, unknown, or other
MAYVERGVVKDKRTIWRLSIISDFFRAIVNFIRIFFDKLFSVXKTDSYKKGYGAGKKWDGGAGGGGGRGHYGGGGGGFGGRRWRW

SEQ ID NO: 2925 - DNA, 324 bp, Zea mays
  misc_feature: Ceres CLONE 280318-F
  misc_feature: Encodes the peptide sequence at SEQ ID NO. 2926
ggagctggtgcagggtcaccttcccctcggcctcaagagctctgcstttgcygcggccaagggcgtccgtggagaagcgggacaggtggcggcgatggaagagcaaggcgccaggcggcgctcggatgggcggccagggacgactccggcgtctctccccctacagcttctccagaagggttcctaaagacgacgatgtcacgatcaaggtgctctactgcgggatctgccacaccgacctgcacgtcatcaagaacgactggcgaaacgccatgtacccagttgtcccggggcacgagatcgtgggcgtggtgaccggcgtcg

SEQ ID NO: 2926 - protein, 66 aa, Zea mays
  misc_feature: Ceres CLONE 280318-F
  misc_feature (22)..(66): Pfam Name: ADH_N Pfam Description: Alcohol dehydrogenase GroES-like domain
  misc_feature: SWISSPROT Homolog: EC 1.1.1.255 Mannitol dehydrogenase
  misc_feature: The sequence is a functional homolog of SEQ ID NO 2 in US patent 7288696
MGGQGRLRRLSPYSFSRRVPKDDDVTIKVLYCGICHTDLHVIKNDWRNAMYPVVPGHEIVGVVTGV

SEQ ID NO: 2927 - DNA, 296 bp, Zea mays
  misc_feature: Ceres CLONE 280332-F
  misc_feature (181)..(181): n is a, c, t, g, unknown, or other
  misc_feature (274)..(274): n is a, c, t, g, unknown, or other
aggacccaaatactctctccattgcttcccttccaaacaggtgtaggaagcaagatcgatcgatcgagagaacaaaacaaaagggtatctgcagttcctgcatatatagatatggcgccggcksgtctggctctgagtctgctcctcgcgttcctggcgatcgggccctggcgccgccganagcatcgacctgtggccgatscgcagtcgggtgtcgcacgggacgcagaagctytacgtcaagaaggacatcaccatgtcgatggtggggagnacgtactccgacgagaaatcga

SEQ ID NO: 2928 - DNA, 102 bp, Zea mays
  misc_feature: Ceres CLONE 280338-F
  misc_feature: Encodes the peptide sequence at SEQ ID NO. 2929
  misc_feature (61)..(61): n is a, c, t, g, unknown, or other
  misc_feature (69)..(69): n is a, c, t, g, unknown, or other
gccttggagtgctagattctgtttccattgtccattctcagtcacctgagcagccgaacgncctcagtnacctgcaggtcaggaaccaacgatgccgggtat

SEQ ID NO: 2929 - protein, 33 aa, Zea mays
  misc_feature: Ceres CLONE 280338-F
  misc_feature (20)..(20): Xaa is any aa, unknown, or other
  misc_feature (23)..(23): Xaa is any aa, unknown, or other
LGVLDSVSIVHSQSPEQPNXLSXLQVRNQRCRV

SEQ ID NO: 2930 - DNA, 504 bp, Zea mays
  misc_feature: Ceres CLONE 280418-F
  misc_feature: Encodes the peptide sequence at SEQ ID NO. 2931
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcga

SEQ ID NO: 2931 - protein, 101 aa, Zea mays
  misc_feature: Ceres CLONE 280418-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRWRRRRPCRASARGAARSRPSPTSCTSRRA

SEQ ID NO: 2932 - DNA, 535 bp, Zea mays
  misc_feature: Ceres CLONE 280463-F
  misc_feature: Translation starting site: 85
  misc_feature: SWISSPROT Homolog: EC 2.3.1.74 Naringenin-chalcone synthase
  misc_feature: SWISSPROT Homolog: EC 2.3.1.95 Trihydroxystilbene synthase
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcannntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcgaggccgcgcttcccgggcggcgacctgcacct

SEQ ID NO: 2933 - DNA, 170 bp, Zea mays
  misc_feature: Ceres CLONE 280477-F
tcgattcgcccagggcaatattccccccggaccaaactagatcagcgaaacccactccgctctcccgagatcggacacatggcggcggcggcagtgacgtccaacggcggcgcagtggccgckkaacgggccggcgcccggcaggctggcctccgtgtacagcgaggtgc

SEQ ID NO: 2934 - DNA, 496 bp, Zea mays
  misc_feature: Ceres CLONE 280538-F
  misc_feature: Encodes the peptide sequence at SEQ ID NO. 2935
  misc_feature (125)..(125): n is a, c, t, g, unknown, or other
ccaaataaacacaccmacccggtcgctccgctccaccgttccgccctcgaccgcgcgcgagctcctcaaacccttmaagacctcggcctcccaccgcttccgtagcctcgcgccctcgcctcgyntcgcctcgtccttctcctccgtcccaaccatgagggagatcctgcacatccagggcgggcagtgcgggaacagatcggtgccaagttctgggaggtgatctgcgacgagcacggcatcgaccacacgggcaagtacgccggcgactccgacctccagctcgagcgcatcaacgtctactacaatgaggccggcgggggccgttttcgtcccgcgcgccgtgctcatggacctcgagcccggcaccatggactccgtgcgctccggcccctacggccagatcttccgccccgacaacttcgtcttcggccagtccggcgccggcaacaactgggccaagggcactacaccgagggcgccgagctcatcgact

SEQ ID NO: 2935 - protein, 63 aa, Zea mays
  misc_feature: Ceres CLONE 280538-F
MRPAGAVFVPRAVLMDLEPGTMDSVRSGPYGQIFRPDNFVFGQSGAGNNWAKGTTPRAPSSST

SEQ ID NO: 2936 - DNA, 448 bp, Zea mays
  misc_feature: Ceres CLONE 280539-F
  misc_feature: Encodes the peptide sequence at SEQ ID NO. 2937
atctcgtcttaggtagcggccgaaccagagccccgtcccaactccaccacctctcttctctacggcgcgaswagggcggcgcggccgggcgtcggcgggaaccgggcctcgctctcctcatctctccgatcacttctgtcttgtgaaaatggcggatgaactatgctcaatgtctgtgggtcagaagttccatgggcagtccgtgctgttgagcagaatttcttcctattctgccatgaacaaccctgtattcaacaatgcctattctgcttacaatgtgccccagaggtcatatcatgggatgaatgcaactgctggactctcatctgtcatsgcaccatctcctgtctttgcttctgccccaaaagagaaaggcttttctggatttatgatcgactttatgatgggtggagtttctgctgctgtctccaagacagctgcagctccg

SEQ ID NO: 2937 - protein, 100 aa, Zea mays
  misc_feature: Ceres CLONE 280539-F
  misc_feature (62)..(62): Xaa is any aa, unknown, or other
MADELCSMSVGQKFHGQSVLLSRISSYSAMNNPVFNNAYSAYNVPQRSYHGMNATAGLSSVXAPSPVFASAPKEKGFSGFMIDFMMGGVSAAVSKTAAAP

SEQ ID NO: 2938 - DNA, 409 bp, Zea mays
  misc_feature: Ceres CLONE 280571-F
  misc_feature: Encodes the peptide sequence at SEQ ID NO. 2939
  misc_feature (51)..(51): n is a, c, t, g, unknown, or other
  misc_feature (251)..(251): n is a, c, t, g, unknown, or other
atcctctccatgtaggccgcgggattccgtgtccctctccaatccggcgtnrtcgttcgccggatacaggatccggtccccgcgatggagccctcaccaacctcctcctcgccggctgtggcgcgccggttgtcgccggagtaaggagggtgccgaagcgggcgctggaggagttgttggagcaggtccagcgggctgttgagatgctgcgcgatgccgacgctgatctcgccatctctctctcggagganaccgcagcagcctcgccggacgcgaggwaccgcaagacgatgttggtgtcgatggaaatggcatggcgacgtcgtcggttgcragtgactccgattacgagacgacgcaatgtgtraccttcttaaatctaaggttggatcactcgagttccttcaaa

SEQ ID NO: 2939 - protein, 121 aa, Zea mays
  misc_feature: Ceres CLONE 280571-F
  misc_feature (17)..(17): Xaa is any aa, unknown, or other
  misc_feature (83)..(83): Xaa is any aa, unknown, or other
  misc_feature (93)..(93): Xaa is any aa, unknown, or other
  misc_feature (111)..(111): Xaa is any aa, unknown, or other
PLHVGRGIPCPSPIRRXRSPDTGSGPRDGALTNLLLAGCGAPVVAGVRRVPKRALEELLEQVQRAVEMLRDADADLAISLSEXTAAASPDARXRKTMLVSMEMAWRRRRLXVTPITRRRNV

SEQ ID NO: 2940 - DNA, 389 bp, Zea mays
  misc_feature: Ceres CLONE 280579-F
  misc_feature: Encodes the peptide sequence at SEQ ID NO. 2941
  misc_feature (35)..(35): n is a, c, t, g, unknown, or other
  misc_feature (303)..(303): n is a, c, t, g, unknown, or other
  misc_feature (304)..(304): n is a, c, t, g, unknown, or other
acgagaaggccagggagacgtcttgcttctccttngctcgtctacctgcttcctagttgttccatcatccatggcgcgcttcgcctccgctgtcctcttcgccgctgtcctgctcatggctggacggctgacccatgcggggccgtcgacggcgaggtgctttggcggcgcgcagtcctgccgggctccgcgtgccgaacgccgtcctccggctcctacgcccctatagccacttcgtaagcgaascaatgccgaggwkrccgggcgatccaacgctccgttcaactaccataaytacaagcnncctctgcgactgcgacctcacctccaggtgaccgcagtgaagcagggctcgctggtggcagcggcgcgagakatgacacgccgtt

SEQ ID NO: 2941 - protein, 66 aa, Zea mays
  misc_feature: Ceres CLONE 280579-F
  misc_feature (38)..(38): Xaa is any aa, unknown, or other
  misc_feature (42)..(42): Xaa is any aa, unknown, or other
  misc_feature (54)..(54): Xaa is any aa, unknown, or other
  misc_feature (57)..(57): Xaa is any aa, unknown, or other
MRGRRRRGALAARSPAGLRVPNAVLRLLRPYSHFVSEXMPRXPGDPTLRSTTIXTSXLCDCDLTSR

SEQ ID NO: 2942 - DNA, 391 bp, Zea mays
  misc_feature: Ceres CLONE 280599-F
  misc_feature: Translation starting site: 161
  misc_feature (145)..(145): n is a, c, t, g, unknown, or other
  misc_feature (153)..(153): n is a, c, t, g, unknown, or other
ctcttcgcttctaactccgctgggccaccavtttgaccgccgcctcccttcccctccgctactgctcctccccaccccactcccccgcagagcgcggcgcggcggcgaggtcgtaccccacatcggcgagcggcggcgcaccgcnagggcaanaggcaagatgttcgggcgcgcgccgaagaagagcgacaacaccaagtactacgagatcctcggggtgcccaagtcggcgtcccaggacgatctcaagaaggcctaccgcaagctgctatcaagaaccaccccgacaaggcgggtgaccccgagaagttcaaggagctcgcacaagcctatgaggttttragtgatccagaraaacgtgagatttatgatcagtatggtgaagatgccc

SEQ ID NO: 2943 - DNA, 855 bp, Zea mays
  misc_feature: Ceres CLONE 280614-R
tcgaggtcgacggtatcgataagcttttttttttttttttttgccgagaacttcattgctctttgctatagctatgcttactgtacagaaggccaacacccgactagcatcatgcatgtgtgcgatgacctactctacagaagccggaacatgatctacaactctctaatcagacagtgctgacagaacatgtagactactacttccacctcccccggacacgatgtctgggccctctccccacggatacggacggcgagctggatgcccttggccctgatggcgacgcacttggtgcgagtcgggcagacttcgtctcccaccaagagccgacgaagtaggactcggacgactcctgtttcgcggcaacggcggagttctggaactggaggtcgaccttgaaggcttggacgatatcccgctccattcgctggaacggcagcttgcgcatcatcagcccccggctcttctgcctattgcggcactcaccgacctcgacggtgccggggtcttaaaacgtcgtgatttcttccctccggcggacgccagcgcgaattctgcgttccgccctcggaggccaattgctcccttgagtcgttgccgcgggtgcacttccacgaccatggatgagtgcgggccatcgcccccctgacgatggggcataggctgtgtttcaaactaccacccgctggcaaagatgttagggaacccgcacaccccctgtttttcaaccaggtggtccatggcaagctccttcgcagataccgccccccgggggatctatagtccctgaggggacgcccccgggacgaacatccacttttcgtcccattaaggaggttaacccggcccgtg

SEQ ID NO: 2944 - DNA, 482 bp, Zea mays
  misc_feature: Ceres CLONE 280635-F
  misc_feature: Translation starting site: 57
  misc_feature (92)..(92): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (143)..(143): n is a, c, t, g, unknown, or other
attactgtgcctttatcttcaacccaaaccatccattaccatattcctaagctatcatggtgcaccggacttccatagccgatgtgcatgtnatgtgcatggatctaagcccaaagaaacccaacaaggccagckccannncnggcggasttactacgactggtcccccgccgatctgcccatgctcggcgttgcctccattggtgccgccaagctctgcctcaccgccggagtcttgccctacccagctactccgactctgccaagatcgcctacgtcctccaaggcaaaggtatattcggcgtggttctcccggagcgaccaaggagaaggtcatctccgtcaaggaaggcgacgcgctggcgctccccttcggcgtcgtcacctggtggcacaacaacgccgacgccgctatctccgacctcgtggtgctcttcctcggcgacacctccacgggccacaagccgggccaatttcacaaa

SEQ ID NO: 2945 - DNA, 487 bp, Zea mays
  misc_feature: Ceres CLONE 280648-F
  misc_feature: Encodes the peptide sequence at SEQ ID NO. 2946
  misc_feature (150)..(150): n is a, c, t, g, unknown, or other
  misc_feature (359)..(359): n is a, c, t, g, unknown, or other
  misc_feature (360)..(360): n is a, c, t, g, unknown, or other
  misc_feature (362)..(362): n is a, c, t, g, unknown, or other
atcggaatcaatcgtgtttctcgcctccacgccgagaccaatccagccaccgccaactctttgcctcgcctctccgattcgagggaacgatggagtgcgtcaccgatatgcccctcgcgacgctggacagccgaccgcgcawkcaagcgncttcgggtgggacgtcgttcccgccgagatgtatcaggttacgcggccgsggcttggttgggacgtcggccccgccagattgaatcagtttgcactttgtggacaagaagttgtgaatgccttcagtgctgcagtgttgggcctatcttcaggttgtgtttcttctcaagtcaaccaagagcagcctcatgatggttcccctcctcthnnhnaagatgacaagaatgggcattatgtttttgctgttggagataatctcacatctcgctataagatcaatgcaaaaatgggagaaggtacctttggtcaggtgttggagtgttgggataagggaaac

SEQ ID NO: 2946 - protein, 103 aa, Zea mays
  misc_feature: Ceres CLONE 280648-F
  misc_feature: SWISSPROT Homolog: EC 2.7.12.1 Dual-specificity kinase
  misc_feature (8)..(8): Xaa is any aa, unknown, or other
  misc_feature (61)..(61): Xaa is any aa, unknown, or other
  misc_feature (62)..(62): Xaa is any aa, unknown, or other
MYQVTRPXLGWDVGPARLNQFALCGQEVVNAFSAAVLGLSSGCVSSQVNQEQPHDGSPPLXXDDKNGHYVFAVGDNLTSRYKINAKMGEGTFGQVLECWDKGN

SEQ ID NO: 2947 - DNA, 485 bp, Zea mays
  misc_feature: Ceres CLONE 280649-F
  misc_feature: Translation starting site: 141
  misc_feature (459)..(459): n is a, c, t, g, unknown, or other
acaaacctctcctggcacgagatcacgcttctcgttggatcgaacagctagggtttccaagatgtttcgggcgcgcgcgaagaagagcgacaacacacggtactacgagatcctcggggtctccaaggacgcgtcccaggatgacctcaagaaagcctaccgcaagccgccatcaagaaccaccccgacaaggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaagggggagaggatgtggttcatcctctaaaggtttctctggaggatttntacaatggcacatcaaagaagctctc

SEQ ID NO: 2948 - DNA, 367 bp, Zea mays
  misc_feature: Ceres CLONE 280650-F
  misc_feature: Pfam Name: C2 Pfam Description: C2 domain
  misc_feature (63)..(63): n is a, c, t, g, unknown, or other
ccctctgttccgcttgattccagtggccctgcttccctcgtcgccactctctctcgagagcwncaccggcacttcggacaggagttgaaaagcaaaggtgtgttcttgtcatggagcagccgcagcagcagaagggagtagcggtctctgcgcaggcggcggccgcgaacgggaccaagggcgcggactgatcgggtacgtcgacgtgctcgtgcggacgcscgggacatccagaacatctgcatctaccacaagcaggacgtgtacgcgcggctctcgcccccggggacggcgcgccggcggytcccacgcaggtgttcaacggcgggggccgcaacccggtgttcgaccagtcgctgcgcctcgg

SEQ ID NO: 2949 - DNA, 208 bp, Zea mays
  misc_feature: Ceres CLONE 280654-F
acccacccacccacccactcctttccccaacccatggccgccgcgccgccggacccgggaggagatggtctacatggccaagctagcggmsaggcggasggtacgaggagatggtggagttcatggagaaggtcgcggccgccgcsagctcaccgtcgaggagcgcaacctgctctccgtcgcctacaagaacgtcatcggcgcgcgc

SEQ ID NO: 2950 - DNA, 493 bp, Zea mays
  misc_feature: Ceres CLONE 280667-F
  misc_feature: Encodes the peptide sequence at SEQ ID NO. 2951
  misc_feature (198)..(198): n is a, c, t, g, unknown, or other
tcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagndtgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacg

SEQ ID NO: 2951 - protein, 77 aa, Zea mays
  misc_feature: Ceres CLONE 280667-F
  misc_feature: SWISSPROT Homolog: EC 2.3.1.74 Naringenin-chalcone synthase
  misc_feature (38)..(38): Xaa is any aa, unknown, or other
MVSSSMDTTSDKRASSMLAPNPGKATILALGHAFPQQXVMQDYVVDGFMKNTNCDDPELKEKLTRLCKTTTVRLGTW

SEQ ID NO: 2952 - DNA, 485 bp, Zea mays
  misc_feature: Ceres CLONE 280718-F
  misc_feature: Encodes the peptide sequence at SEQ ID NO. 2953
  misc_feature (2)..(2): n is a, c, t, g, unknown, or other
  misc_feature (262)..(262): n is a, c, t, g, unknown, or other
antcttacctagccttgctgagccccttgcagtgctgggaggagaaggacaaggtctctgatcagctcagcttgtctggtcaaagctgagagcctcgmytgtgctgtgagtgcaagctcgaccgacagacccctgccactgtgaagcacagcgtcascgacaagacgaaggggcggaagctgccaagccgatagatctacgcaaattggagaccaaggacgtgtcgccgctcgccgccgccaccaccacyaccgcggcgcyntgcctgcaccgacctctcaaccgcctccgccggccccttcttctatggcgccgcgcagcaccagcaccagcaccatccgccgccgccgttcgcgcmsaggcgccccggttccgtcgcctgcygcgtccatgcccggcggcatgcggctctcgttcgaccagatgtccgggaaggcgcccggggagcagcaccaccactccgcgcccatgctgtacacggtgcc

SEQ ID NO: 2953 - protein, 31 aa, Zea mays
  misc_feature: Ceres CLONE 280718-F
MPGGMRLSFDQMSGKAPGEQHHHSAPMLYTV

SEQ ID NO: 2954 - DNA, 507 bp, Zea mays
  misc_feature: Ceres CLONE 280724-F
  misc_feature: Translation starting site: 234
  misc_feature: SWISSPROT Homolog: EC 2.7.10.2 Non-specific protein-tyrosine kinase
  misc_feature (221)..(221): n is a, c, t, g, unknown, or other
  misc_feature (392)..(392): n is a, c, t, g, unknown, or other
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgckacaacggaactggcatggtcaaggctgggttcgccsgckacgacgccccgagggccgtcttccccagcatcgtggggcgcccgcncacactggtgtcatggtcgggatggggcakaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcktnggctcccgaggagcaccccgtcctcctcaccgaggcgcccctgaaccccaaggctaacagggagaagatgacccagatcatgttcgagaccttcaacacccccgctatgtacgtc

SEQ ID NO: 2955 - DNA, 1136 bp, Zea mays
  misc_feature: Ceres CLONE 280727
  misc_feature: Encodes the peptide sequence at SEQ ID NO. 2956
acactttccaaaccctaggcaccacccattatattgatcgatctatgctgctgctggtcgcaaacgcaccgcagattcacgggccgccctctcccaaaaatcgagcaccagagtgtttcaattccttctccatatattgttggtgttagtttcctgctttccctagtccctcgcaatcaacagatacctcatggacgatcaggagaacgagcacgagaagcatgctgatgctgggactgacatcgacgaagaagaggaggacgaagatggccacaagcgtgtcgtcgttcttggaccccaagtccccctcaaggaacagctcgagcttgacaaggatgatgagagcctgaggaggtggaaggagcaactcctcgggcaagtcgacaccgagcagctcggagagactgcggagccggaggtgaaggtgctcaacctgaccatcctgtcaccggggcggccagatctagtgctaccgatcccgttcgaggccgacgacaagggctatgcgtttacgctcaaggatggcagcctctatagcttccgtttctccttcaccgtctccaacaacatcgtttcaggcctcaagtacaccaacacggtctggaagactggagtcaaagtggagaaccagaaaatgatgctagggacattcagtccccagcaagagccgtacgtttacgagggtgaagaagagaccacacctgctggcatcttcgcaagaggttcctattctgctaagctaaagttttttgatgatgatggcaagtgttatttggagacgagttactactttgagattagaaaagagtggccagggccagcaacctaatgatatggagcggcggtgttgcattggattcgttaaatgcatacatgttagaactcttagttaagacaagcagaagatctattatattctactgcttctagctagaggatgattgcttcacatgcatatcgtgcatgtttaaccaccgtacgtacgtataatttgtttcgagtccattattctacgctatcgatctgttgcgtattattattgttaattcacattatagaatcagtcgtgtatgaagattcaaagatatatttatatacttatgacctttttattgaacgaaaaaaaaaaaaaaaaa

SEQ ID NO: 2956 - protein, 212 aa, Zea mays
  misc_feature: Ceres CLONE 280727
  misc_feature (1)..(209): Pfam Name: Rho_GDI Pfam Description: RHO protein GDP dissociation inhibitor
MDDQENEHEKHADAGTDIDEEEEDEDGHKRVVVLGPQVPLKEQLELDKDDESLRRWKEQLLGQVDTEQLGETAEPEVKVLNLTILSPGRPDLVLPIPFEADDKGYAFTLKDGSLYSFRFSFTVSNNIVSGLKYTNTVWKTGVKVENQKMMLGTFSPQQEPYVYEGEEETTPAGIFARGSYSAKLKFFDDDGKCYLETSYYFEIRKEWPGPAT

SEQ ID NO: 2957 - DNA, 448 bp, Zea mays
  misc_feature: Ceres CLONE 280752-F
  misc_feature: Encodes the peptide sequence at SEQ ID NO. 2958
  misc_feature (47)..(47): n is a, c, t, g, unknown, or other
gagaggcccccctcaacatcactgacaccaccaaagcacgggaaaknagaggaagcggacagagctttgtgggagcgtcaatggaaggwacttgggcgaagatggagcagaagggcgccggtccgggagcacggagctcccacgccatcacgctgctcgggggcacggcctactcgttcggcggcgagctcaccccgcgcgtcccggtggacagcaccatgtacgccttcgacctcaacacccagacgtggtcggcgctggacgcgacgggcgaygtgccgccgccgcgcgtgggcgtgaccatggcggccgcakgcacggtgttcacgttcggcgggcgckacctggagcacaaggagctgaacgagctctacgctttcgacgcggcggccgggcttggacsctgctgtcgtccggcgccgacgcccgccgcaccgcagcttaccac

SEQ ID NO: 2958 - protein, 122 aa, Zea mays
  misc_feature: Ceres CLONE 280752-F
  misc_feature: SWISSPROT Homolog: EC 3.1.3.16 Phosphoprotein phosphatase
  misc_feature (79)..(79): Xaa is any aa, unknown, or other
  misc_feature (88)..(88): Xaa is any aa, unknown, or other
  misc_feature (108)..(108): Xaa is any aa, unknown, or other
MEGTWAKMEQKGAGPGARSSHAITLLGGTAYSFGGELTPRVPVDSTMYAFDLNTQTWSALDATGDVPPPRVGVTMAAAXTVFTFGGRXLEHKELNELYAFDAAAGLGXCCRPAPTPAAPQLT

SEQ ID NO: 2959 - DNA, 409 bp, Zea mays
  misc_feature: Ceres CLONE 280753-F
  misc_feature: Encodes the peptide sequence at SEQ ID NO. 2960
atccccccgcgtagagagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtkacccccgcgtcgccgtctggcaagaagaccctccgcaaggcacagcggtcatcaccggcgcgtcgtccggcctcgg

SEQ ID NO: 2960 - protein, 95 aa, Zea mays
  misc_feature: Ceres CLONE 280753-F
  misc_feature: SWISSPROT Homolog: EC 1.3.1.33 Protochlorophyllide reductase
MALQAATSFLPSALSARKEGSVKDSASFLGVRLAADGLKLDTTALGLRTVRVSRSADIRAQTAAVSSPSVTPASPSGKKTLRKAQRSSPARRPAS

SEQ ID NO: 2961 - DNA, 324 bp, Zea mays
  misc_feature: Ceres CLONE 280776-F
  misc_feature: Encodes the peptide sequence at SEQ ID NO. 2962
  misc_feature (52)..(52): n is a, c, t, g, unknown, or other
  misc_feature (273)..(273): n is a, c, t, g, unknown, or other
aatcctctccgtgtaggccgcgggattccgtgtccctctccaatccggcgtnrttcgtcgccggatacaggatccggtccccgcgatggagccctcaccaacctcctcctcgccggctgtggcgcgccggttgtcgccggagtaaggagggtgccgaagcgggcgctggaggagttgttggagcaggtccagcgggctgttgagatgctgcgcgatgccgacgctgatctcgccatctctctctcggaggagaccgcagcagcctcgccggancgagaccgcaagacgatgttggtgtcgatggagatggcatggcgacgtcgt

SEQ ID NO: 2962 - protein, 108 aa, Zea mays
  misc_feature: Ceres CLONE 280776-F
  misc_feature (18)..(18): Xaa is any aa, unknown, or other
  misc_feature (91)..(91): Xaa is any aa, unknown, or other
NPLRVGRGIPCPSPIRRXSSPDTGSGPRDGALTNLLLAGCGAPVVAGVRRVPKRALEELLEQVQRAVEMLRDADADLAISLSEETAAASPXRDRKTMLVSMEMAWRRR

SEQ ID NO: 2963 - DNA, 189 bp, Zea mays
  misc_feature: Ceres CLONE 280797-F
aaaagggaatatccacagacctctctgtctctccctctcccgtgggtagcagggtgggtagctctcctcctcctcctccccctccccggccgtggtcttgggtatggaggagaatcaagagaagtttgctccggagagcagcgcgcgacggtggtggctcggtgagaacgatctgcgtcttctgcggca

SEQ ID NO: 2964 - DNA, 474 bp, Zea mays
  misc_feature: Ceres CLONE 280813-F
tcttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccccttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgc

SEQ ID NO: 2965 - DNA, 505 bp, Zea mays
  misc_feature: Ceres CLONE 280817-F
  misc_feature: Translation starting site: 415
  misc_feature: SWISSPROT Homolog: EC 2.3.1.74 Naringenin-chalcone synthase
  misc_feature: SWISSPROT Homolog: EC 2.3.1.156 Phloroisovalerophenone synthase
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcgagg

SEQ ID NO: 2966 - DNA, 725 bp, Zea mays
  misc_feature: Ceres CLONE 280864-R
acaattgggtaccgggccccccttcgaggtcgacggtatcgatattttttttttttttttttgcccacaagaacgacgtgatttttattatatttgccttccaatacaatcaaggtcaaataccgatccttacaaacattcatccacagggagctgcatgcagttctaaaactaacatagcactgcaatcacaataaaacgttcacaacactacacaactaaaatcctatacatcatttgacagagctgatataatttctacagatgtcactaaccctgcatatctacaggtctacacacaatctgtgacaaagctgctacagttggtccctacttgtcgttcaacaaaaaatcaatttttgcgactccccataacgtgagggagtctcaatctctccaaacaagcaacagtgtttggtctcgagtgttgaaagcctactgcccctgcagcatcctactttctactccctggttcacatcacagaggaagtctcccaacttcattttgatcttgccgcccctgggaaaccagcctttttccccaataaacccttaagcaccctcctgcagggtgggtaactttcaacacctcccttggcggggatgggaagacccctttggcataaggaacaaaaagtgctggaaacacgaacaacaaaaccttgtcgtcctgtggttactctttctggatactagaatgaccgccccccagtgcgaaacacata

SEQ ID NO: 2967 - DNA, 485 bp, Zea mays
  misc_feature: Ceres CLONE 280865-F
  misc_feature: Encodes the peptide sequence at SEQ ID NO. 2968
attaatatcgccgcggcctcgcacctccatctgttctatatcgccccattgctcgctcgctcgccaagagttcttcttgttaggcaaggcaaaagcagaagcaaaaaaagaaaggaaaaagaaaggtcttgttgccgatggggagctcagggttctcgtggacgcttccggaccaccccaagctccccaaggggaaaccggtggctgtcgtcgtgctggacggatggggcgaggccaaccccgatcagtacaactgtatccatgtcgctcagactcctgtcatggactcgctaaagaatggcgctcctgagaaatggagactagtgaaggctcatggaacagctgtgggtctcccatctgatgatgacatgggcaacagtgaagttggtcacaatgcacttggtgctggtcgaattttcgcccaaggtgctaagcttgtcgatcaagctcttgcctccggaaagatttatgatsgagatgggttc

SEQ ID NO: 2968 - protein, 116 aa, Zea mays
  misc_feature: Ceres CLONE 280865-F
  misc_feature (18)..(116): Pfam Name: iPGM_N Pfam Description: BPG-independent PGAM N-terminus (iPGM_N)
  misc_feature: SWISSPROT Homolog: EC 5.4.2.1 Phosphoglycerate mutase
  misc_feature (113)..(113): Xaa is any aa, unknown, or other
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDXDGF

SEQ ID NO: 2969 - DNA, 274 bp, Zea mays
  misc_feature: Ceres CLONE 280906-F
  misc_feature: Encodes the peptide sequence at SEQ ID NO. 2970
  misc_feature (33)..(33): n is a, c, t, g, unknown, or other
  misc_feature (217)..(217): n is a, c, t, g, unknown, or other
gtggatcatcatcatcagaagcagcagcaaggnaacatgtcccagcacggyggcctcggcgacacgscccggcggtggcgcgactccacggcgacggcggctgggcgggaatgctggacccgctggacctcgacctgcggcgcaccgtgctccgctacggcgagatggcgcaggcgacctacgacgccttcaacaacgagcgggcgtcgcgcacgcnggctgtcccgcttcgccagggcgcgcttcttcgaccgggtgcggctgccggcgcacg

SEQ ID NO: 2970 - protein, 90 aa, Zea mays
  misc_feature: Ceres CLONE 280906-F
  misc_feature (11)..(11): Xaa is any aa, unknown, or other
  misc_feature (17)..(17): Xaa is any aa, unknown, or other
  misc_feature (22)..(22): Xaa is any aa, unknown, or other
  misc_feature (72)..(72): Xaa is any aa, unknown, or other
GSSSSEAAARXHVPARXPRRHXPAVARLHGDGGWAGMLDPLDLDLRRTVLRYGEMAQATYDAFNNERASRTXAVPLRQGALLRPGAAAGA

SEQ ID NO: 2971 - DNA, 307 bp, Zea mays
  misc_feature: Ceres CLONE 280917-F
  misc_feature: Encodes the peptide sequence at SEQ ID NO. 2972
  misc_feature (141)..(141): n is a, c, t, g, unknown, or other
atacatttcgactctcaactcccaaggtcccttttctctctcttcctcgatctggaagcgccgcagtagcagccatggacgtgagcggasaggcggtaaggcgaagaagggcgcggcggggcgcaaggtccggcgggcgancgaagaagtcggtgtcgcggtcctccagggccgggctgcagttccccgtcagccgcgtcgggcggtacctcaaaaagggccggtacgcgcrkttaaggcacgggtgccccgtctacctcgccgccgtcctggagtacctcgcggccgaggtgctcgagctcgccgg

SEQ ID NO: 2972 - protein, 77 aa, Zea mays
  misc_feature: Ceres CLONE 280917-F
  misc_feature (6)..(6): Xaa is any aa, unknown, or other
  misc_feature (23)..(23): Xaa is any aa, unknown, or other
  misc_feature (53)..(53): Xaa is any aa, unknown, or other
MDVSGXAVRRRRARRGARSGGRXKKSVSRSSRAGLQFPVSRVGRYLKKGRYAXLRHGCPVYLAAVLEYLAAEVLELA

SEQ ID NO: 2973 - DNA, 436 bp, Zea mays
  misc_feature: Ceres CLONE 280922-F
  misc_feature: Encodes the peptide sequence at SEQ ID NO. 2974
  misc_feature (218)..(218): n is a, c, t, g, unknown, or other
  misc_feature (370)..(370): n is a, c, t, g, unknown, or other
aggatcatcatcatcagaagcagcagcaaggcaacatgtctcagcacggcgggcctcggcgacacggcccggcggtggcgcgactccacggcgacggcggctgggcgggaacgctggacccgctggacctcgacctgcggcgcaccgtgctccgctacggcgagatggcgcaggcgacctacgacgccttcaacaacgagcgggcgtcgcgcacgcgnggctgtcccgcttcgccagggcgcgcttcttcgaccgggtgcggctgccggcgcacgsscgcgttaccgggtcaccaggttcctgtacgccacgtcgtcggtggccgtgcggacgccttcatcctcaggtccgtgtccaggtcgcgccggtncagggagtccaactggatcggctacgtcgcggtggccaccgacgaagggaaggccgcgctcggcgc

SEQ ID NO: 2974 - protein, 133 aa, Zea mays
  misc_feature: Ceres CLONE 280922-F
  misc_feature (81)..(81): Xaa is any aa, unknown, or other
  misc_feature (112)..(112): Xaa is any aa, unknown, or other
MSQHGGPRRHGPAVARLHGDGGWAGTLDPLDLDLRRTVLRYGEMAQATYDAFNNERASRTRGCPASPGRASSTGCGCRRTXALPGHQVPVRHVVGGRADAFILRSVSRSRRXRESNWIGYVAVATDEGKAALG

SEQ ID NO: 2975 - DNA, 342 bp, Zea mays
  misc_feature: Ceres CLONE 280926-F
  misc_feature: Encodes the peptide sequence at SEQ ID NO. 2976
  misc_feature (258)..(258): n is a, c, t, g, unknown, or other
  misc_feature (262)..(262): n is a, c, t, g, unknown, or other
  misc_feature (305)..(305): n is a, c, t, g, unknown, or other
agaaagagaaatatgcaggcggtggcacgggcggcgcgtgggctcgcggctgcggctgcggctgcgcggccgtcggcgacgaggcagggcaccgcgggcaggtgcagcaagctcggggcatcgtggtgcaggtgagggacgggaatctggagcgggcgctgtcgatcatggagcgcaggatgcggtccagcggcatggagcgcctcatccgggcgcgcacccattaccacgtcaaggactcggagaagcgcgtgctcncgknataggggcttatgcaacgcgtccgttcccaggagctcggcaanaagctccgcgagatcctcatcaagaagatcaggggcc

SEQ ID NO: 2976 - protein, 85 aa, Zea mays
  misc_feature: Ceres CLONE 280926-F
KEKYAGGGTGGAWARGCGCGCAAVGDEAGHRGQVQQARGIVVQVRDGNLERALSIMERRMRSSGMERLIRARTHYHVKDSEKRVL

SEQ ID NO: 2977 - DNA, 297 bp, Zea mays
  misc_feature: Ceres CLONE 280929-F
  misc_feature: Encodes the peptide sequence at SEQ ID NO. 2978
  misc_feature (211)..(211): n is a, c, t, g, unknown, or other
accaaaccctaccccttcgccgcgaccgsatcccccacatcgttggcgatgagctcctcctccaacagcgggaagaagccggcgcccgcyktccgcggggggcccaccatccgcacgctcgccgacataaaccgtggccctgccggtttcccaggtgccggasggcagcagcgatgacgacgagccccaggattactacaccggcggcganaagagtggaatgcttgttcaagatccaacaagaagaaatgacgtggatgcaatattggaacaagcaagacaggcgggcgctatcca

SEQ ID NO: 2978 - protein, 42 aa, Zea mays
  misc_feature: Ceres CLONE 280929-F
  misc_feature (15)..(15): Xaa is any aa, unknown, or other
  misc_feature (39)..(39): Xaa is any aa, unknown, or other
MSSSSNSGKKPAPAXRGGPTIRTLADINRGPAGFPGAGXQQR

SEQ ID NO: 2979 - DNA, 114 bp, Zea mays
  misc_feature: Ceres CLONE 280939-F
acgcacaccgcgacccagtccagagccagtacgtgcgamgcacgcacgctgctggtccgcgtacsagacgacggtcaggtcggccggtgcttttcagtttggaataatgacggc

SEQ ID NO: 2980 - DNA, 508 bp, Zea mays
  misc_feature: Ceres CLONE 280994-F
  misc_feature: Encodes the peptide sequence at SEQ ID NO. 2981
  misc_feature (312)..(312): n is a, c, t, g, unknown, or other
  misc_feature (313)..(313): n is a, c, t, g, unknown, or other
  misc_feature (316)..(316): n is a, c, t, g, unknown, or other
gcaaaccctagccgacctcttctcctcgcgccgccgccgctgccgccgtcgtcatgtcgaagcgcgggaggggagggacggcggggaacaagttccgcatgtcgctgggtctccccgtcgcagcgaccgtgaactgtgcggacaacacaggcgccaagaacctctacatcatctccgtcaagggcatcaagggtaggctcaaccgcctgccgtccgcctgcgtcggcgacatggtcatggccaccgtcaagamgsggtaagcccgacctcaggaagaaggtcatgcccgccgtcatcgtccgccagcgcaanntgngcgccgcaaggacggagtctacatgtacttcgaagataatgctggagtcattgtgaaccccaagggcgagatgaaaggatctgctatcactggacctattggcaaggagtgcgctgacctttggcctaggattgctagtgcagcaaatgctattgtctgatgctactggttgggaggctggttgagatagtt

SEQ ID NO: 2981 - protein, 66 aa, Zea mays
  misc_feature: Ceres CLONE 280994-F
MSKRGRGGTAGNKFRMSLGLPVAATVNCADNTGAKNLYIISVKGIKGRLNRLPSACVGDMVMATVK

SEQ ID NO: 2982 - DNA, 496 bp, Zea mays
  misc_feature: Ceres CLONE 281011-F
  misc_feature: Translation starting site: 290
akttttyatttaccacaccctgctctcgctcttgttgtgacggtcgattcgcttgtacaaggtagcaaccttgagatccagccaagatccagccataagggagattctccacatccagggtggacagtgcggcaaccagatcggttccaagttctgggaggtcgtctgckacgagcatggtatcgaccccaccggacgctatgtcggcacctccgacctccagctcgagcgcgtcaatgtctactacaacgaggcctcatgcggccgcttcgtgccgcgcgctgtgctcatggacctcgagcccggcaccatggacagcgtcgcaccgggccgtacggacagatcttccggcccgacaacttcgtcttcggccagtctggtgcagggaacaactgggccaagggcactacacagagggcgctgagctcatcgactctgtgcttgacgtcgtgaggaaatakgcggagaactgcgactgccttcaaggattccaagt

SEQ ID NO: 2983 - DNA, 510 bp, Zea mays
  misc_feature: Ceres CLONE 281038-F
  misc_feature: Translation starting site: 62
  misc_feature (489)..(489): n is a, c, t, g, unknown, or other
actcgcgcttgcytgcacgctccagggcttcaggctcccctcccacctcgccgcggcagccatggcgatcacggcgccaactcccgacatccgcggcgagcgtcagtccggccaggacgtccgcacgcagaacgtgatggcgtgcggcgcgttgtccaacatcgtaaaatcctcgctcggccccgtcggtctcgacaagatgctagtggacgatatcggtgatgttacaatcactaatgatggtgcaacatacttaagatgttggaagttgagcacccagctgccaaggttcttgttgagttggctgaactccaagaccgtgagtaggagatggaacaacttccgttgtcatcatagcggcagagctgctcaagagagccaacgatcttgtgaagaataagatccatccaacctctataatcagtggctacaggcttgctatgcgtgaagcctgcaaatatgttgaggaaaaattggcagtcaaggttnacaaacttggaaaagactccc

SEQ ID NO: 2984 - DNA, 488 bp, Zea mays
  misc_feature: Ceres CLONE 281045-F
  misc_feature: Encodes the peptide sequence at SEQ ID NO. 2985
  misc_feature (398)..(398): n is a, c, t, g, unknown, or other
gcatcgaacaccaatggcattcttgcattgaaggaaccttccctccacctccaccgcccgakagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaaaatgaagacgaggacaatgacgacgatagctggcggtggcggcgaccgcggcgccscccgsnaccaaggcaagaagagcgacgtcgtctcgtgtccgtatgtttcgtttcgtgttcgttgttgttgttrcccatctgtgtttttgaccgcaa

SEQ ID NO: 2985 - protein, 131 aa, Zea mays
  misc_feature: Ceres CLONE 281045-F
  misc_feature (100)..(100): Xaa is any aa, unknown, or other
  misc_feature (102)..(102): Xaa is any aa, unknown, or other
MAAPAMLQVVILAAVLLLPFLSVPGAEAQTKKFCLTQFAIASQACAILPPTSPEHHHHHHDDEDNDEDNDEDEDEDEDNDENEDEDNDDDSWRWRRPRRXPXPRQEERRRLVSVCFVSCSLLLLPICVFDR

SEQ ID NO: 2986 - DNA, 474 bp, Zea mays
  misc_feature: Ceres CLONE 281048-F
  misc_feature: Encodes the peptide sequence at SEQ ID NO. 2987
gtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacccgcgagtgcaagaacaacagctgccatgacaacgcgtgcttcaaggacctgc

SEQ ID NO: 2987 - protein, 120 aa, Zea mays
  misc_feature: Ceres CLONE 281048-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDPRVQEQQLP

SEQ ID NO: 2988 - DNA, 482 bp, Zea mays
  misc_feature: Ceres CLONE 281050-F
  misc_feature: Encodes the peptide sequence at SEQ ID NO. 2989
aaaaaacagcatctgctcgttcgtctagcttgggcggtggaccgacagaccagccagctagatggcgcgcagggcggtcggcgttctcctggccgtggcgcgctcttcgcgcggccgcgagggcagcagacgacgacgacaagacgcagccctggcagtgcttcaggtcatgctccagaggctgccaccaccaccacgaccacgaccacgacaacggcgctgctgccgtggcggacttcctctccggggccgccgccaaggtctccgccgccgtcacccgcgaktgcaakaacaacagctgccatgacaacgcgtgcttcaaggacctgccggccatcacctacccgcagtgcgccatcgccacctgcctcagccttccgcaccatagcagaaagaaaacggcgtgcttgaaggactgctgcgagaagtgcttcatcaataatggcccacctgcgcctggcccacctgtgcctggcccgcct

SEQ ID NO: 2989 - protein, 160 aa, Zea mays
  misc_feature: Ceres CLONE 281050-F
  misc_feature (94)..(94): Xaa is any aa, unknown, or other
  misc_feature (96)..(96): Xaa is any aa, unknown, or other
KTASARSSSLGGGPTDQPARWRAGRSAFSWPWRALRAAARAADDDDKTQPWQCFRSCSRGCHHHHDHDHDNGAAAVADFLSGAAAKVSAAVTRXCXNNSCHDNACFKDLPAITYPQCAIATCLSLPHHSRKKTACLKDCCEKCFINNGPPAPGPPVPGPP

SEQ ID NO: 2990 - DNA, 115 bp, Zea mays
  misc_feature: Ceres CLONE 281056-F
acgcacaccgcgacccagtccagagccagtacgtgcgamgcacgcacgctgctggttccgcgtacsagacgacggtcaggtcggccggtgcttttcagtttggaataatgacggc

SEQ ID NO: 2991 - DNA, 212 bp, Zea mays
  misc_feature: Ceres CLONE 281067-F
  misc_feature: Encodes the peptide sequence at SEQ ID NO. 2992
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgadcgaagaagtcggtgtcgcggtcctccagggccgggctgcagttccccgtcagccgcgtcgggcgtacctcaaa

SEQ ID NO: 2992 - protein, 70 aa, Zea mays
  misc_feature: Ceres CLONE 281067-F
  misc_feature (30)..(30): Xaa is any aa, unknown, or other
  misc_feature (47)..(47): Xaa is any aa, unknown, or other
THTFRLSTPKVPFFFSIWKRRSSSHGRERXGGKAKKGAAGRKAGGRXKKSVSRSSRAGLQFPVSRVGRTS

SEQ ID NO: 2993 - DNA, 181 bp, Zea mays
  misc_feature: Ceres CLONE 281076-F
  misc_feature (36)..(36): n is a, c, t, g, unknown, or other
aaacctctagctgtattgatctctggtatttaccmntctttccttccttccttccttcaattctaaataccacaaatcaaagttgctttggatggtgagcagcagcwatggacacgacgagtgacaagcsgtgcgtcatccatgctggcccctaaccctggcaaggccacgatcctcgccc

SEQ ID NO: 2994 - DNA, 170 bp, Zea mays
  misc_feature: Ceres CLONE 281082-F
  misc_feature (65)..(65): n is a, c, t, g, unknown, or other
atcctattccctcgtgtcatggcgcttctbctgcgcctcgctgctccgtcggtgccgccccgggnagctccggcctcagagcattcccgcgcgtcgtccttccggagtcgtttccaaacaatcatttcttcgtttactagttgacagcactgcaagtatgccctgtccta

SEQ ID NO: 2995 - DNA, 181 bp, Zea mays
  misc_feature: Ceres CLONE 281135-F
ayagtctttcgaactgaggaaccctaggcccagcactcggcgacggcggcgctccaccggcgacggatcagcggcatcactcccctccttccccggcgcggcggcscttcacctaggccctagcactgcagcactcgacaacaggatcagcggtcgcgcccccctcctccttccccggcgc

SEQ ID NO: 2996 - DNA, 153 bp, Zea mays
  misc_feature: Ceres CLONE 281167-F
  misc_feature (69)..(69): n is a, c, t, g, unknown, or other
  misc_feature (116)..(116): n is a, c, t, g, unknown, or other
ctcctccgtcgatttggattcgcagcggcggcgcggccaatcaaagcaatcatcacccagtcgcccakncaacagacgctccagtccccagccctcccccccgcatcgatcgatsnaggcacaatgccgcyaccgactcctcctcctcgtcgt

SEQ ID NO: 2997 - DNA, 118 bp, Zea mays
  misc_feature: Ceres CLONE 281175-F
acacgcacaccgcgacccagtccagagccagtacgtgcgamggccacgcacgctgctggtccgcgtacsagacgacggtcaggtcggccggtgcttttcagtttggaataatgacggc

SEQ ID NO: 2998 - DNA, 244 bp, Zea mays
  misc_feature: Ceres CLONE 281191-F
  misc_feature: SWISSPROT Homolog: EC 3.2.1.14 Chitinase
aaatcacctcacaacaagctgccccgcvaacgaacacgaaccttggcagaacgaagctgaagtagttcgttgtgaacccagtatggcaaacgcgccgaggatcctggccctcggctgctagcgctcctgtgcgctgccgccggcccggccgccgcgcagaactgcggctgccagcctaacttctgctgcagcaagttcggctactgcggcacgaccgacgcctactgcggcgacgggtgccagt

SEQ ID NO: 2999 - DNA, 100 bp, Zea mays
  misc_feature: Ceres CLONE 281192-F
acgcacaccgcgacccagtccagagccagtacgtgcgamgccacgcacgctgctggtccgcgtacsagacgacggtcaggtcggccggtgcttttcagtt

SEQ ID NO: 3000 - DNA, 441 bp, Zea mays
  misc_feature: Ceres CLONE 281207-F
  misc_feature: Encodes the peptide sequence at SEQ ID NO. 3001
  misc_feature (138)..(138): n is a, c, t, g, unknown, or other
  misc_feature (139)..(139): n is a, c, t, g, unknown, or other
  misc_feature (368)..(368): n is a, c, t, g, unknown, or other
acgcacaaagagggacttgctcgagggtttagctagcttggaagccctccgcaaactcccatggcgtgcctccdcgtgctcgtcatcgcgtgccacagtactaacggtgcaacacgaagccatagcccgatcagaacnngattcagagacgcagctggtgtcaattattttttttgtttttttgtgctgaacaatgagtcgtgtctcttgatcctcagggtccaccgggaaaactgacgcacgccgctcggacgtcgccggcggaggccttctggcatgcggccctccccggcgctcccatgcccgaggccatccgcgagctcttgcgcccagctggtgctgccgggaccaacgctccagacgccgynagtccaggcaccacgacgccgatccgccgccgatgaacttcaagtacgaagactacaggtcctcgcgtcggaa

SEQ ID NO: 3001 - protein, 34 aa, Zea mays
  misc_feature: Ceres CLONE 281207-F
  misc_feature (23)..(23): Xaa is any aa, unknown, or other
MPEAIRELLRPAGAAGTNAPDAXSPGTTTPIRRR

SEQ ID NO: 3002 - DNA, 483 bp, Zea mays
  misc_feature: Ceres CLONE 281215-F
  misc_feature: Encodes the peptide sequence at SEQ ID NO. 3003
  misc_feature (262)..(262): n is a, c, t, g, unknown, or other
  misc_feature (292)..(292): n is a, c, t, g, unknown, or other
  misc_feature (339)..(339): n is a, c, t, g, unknown, or other
aatccgacgccggacgccccatgatttcgctttcttcttcccgtcgagacccaaccataccagcggcgccgcaskgaacgaggaggcggagtagagtggccggactacctcgacacctccactggcaaccatgggtatctcacgtgattcgatgcacaagcgccgtgccaccggtgaaaagcagaaggcgtggcgcaagaagcgaaagtatgagcttggccgtcagcctgctaacaccaaactgtctagcaataagacagtnaggagggtccgtgtccgtggaggcaacgtnaagtggagggctctccgattggatacaggtaactactcgtggggaantgaggctcttacccgcaagacccgcatcctggatgtggtctataatgcatcaaacaatgagcttgtgaggactcagactcttktgaagagcgccattktacaagttgatgctgctccattcaagcagtggtactcactcactat

SEQ ID NO: 3003 - protein, 117 aa, Zea mays
  misc_feature: Ceres CLONE 281215-F
  misc_feature (1)..(116): Pfam Name: Ribosomal_S8e Pfam Description: Ribosomal protein S8e
  misc_feature (70)..(70): Xaa is any aa, unknown, or other
  misc_feature (98)..(98): Xaa is any aa, unknown, or other
  misc_feature (103)..(103): Xaa is any aa, unknown, or other
MGISRDSMHKRRATGEKQKAWRKKRKYELGRQPANTKLSSNKTVRRVRVRGGNVKWRALRLDTGNYSWGXEALTRKTRILDVVYNASNNELVRTQTLXKSAIXQVDAAPFKQWYSLT

SEQ ID NO: 3004 - DNA, 450 bp, Zea mays
  misc_feature: Ceres CLONE 281219-F
  misc_feature: Encodes the peptide sequence at SEQ ID NO. 3005
accaaattcctctacggcccaccttcttcctacctgccattctcccatccaacacagcaggacgtctcctcctcctccctcccgcttctatcgccgtcttcatttccaggacgcgtcgaattcctccatctaccgcgccggccgccgaggccgagggggaggaggatgctgggcgccgcgagaggcagcttggatccggtcccatgctgggacaggcttttgcgaaggctccgccggcgcgctggctgaggtggckaggggctactccgctgcggcgaaggaaatgactstmcgtgatgcattaaactctgcactggattaagakatgtctgctgatccttcagtttttctgatgggacaagaggttggagagtatcaaggtgcatacaagatttctaagggctttcttaacaagtatagtcccgatagttmcttgacacacctatcaca

SEQ ID NO: 3005 - protein, 41 aa, Zea mays
  misc_feature: Ceres CLONE 281219-F
  misc_feature: SWISSPROT Homolog: EC 1.2.4.1 Pyruvate dehydrogenase (acetyl-transferring)
  misc_feature (36)..(36): Xaa is any aa, unknown, or other
MSADPSVFLMGQEVGEYQGAYKISKGFLNKYSPDSXLTHLS

SEQ ID NO: 3006 - DNA, 230 bp, Zea mays
  misc_feature: Ceres CLONE 281261-F
  misc_feature (133)..(133): n is a, c, t, g, unknown, or other
acagctgaaasagccaaaacgcagaagctgcactgcatacatcgagctaactatctgcagcgatgtctcgctcctgctgcgtcgccgtgtcggtgcttctcgctgtcgccgcgacvcagcgccaccgcgcdtnyatggctgcacgaggaggccatggcacgggccgctggtcgcagagggtgcaagggtggcgccctccgcgtccacctgggctgccgacaagsgtcgcg

SEQ ID NO: 3007 - DNA, 488 bp, Zea mays
  misc_feature: Ceres CLONE 281269-F
  misc_feature: Encodes the peptide sequence at SEQ ID NO. 3008
ctccccaacacgccgccgtcttctgcggttctgccgtttactcctccactttggcctcctcacttgcaagtttaatcttcgcctccagccatgggtaaggagaagtctcacatcaacattgtggttattggccacgtcgactctggcaagtcgacaaccaccggccacctgatctacaagcttggaggcattgacaagcgtgtgatcgagaggtttgagaaggaggccgctgaaatgaacaagcggtcctttaagtatgcttgggtgcttgacaagctcaaggctgagcgtgagaggggtatcaccattgatattgctctgtggaagtttgagaccaccaagtactattgcaccgttattgatgcccctggacaccgtgactttatcaagaacatgatcactggtacctcccaggctgactgtgctgtccttatcattgactccaccactggtggttttgaggctggtatctccaaggatggccaaga

SEQ ID NO: 3008 - protein, 132 aa, Zea mays
  misc_feature: Ceres CLONE 281269-F
  misc_feature (5)..(132): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQ

SEQ ID NO: 3009 - DNA, 454 bp, Zea mays
  misc_feature: Ceres CLONE 281283-F
  misc_feature: Encodes the peptide sequence at SEQ ID NO. 3010
accgccgttcacgccgcgtgtgcgctctggctctgcgctctctctctcctgcgcgtggcgactgccgtccttataccaggcgcccaggtgccaggtctagcctcgtcggtcccttcgccaggtctttctcgggcccttcgccaacgacgagcgcccgcaagttagaaggtatgcattcgtgttcataatattgtatttgactaaaaagactgggcctacgcatgggggctccaaaacagaggtggacttctgaggaakaggctgctcttagagctggagtagccagacatggagttggaaattggcgcatgatattgaatgatccagaacttagctccacattgcgctaccgctcgaatgttgacctaaaggttaaatctattcactcgtttttacgtaagattgatttagtgaagggactgccatatttgggtattccttgaaatcatgtgtc

SEQ ID NO: 3010 - protein, 73 aa, Zea mays
  misc_feature: Ceres CLONE 281283-F
  misc_feature: The sequence is a functional homolog of SEQ ID NO 1219 in the 10/666,642 US patent application
  misc_feature (13)..(13): Xaa is any aa, unknown, or other
MGAPKQRWTSEEXAALRAGVARHGVGNWRMILNDPELSSTLRYRSNVDLKVKSIHSFLRKIDLVKGLPYLGIP

SEQ ID NO: 3011 - DNA, 121 bp, Zea mays
  misc_feature: Ceres CLONE 281324-F
acacgcacaccgcgacccagtccagagccagtacgtgcgamgcacgcacgctgctggtccgcgtacgcagacgacggtcaggtcggccggtgcttttcagtttggaataatgacggcgacg

SEQ ID NO: 3012 - DNA, 119 bp, Zea mays
  misc_feature: Ceres CLONE 281328-F
gcacaccgcgacccagtccagagccagtacgtgcgamggcacgcacgctgctggtccgcgtacsagaacgacggtcaggtcggccggtgcttttcagtttggaataatgacggcgacga

SEQ ID NO: 3013 - DNA, 228 bp, Zea mays
  misc_feature: Ceres CLONE 281353-F
  misc_feature: Encodes the peptide sequence at SEQ ID NO. 3014
  misc_feature (139)..(139): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgancgaagaagtcggtgtcgcggtcctccagggccgggctgcagttccccgtcagccgcgtcgggcgtacctcaaaaagggccggtacgcgc

SEQ ID NO: 3014 - protein, 76 aa, Zea mays
  misc_feature: Ceres CLONE 281353-F
  misc_feature (30)..(30): Xaa is any aa, unknown, or other
  misc_feature (47)..(47): Xaa is any aa, unknown, or other
THTFRLSTPKVPFFFSIWKRRSSSHGRERXGGKAKKGAAGRKAGGRXKKSVSRSSRAGLQFPVSRVGRTSKRAGTR

SEQ ID NO: 3015 - DNA, 421 bp, Zea mays
  misc_feature: Ceres CLONE 281360-F
  misc_feature: Encodes the peptide sequence at SEQ ID NO. 3016
  misc_feature (190)..(190): n is a, c, t, g, unknown, or other
  misc_feature (270)..(270): n is a, c, t, g, unknown, or other
  misc_feature (273)..(273): n is a, c, t, g, unknown, or other
  misc_feature (390)..(390): n is a, c, t, g, unknown, or other
aactcttttcttcaccagacgtccagacctgctcacggcctcccaaactccgccgccgccctgcttccagtctccccttggcaatctccgccttgcaaaccctagccgctgccatggcatatctagctcccgcgaccgccgcctcttccctccgcacccccatctacgtagccgcctcttyccggcgcsntcctttctccctgccgccgtcaaagccatcgccagttctgcacatcccatcctctcctccctccgcatggccgcctccgncgncgttctcttcgccgccacctccccggcactcgcgtgcaccccctccgttcctccgcccccgctcactcctctgacagtcacggtgtcccacgacgatgccatcccagacgctccgantcttcgagaagctgataatcgagactgcctg

SEQ ID NO: 3016 - protein, 140 aa, Zea mays
  misc_feature: Ceres CLONE 281360-F
  misc_feature (63)..(63): Xaa is any aa, unknown, or other
  misc_feature (90)..(90): Xaa is any aa, unknown, or other
  misc_feature (91)..(91): Xaa is any aa, unknown, or other
  misc_feature (130)..(130): Xaa is any aa, unknown, or other
TLFFTRRPDLLTASQTPPPPCFQSPLGNLRLANPSRCHGISSSRDRRLFPPHPHLRSRLFPAXSFLPAAVKAIASSAHPILSSLRMAASXXVLFAATSPALACTPSVPPPPLTPLTVTVSHDDAIPDAPXLREADNRDCL

SEQ ID NO: 3017 - DNA, 153 bp, Zea mays
  misc_feature: Ceres CLONE 281366-F
aagcattttccgtttctttaaaccgtcatcgtcctccctcgtgcctcgctcgttgcgcgttcaaatttcgaaccacctccgccttcgacgccccaaaccctagcccgacccctcctcctccacctgcgccaccgcccaccatgagctccgccg

SEQ ID NO: 3018 - DNA, 334 bp, Zea mays
  misc_feature: Ceres CLONE 281370-F
  misc_feature: Pfam Name: peroxidase Pfam Description: Peroxidase
  misc_feature: SWISSPROT Homolog: EC 1.11.1.11 L-ascorbate peroxidase
aaggcggtcgacaaggccaagcgtaabccgcgtcctcatcgccgagaagaattgcgccccgctcatgctccgcctcgcatggcactccgcgggcaccttcgatgtggccaccaaaaccgggggccccttcggcaccatgaagaaccccgccgagcaggccaacggagccaacgccggactggaaattgccatcaggctgctagagcccatcaaggagcagttccccatcctatcctacgctgacttctaccagcttgctsagtcgtggcagtcgaggtaaccggcggacctgatgtccccttccaccctgggaggcaggacaagcctgagcctc

SEQ ID NO: 3019 - DNA, 384 bp, Zea mays
  misc_feature: Ceres CLONE 281374-F
  misc_feature: Pfam Name: Ribosomal_S4 Pfam Description: Ribosomal protein S4/S9 N-terminal domain
  misc_feature (43)..(43): n is a, c, t, g, unknown, or other
  misc_feature (128)..(128): n is a, c, t, g, unknown, or other
  misc_feature (215)..(215): n is a, c, t, g, unknown, or other
  misc_feature (267)..(267): n is a, c, t, g, unknown, or other
agccctgccactccactcctaccccacacagaagcggcggcgncggasaaacgcaggcgaaggcgagggtgtgagggaaggagcaccagccatggysacgtcaacttctaccgcaactatggtaagangttcaagaaaccaaggcgtccttatgagaaggagcgtcttgatgctgaactgaagctggtcggtgagtatgggctgaggtgcaagcntgastttggagggtccagtatgcactgagcaggatccgtaatgctgcaaggnacttstcacccttgacgagaagaacccccgtcgtatctttgagggtgaggcgcttcttcgccgcatgaaccgctatggggctgcttgctgagggtcagaacaagcttgattatgttc

SEQ ID NO: 3020 - DNA, 251 bp, Zea mays
  misc_feature: Ceres CLONE 281498-F
  misc_feature (40)..(40): n is a, c, t, g, unknown, or other
gaggcagaaaagggcggataaactgcttgaactggaagcnaccctagtccaaaccaccgcaccgacaccgactccgagccccgccgcgccgcgctacctccgctcctctcttcgcccctgccggcgtcgaggccgaagcgaaggcgagcatgcatcacgaccccaaccccttcgacgagggcagcgcgaggacaaccccttctcaaatggaggagccggastcaaagcagcagtacggcttccggccgact

SEQ ID NO: 3021 - DNA, 368 bp, Zea mays
  misc_feature: Ceres CLONE 281513-F
  misc_feature: Translation starting site: 111
  misc_feature (187)..(187): n is a, c, t, g, unknown, or other
  misc_feature (303)..(303): n is a, c, t, g, unknown, or other
aagtattctgctcaagccgagcmccgcagaaaaagaaaaagaaaagccaaagsaaaggcacgaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtngcgcgagttcatggtggagctgggcctccccgacggctcctcccgctgcccagcctggacgaggtgggctacaaccggtcgacggggttcgtgtggctgcggcaggccgccggctnacccacaccttcggctccatcggcaagcaggtgtggtacgacagggaggtgacggcgttcgtgga

SEQ ID NO: 3022 - DNA, 382 bp, Zea mays
  misc_feature: Ceres CLONE 281516-F
  misc_feature: Encodes the peptide sequence at SEQ ID NO. 3023
atccatcccgrgcaagcaagtaatatggcttggtcttgtgctcgtccgatgagcatcgccctgccgtcctcctgctgtgcggcggcgcgtggctgcagcargcggcggaggcgcgcccccaccacatggacgacgacagcagcatcgacatkgaccgcggcasacgaacttcttctccatcgtggggtactcgccggaggacctgacgcagcacgaccggctcgtcaggctgttcgaggagtgggttgccaagtaccgcaagcgtacggcagcttcgaggagaagctgcgccggttcgaggtgttcaaggacaacctgcaccacatcgacgaggccaacaggaaggaggtcaccagctactggctgggcctcaacgccttcg

SEQ ID NO: 3023 - protein, 119 aa, Zea mays
  misc_feature: Ceres CLONE 281516-F
  misc_feature: SWISSPROT Homolog: EC 3.4.22.30 Caricain
  misc_feature (26)..(26): Xaa is any aa, unknown, or other
  misc_feature (43)..(43): Xaa is any aa, unknown, or other
  misc_feature (47)..(47): Xaa is any aa, unknown, or other
MAWSCARPMSIALPSSCCAAARGCSXRRRRAPTTWTTTAASTXTAAXELLLHRGVLAGGPDAARPARQAVRGVGCQVPQAYGSFEEKLRRFEVFKDNLHHIDEANRKEVTSYWLGLNAF

SEQ ID NO: 3024 - DNA, 337 bp, Zea mays
  misc_feature: Ceres CLONE 281520-F
  misc_feature: Encodes the peptide sequence at SEQ ID NO. 3025
  misc_feature (147)..(147): n is a, c, t, g, unknown, or other
  misc_feature (272)..(272): n is a, c, t, g, unknown, or other
  misc_feature (330)..(330): n is a, c, t, g, unknown, or other
aacgccgcctactccgcgctcctccaaaccaaactgaaccctatcctagcacgagtgcacgacggtggcagcaggagatggtggggacggcggaaggcggcgcggagagggcggtgcggcggtgggtggacgccgccgsggcgcctngtcctggacggcgggcttgccacggagctcgakgccaacgsgccgacctcaacgacccgctctggagcgccaagtgcctcctctcctccccgcacctcatccgcaagtccawatggactacctanaagccgggggcgaacattataatcacagcatcgtatcaggctactatccaagggtttnaatcaaa

SEQ ID NO: 3025 - protein, 86 aa, Zea mays
  misc_feature: Ceres CLONE 281520-F
  misc_feature: SWISSPROT Homolog: EC 2.1.1.10 Homocysteine S-methyltransferase
  misc_feature (21)..(21): Xaa is any aa, unknown, or other
  misc_feature (24)..(24): Xaa is any aa, unknown, or other
  misc_feature (35)..(35): Xaa is any aa, unknown, or other
  misc_feature (61)..(61): Xaa is any aa, unknown, or other
  misc_feature (65)..(65): Xaa is any aa, unknown, or other
  misc_feature (85)..(85): Xaa is any aa, unknown, or other
MVGTAEGGAERAVRRWVDAAXAPXPGRRACHGARXQRADLNDPLWSAKCLLSSPHLIRKSXWTTXKPGANIIITASYQATIQGFXS

SEQ ID NO: 3026 - DNA, 455 bp, Zea mays
  misc_feature: Ceres CLONE 281549-F
  misc_feature: Translation starting site: 74
  misc_feature (230)..(230): n is a, c, t, g, unknown, or other
  misc_feature (234)..(234): n is a, c, t, g, unknown, or other
  misc_feature (379)..(379): n is a, c, t, g, unknown, or other
  misc_feature (419)..(419): n is a, c, t, g, unknown, or other
actcatacatttcgactctcaactcccaaggtccctttttttttctcgatctggaagcgccgcagtagcagccatggacgtgagcggasaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcangtanggcacgggtgcccccgtctacctcgccgccgtcctggagtacctcgcggccgagtgctcgagctcgccggcaacgcscaagggacaacaagaagacgcgcatcattccgcgccacgtgctcctcgccatccgcaacgacgagganctcggcaagctgctggccggcgtcaccatcgcccacgggncgtcctccccaacatccacactgtgctcytccccaa

SEQ ID NO: 3027 - DNA, 490 bp, Zea mays
  misc_feature: Ceres CLONE 281555-F
  misc_feature: Translation starting site: 97
  misc_feature (79)..(79): n is a, c, t, g, unknown, or other
aatagctggggcactgctcgctcgctcgctacgsgacctgtggcgtacgcgtaccactccgagacagcaggcgcgtgcnagagcagcccggcgaggatggggcggatcccgtgctgcgagaaggacagcgtcaagcgcgggcagtggacgcccgaggaggacaacaagctgctctcctacatcacccagtacggcacgcgcaactggcgcctcatccccaagaatgccggactgcagcgatgcgggaagagctgccggctccggtggaccaactacctgcgtcccgacctcaagcacggtgagttcacggacaccgaggagcagaccatcatcaagctgcactccgtcgttggcaacaggtggtcggtgatcgcggcgcastgccgggtcggacggacaacgacgtcaagaaccactggaacaccaagctgaagaagaagctgtccgggatgggcatcgaccccatcacgcacaattccttctcgcacct

SEQ ID NO: 3028 - DNA, 277 bp, Zea mays
  misc_feature: Ceres CLONE 281575-F
  misc_feature: Translation starting site: 64
  misc_feature: SWISSPROT Homolog: EC 1.1.1.1 Alcohol dehydrogenase
  misc_feature: SWISSPROT Homolog: EC 1.1.1.2 Alcohol dehydrogenase (NADP(+))
  misc_feature (174)..(174): n is a, c, t, g, unknown, or other
aacatctctccactgctccgtccagcgcgtccacctcccaaacccctactcccccaggaagcaatggcttcccccacccagggccaggtcatcacctgcaaagcggcggtggcgtacgakccgaacaagccactcgtgatcgaggacgtgcaggtggcgccgcgcascggsagngttccgcgtcaagatcctcttcaccgcgctctgccacaccgaccactacacctggagcggcaaggatcctgagggtctttttccttgcattcttggccacgaa

SEQ ID NO: 3029 - DNA, 627 bp, Zea mays
  misc_feature: Ceres CLONE 281580-R
caaattgggtaccgggccccccctcgaggtcgacggtatcgataagcttttttttttttttttttgtcttgagcaaacagattaaaatataaaataaaaaaaccagccaagcttgtcttacacaggtactatacaatacctcaccatccatgcggttttatgactccactcttgagctaactcgcccataataaaattaattaagggttttaaaacagctactaggacacaagacagatagtaattaattacgcagatacattaattcgtaggctcgggtcgcttacatgtcctggaagccgaatctgccaaggaattagaatggaacaaactcaggggcggccggggggggggccttcccggtgggttgatggggggaaccccttttggaacaaccaaacggggcctctaaaaggggaaaggcccccccgggccccaaaaaacccccaaaaaaaaaaaaaaacccccccccccaaaatttaaaaaaaccccccccccttctttccggggggggggggggggtggggggcccctcaggggagcgccccccccccccttcccctctggggggaaaaaaaaaaacatttttttttttgaaaaaaatttattttttcttttttttaaaat

SEQ ID NO: 3030 - DNA, 164 bp, Zea mays
  misc_feature: Ceres CLONE 281610-F
  misc_feature (125)..(125): n is a, c, t, g, unknown, or other
agacaaaacagcgtccccctccctctactaaaaaaaaaatggaggcatgagctccgcctcctcctcgtctctcgccgatctccccaaaccctagccccgacctgaccgccggcgggcccggscgnaagaaaggagtcgctcccacccacccaacttctgcggcg

SEQ ID NO: 3031 - DNA, 468 bp, Zea mays
  misc_feature: Ceres CLONE 281611-F
  misc_feature: Translation starting site: 175
  misc_feature (275)..(275): n is a, c, t, g, unknown, or other
ggagcagggcaggggttgcgtctcagttcctggttgtgttgttgtaagctcacaggtttcttctcttcgcgtgastagctagagtgggatcgcgaggaagaaggatgtcgtgctgcggaggcaactgcgggtgcggcasggattgcaagtgcggcasggctgcgagggtgcaagatgtacccggacatggttgagcaggtgaccaccaccaccaccacccagactctcatcatgggtgttgcgccatccacgggcgggttcgaggcggccgcgtnagctgagaacggcgggtgcaagtgcggcgccactgcmcctgcgacccctgcacctgcaagtgaggatgaccgggtgcagcatgcaggccgtgacgatggaggaagtagctagatcggaaggacacccttcagtatctctagctaaatcaagctctgcagtatgttgtagcagtgtcgtctgtgtttgccgcca

SEQ ID NO: 3032 - DNA, 456 bp, Zea mays
  misc_feature: Ceres CLONE 281626-F
  misc_feature: Encodes the peptide sequence at SEQ ID NO. 3033
  misc_feature (281)..(281): n is a, c, t, g, unknown, or other
  misc_feature (351)..(351): n is a, c, t, g, unknown, or other
  misc_feature (397)..(397): n is a, c, t, g, unknown, or other
agagagaatagctaggccgcgcgacgccgaaccgcagcagacacgcgcgcggacagcgtacgagggagggagctgcctgaggtagaggaggaggagaacatgcagggcggcggcggcgtggaccagccgcsattgcagatggtgctgcgggtgaggcacccgtcgtcgctgggcggcacggggcggacgaggacgacggcgaggggtcctccaggtcggcgctctcggtgttcaaggccaaggaggagcagatcgagcggcgcaagatggaggtccggganaaggtgttcgcccacctcggacgcgtcgaggaggagtccaagcgactcgccttcatcaggcaggagcttnaagggatgccgaccctacaaggaakgaggttgagtcgataaggaancggatcgacacggttaaccgtcagctcaagcctctcagcaagagctgcgtcaataagga

SEQ ID NO: 3033 - protein, 41 aa, Zea mays
  misc_feature: Ceres CLONE 281626-F
  misc_feature (5)..(5): Xaa is any aa, unknown, or other
  misc_feature (29)..(29): Xaa is any aa, unknown, or other
  misc_feature (37)..(37): Xaa is any aa, unknown, or other
MEVRXKVFAHLGRVEEESKRLAFIRQELXGMPTLQGXRLSR

SEQ ID NO: 3034 - DNA, 250 bp, Zea mays
  misc_feature: Ceres CLONE 281654-F
  misc_feature: Encodes the peptide sequence at SEQ ID NO. 3035
  misc_feature (98)..(98): n is a, c, t, g, unknown, or other
awacaaaccatcgtcacccaatagccaccggccaactgtcaagcactccttcggtgcttccccatctgcgccccccgatccctccggacccgcgagcntadgccgtcgccgcgcgcgcgagatttgagctgaggccatggagtcaccgttccgggccgacgtggtcaaggacaaggcggcgctggtcaccggcgggggatccggcatctgctttgagatcgccgcccagctcgcgcgcctacggcgrggg

SEQ ID NO: 3035 - protein, 38 aa, Zea mays
  misc_feature: Ceres CLONE 281654-F
  misc_feature: SWISSPROT Homolog: EC 1.3.1.34 2,4-dienoyl-CoA reductase (NADPH)
MESPFRADVVKDKAALVTGGGSGICFEIAAQLARLRRG

SEQ ID NO: 3036 - DNA, 203 bp, Zea mays
  misc_feature: Ceres CLONE 281680-F
  misc_feature (119)..(119): n is a, c, t, g, unknown, or other
  misc_feature (188)..(188): n is a, c, t, g, unknown, or other
aagcgtggtagttgccactgccgtcccctccagaagtgcgatacagttcggattcagatcgcggccggtgcgaacccacgaaggcacgaacggtagaacccgaccgagcgcggcasaanacctccgatccctgctgcgagcaaggatggcggcggcatgggcagtgctggcggcggtgctcgtcgcancgcaggttggcgtct

SEQ ID NO: 3037 - DNA, 471 bp, Zea mays
  misc_feature: Ceres CLONE 281686-F
  misc_feature (28)..(28): n is a, c, t, g, unknown, or other
cttccgctaccaccttcatccatcctgnhgtcggtgtcttgcccccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgc

SEQ ID NO: 3038 - DNA, 478 bp, Zea mays
  misc_feature: Ceres CLONE 281756-F
  misc_feature: Pfam Name: CPSase_sm_chain Pfam Description: Carbamoyl-phosphate synthase small chain, CPSase domain
  misc_feature (32)..(32): n is a, c, t, g, unknown, or other
agcgtttcaacagtaatctctctgtgcctgcnacgacgactaggtgggttaccgccgtcgcgccgccgccgcctccgccgtcatactacaggtgcgaggccttcatcggtatcttaacaggcgacgaacaccaaccagtctgcactctacgatggcggcgctccggccacgctcccgcggcctcccggtgtctctccggtgccaagtcgtgctgggctgctgagcggastccagctcgtttgccgtctcggsgccttctactgacctccggcaaagtaggagccgcatcctcagcgtccgtgccaaggttgccactggcgtgcagagagccagcactgtggatgatggagcaaaaaggccgtggaagctcagtgatgctcgtcttgtcctggaagatggttcagtgtggagggccaagtcttttggcgcttcaggaacacaagtcggtgaagttgtttcaacacatcactgacaggct

SEQ ID NO: 3039 - DNA, 715 bp, Zea mays
  misc_feature: Ceres CLONE 281813-R
ccgaattgggaccgggccccccctcgaggtcgacggtatcgataagcttttttttttttttttttggacggactgtacacatattctgacgccaccgcagagtatggtaaggggacaaaaaataatgtcatatagtgattataactctgctggtagactaacagtatgggccctaggataccactcagacaaaaaccttggaaggtgatcttgagttctcatggacatgaagccagagctgttttgcccccacaggtgaggtttaaatcgtgctggcctgagccttggtgaggatgacaccttcatacttgacctggaacacctcatggagtcctccttggttcaccgctatgctgaatcccaacacgggacttgcgcctgctgcggcgtgcgacacgctacccatgacgctcgagcaccacctataagttcatcccataaatgcctgttgatggatcatacttgataaaaggtcgatgtgctcatgtatgccgaacccgaatcgccggtgtcgctgaagttctactgagcagctcgtactcattgaccttgaggacgctctcagcagctgatcgtcttgtcaccactgacgtgacctaccagctagtctcgcgttacgacagacgcgatttacttcacctgtccctcgctgcataccaatagcagaacgggacgtgaaccacccccactcgtgagaggacccgtgaaagtgacg

SEQ ID NO: 3040 - DNA, 161 bp, Zea mays
  misc_feature: Ceres CLONE 281857-F
agccaccaacctcctcctcttccgcatcgcatcgagagcggggctgtacagtgcgagaytctactgctcgatcgccatggccgccgcgctcaggtgcccggcatccgtcaggtctcgggccccgccgccgcgttccgctcaatgtgcgccaggcgtccaga

SEQ ID NO: 3041 - DNA, 281 bp, Zea mays
  misc_feature: Ceres CLONE 281872-F
  misc_feature: Encodes the peptide sequence at SEQ ID NO. 3042
  misc_feature (127)..(127): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggncggcgggcgacgaagaagtcggtgtcgcggtcctccagggccgggctgcagttccccgtcagccgcgtcgggcgtacctcaaaaagggccggtacgcgcabgtaggcacgggtgccccgtctacctcgccgccgtcctggagtacctcgcggcc

SEQ ID NO: 3042 - protein, 69 aa, Zea mays
  misc_feature: Ceres CLONE 281872-F
  misc_feature (6)..(6): Xaa is any aa, unknown, or other
  misc_feature (19)..(19): Xaa is any aa, unknown, or other
  misc_feature (52)..(52): Xaa is any aa, unknown, or other
MDVSGXAGRRRRARPGARXAGDEEVGVAVLQGRAAVPRQPRRAYLKKGRYAXVGTGAPSTSPPSWSTSR

SEQ ID NO: 3043 - DNA, 159 bp, Zea mays
  misc_feature: Ceres CLONE 281885-F
  misc_feature (124)..(124): n is a, c, t, g, unknown, or other
atttcaaaagcactccgccatgacaaaacccacagctggtttccagacgccgcgcccttcctcccttcgcgcctcctccaccgccggcgcccgctcctctgcagcgaavtcgcggtcgccagcnccgtccccagggacttcgcctccagcaccaaggtg

SEQ ID NO: 3044 - DNA, 145 bp, Zea mays
  misc_feature: Ceres CLONE 281913-F
  misc_feature (109)..(109): n is a, c, t, g, unknown, or other
actttctcctcctcacctgtwgtcacaaagccaaaccctaattcacggccgccggagatgggacaaggttctcccggcggatgggcaagcwgcccggccttccggsganccgcaagcagggagacggcaagaaagagaagaaata

SEQ ID NO: 3045 - DNA, 492 bp, Zea mays
  misc_feature: Ceres CLONE 281928-F
  misc_feature: Translation starting site: 234
  misc_feature: SWISSPROT Homolog: EC 2.7.10.2 Non-specific protein-tyrosine kinase
  misc_feature (456)..(456): n is a, c, t, g, unknown, or other
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgttggctcccgaggagcaccccgtcctcctcaccgaggcgcccctgaaccccaaggctaacaggganaagatgacccagatcatgttccgagaccttcaacac

SEQ ID NO: 3046 - DNA, 445 bp, Zea mays
  misc_feature: Ceres CLONE 281932-F
  misc_feature (238)..(238): n is a, c, t, g, unknown, or other
  misc_feature (375)..(375): n is a, c, t, g, unknown, or other
  misc_feature (397)..(397): n is a, c, t, g, unknown, or other
atacatttcgactctcaactcccaaggtcccttttttttctcgatctggaagcgccgcagtagcagccatggacgtgagcggasaggcgggaaggcgaagaagggcgcggccgggcgcaaggccggcgggcgacgaagaagtcggtgtcgcggtcctccagggccgggctgcagttccccgtcagccgcgtcgggcggtacctcaaaaagggccggtacgcgcmbgtaggcacgggtncccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgagganctcggcaagctgctggccggcntcaccatcgcccacggsgcgttcctccccaacatccacactgtgctcc

SEQ ID NO: 3047 - DNA, 466 bp, Zea mays
  misc_feature: Ceres CLONE 281940-F
  misc_feature: Translation starting site: 234
  misc_feature (77)..(77): n is a, c, t, g, unknown, or other
accaaaccaagtgcggccagagaaatttctcccaaatttcagatcaaatcctcgaaatctccgacacctagcccacnggagacttctccccaacagtgtcgcgatccgtctcgatccggcatggagcgcgtcttctccgtggaggagatccccaacccctactgggttccgccgcaccctcaatcggcggccgcsgcgctgttgctgcaccagcgggggaggcggcggggctgatgaaccggtgcccgtcggaatggtacttccagaagttcctggaggaggccgtgctcgacagcccggttcccgtagccggcgtcagtaggggcagcgttggagctggagttgaggctgcggagaggaagacaccggggaccgcggcggcgacggctgctcgagctcggttgttgaccccgtggagtacaacgcgatgctcaagcagaagctggagaaggacctcgctgccgtt

SEQ ID NO: 3048 - DNA, 454 bp, Zea mays
  misc_feature: Ceres CLONE 281964-F
  misc_feature: Translation starting site: 90
  misc_feature: Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature (65)..(65): n is a, c, t, g, unknown, or other
gtctcaatccctccacatcctcccctccttcctccttgggttcccagcccgtgcgcccgcctgtngcagtcgcaccgcagccgccggccatggcctgcctcaccgacctcgtcaacctcaacctctcggacaccacagagaagatcatcgccgagtacatatggatcggtggatctggcatggatcytcaggagcaaagccaggaccctcccgggcccggtgaccgatcccagcaagctgcccaagtggaactacgacggctccagcaccggccaggcccccggcgaggacagcgaggtcatcctgtacccgcagccatcttcaaggacccattcaggaggggcaacaacatccttgtcrtgtgcgattgctacaccccagctggcgagccavttcccaccaacaagaggtacagcgccgccaagatcttcagcagccttgaggtcgctgccga

SEQ ID NO: 3049 - DNA, 437 bp, Zea mays
  misc_feature: Ceres CLONE 281968-F
  misc_feature: Translation starting site: 181
  misc_feature: Pfam Name: NAC Pfam Description: NAC domain
  misc_feature (386)..(386): n is a, c, t, g, unknown, or other
  misc_feature (431)..(431): n is a, c, t, g, unknown, or other
acagtgactggcctcccgactcgactctcctccccctatctctatctgcttcctgctgagctcaaaccccttccgcctccccatcaaccattccatccgccgccgccgccgcctgcgcaagatgaatgtggagaagctcaagaagatggctggcgctgtacgcaccggaggaagggcagcatgcgcaggaagaagaaggcagttcacaagaccacgaccacagatgacaagcggcttcagagcaccttgaaaagatcggggggaacaccattcctggtatcgaggaggtcaacatcttcaaggacgatgttgttatccagtttcagaaccctaaagtgcaagcatccattcctgcaaatacatgggtggttagtggagtaccccanacaaaaagtctgcaaraccttctgccatcaattatcaaccaactnggtcct

SEQ ID NO: 3050 - DNA, 480 bp, Zea mays
  misc_feature: Ceres CLONE 281969-F
  misc_feature: Encodes the peptide sequence at SEQ ID NO. 3051
  misc_feature (183)..(183): n is a, c, t, g, unknown, or other
  misc_feature (302)..(302): n is a, c, t, g, unknown, or other
  misc_feature (362)..(362): n is a, c, t, g, unknown, or other
  misc_feature (383)..(383): n is a, c, t, g, unknown, or other
  misc_feature (402)..(402): n is a, c, t, g, unknown, or other
  misc_feature (438)..(438): n is a, c, t, g, unknown, or other
attcctcggagagagaagccgccgcagcagcaatcacagcagcccggagaacgccctggtccgacaagatgcagatcttcgtgaagacgctgacagggaagaccatcaccctcgaggtcgagagcagcgacaccatcgacaatgtcaaggccaagatccaggacaaggaaggcatcccgccgnatcagcagcggctgatctttgccgggaagcagctggaggatggccgcacccttgcgactataacatccaaaaggagtctacgctccacctcgtgcttaggctccgcggtggaatcattnagccctcgctgcaggsctcgctcgcaagtacaaccaggacaagatgatctgccgcaaatnctatscacgactkcaccctanggctktcaactkccgcaanaagaaktgtggtcacagcaaccagctgagggccaanaagaagatcaagaactgaggtgctgctcctagtcagtttcat

SEQ ID NO: 3051 - protein, 133 aa, Zea mays
  misc_feature: Ceres CLONE 281969-F
  misc_feature (6)..(66): Pfam Name: ubiquitin Pfam Description: Ubiquitin family
  misc_feature (39)..(39): Xaa is any aa, unknown, or other
  misc_feature (78)..(78): Xaa is any aa, unknown, or other
  misc_feature (84)..(84): Xaa is any aa, unknown, or other
  misc_feature (98)..(98): Xaa is any aa, unknown, or other
  misc_feature (100)..(100): Xaa is any aa, unknown, or other
  misc_feature (103)..(103): Xaa is any aa, unknown, or other
  misc_feature (105)..(105): Xaa is any aa, unknown, or other
  misc_feature (107)..(107): Xaa is any aa, unknown, or other
  misc_feature (112)..(112): Xaa is any aa, unknown, or other
  misc_feature (114)..(114): Xaa is any aa, unknown, or other
  misc_feature (124)..(124): Xaa is any aa, unknown, or other
MQIFVKTLTGKTITLEVESSDTIDNVKAKIQDKEGIPPXQQRLIFAGKQLEDGRTLATITSKRSLRSTSCLGSAVESXSPRCRXRSQVQPGQDDLPQXLXTTXPXGXQLPQXEXWSQQPAEGQXEDQELRCCS

SEQ ID NO: 3052 - DNA, 454 bp, Zea mays
  misc_feature: Ceres CLONE 281973-F
  misc_feature: Encodes the peptide sequence at SEQ ID NO. 3053
  misc_feature (187)..(187): n is a, c, t, g, unknown, or other
  misc_feature (336)..(336): n is a, c, t, g, unknown, or other
  misc_feature (419)..(419): n is a, c, t, g, unknown, or other
  misc_feature (432)..(432): n is a, c, t, g, unknown, or other
awaatttttcgcccgccgcccccagtcccgatccgaagctgtgcctcgtaccatttcgatccaatggcgccgacgtcgaagctgtcgacgggcatcaagcgcgcttcgsgtcgcacgcgtaccatcgccgtgggctgtgggccatcaaggcaagaacggcggcgcttccccaaggccgacaaggccncgccdccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaatatantggtgtttctcaagcagctcaagtccggcctgctccttatctctgggcctttcaagatcaatagattaccgatccgccgtttnaaccacacctatntcattgctacatcaaccaaagt

SEQ ID NO: 3053 - protein, 150 aa, Zea mays
  misc_feature: Ceres CLONE 281973-F
  misc_feature (36)..(36): Xaa is any aa, unknown, or other
  misc_feature (62)..(62): Xaa is any aa, unknown, or other
  misc_feature (64)..(64): Xaa is any aa, unknown, or other
  misc_feature (112)..(112): Xaa is any aa, unknown, or other
  misc_feature (139)..(139): Xaa is any aa, unknown, or other
  misc_feature (144)..(144): Xaa is any aa, unknown, or other
NFSPAAPSPDPKLCLVPFRSNGADVEAVDGHQARFXSHAYHRRGLWAIKARTAALPQGRQGXAXVEPKFYPADDVKPRVPSTRKPKPTKLRSSITPGTVLILLAGRFMGNIXVFLKQLKSGLLLISGPFKINRLPIRRXNHTYXIATSTK

SEQ ID NO: 3054 - DNA, 388 bp, Zea mays
  misc_feature: Ceres CLONE 281981-F
  misc_feature: Translation starting site: 109
  misc_feature (146)..(146): n is a, c, t, g, unknown, or other
  misc_feature (226)..(226): n is a, c, t, g, unknown, or other
  misc_feature (245)..(245): n is a, c, t, g, unknown, or other
  misc_feature (271)..(271): n is a, c, t, g, unknown, or other
  misc_feature (323)..(323): n is a, c, t, g, unknown, or other
aaaacactctcctccttcctccaccgccgccaacgtcgcctggcggccgtctgcagctccgcgcctctgctcggaagttgttggtgaaggtttcttgaagctgagaagatggtgctgaagacagaactctgccgcttcasscaagnaagatttatcctgggaaaggcatccgatttatccgtgctgattctcaggttttcctttttgccaactcaaaatgcaagcnctacttccacaaccgcctnaagcctgcaaagcttaccttggacancaatttacaggaagcagcacaagaaggatatccatgctgaggctttcaaaanaggcgccgcgccaacaagaagccatactcgaggtccattgtgggtgcttccctagaggtgatcca

SEQ ID NO: 3055 - DNA, 462 bp, Zea mays
  misc_feature: Ceres CLONE 281995-F
  misc_feature: Encodes the peptide sequence at SEQ ID NO. 3056
  misc_feature (134)..(134): n is a, c, t, g, unknown, or other
  misc_feature (404)..(404): n is a, c, t, g, unknown, or other
  misc_feature (417)..(417): n is a, c, t, g, unknown, or other
  misc_feature (448)..(448): n is a, c, t, g, unknown, or other
atcccaaagacgccgtcgccgctcttgttgtttccgatcccaaaccccaaacacgctccaccggcacctccgctcccacaccacaccgatggcccgcacgaagcagacggcgcgcaagtccaccggagcaaggngccgctgaagcagctggcgaccaaggcagcagcaagtyggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgakatcgcgcaggacttcaagaccgacctccgcttccagtcctccgccgtcgccgcgctacaggaggccgcggaggctacctcgtcggcctcttcgagnacaccaacctctncgccatccacgccaagcgcgtcaccatcatncccaaggacattca

SEQ ID NO: 3056 - protein, 153 aa, Zea mays
  misc_feature: Ceres CLONE 281995-F
  misc_feature (57)..(57): Xaa is any aa, unknown, or other
  misc_feature (102)..(102): Xaa is any aa, unknown, or other
  misc_feature (134)..(134): Xaa is any aa, unknown, or other
  misc_feature (139)..(139): Xaa is any aa, unknown, or other
  misc_feature (149)..(149): Xaa is any aa, unknown, or other
PKDAVAALVVSDPKPQTRSTGTSAPTPHRWPARSRRRASPPEQGAAEAAGDQGSSKXAPATGGVKKPHRFRPGTVALREIRKYQKSTELLIRKLPFQRLVRXIAQDFKTDLRFQSSAVAALQEAAEATSSASSXTPTSXPSTPSASPSXPRTF

SEQ ID NO: 3057 - DNA, 448 bp, Zea mays
  misc_feature: Ceres CLONE 282011-F
  misc_feature (383)..(383): n is a, c, t, g, unknown, or other
  misc_feature (407)..(407): n is a, c, t, g, unknown, or other
  misc_feature (409)..(409): n is a, c, t, g, unknown, or other
aagcggaactcgctgcactgcttggwatccaacgagccaatcattcaaatcctccccggaaccgcgttgagcagggcacggtcgaccggatctagggtgagggtccgtcgccgaagaaactcccaggcggtcacgaggaggcggcgggggagggcggaggagatggcctcggaggagatgacggcgacggaggtggctgcgctgctggatctgaagccgcacccggagcggcttctacaccgagaccttccgcgacggctccatcacgctcaccacctcccagctcccgccccactacaaggtaaaccgtgctgttagcaccgcaatttatttcctacttcccgcagagttgttttcccgtctccaccgcattccttgtgctnaaacctggcacttctacaaggganancctctcacggtcttcgagcttcacgacgatggtcacatt

SEQ ID NO: 3058 - DNA, 97 bp, Zea mays
  misc_feature: Ceres CLONE 282016-F
  misc_feature (71)..(71): n is a, c, t, g, unknown, or other
atctcaagccaccatcgaccttcaagtctcgctacgtagcagtgcaataaaaaaagcagccgcaatgggancagcaccatggccctctcctccacgg

SEQ ID NO: 3059 - DNA, 191 bp, Zea mays
  misc_feature: Ceres CLONE 282026-F
  misc_feature (110)..(110): n is a, c, t, g, unknown, or other
  misc_feature (112)..(112): n is a, c, t, g, unknown, or other
awacaacaccagaatccgcgaatcacagacgcgtctatctcagcttgctgcactgcactaccctgccctgccatcatatcgtacgtgagcccggccgagcgagagvgggnangaggcatggctgctccgaagctcgcgacgctggcgctggccgtgctcctgtcggcgaccgtggtggctcccccggccgc

SEQ ID NO: 3060 - DNA, 336 bp, Zea mays
  misc_feature: Ceres CLONE 282054-F
agcgtaacaagtgtccttcctccatcttcctcctccactccactcccaagtccccaccacccccaaccccgtctctccactgcggcgcaggcttcgcttcggctccgctcggctcgasagaaaatgcaacgggcagtgcaggcccgtcagtcacacggcaatkttcttaaatatgctgttctacaaacacatcagcgctcccaasccagcaatgcttcctgctgccttttctcgtttcatgtcagtttcatctgctcgcctagaggatycgtgaatttgaaaactgccactgtagcagatktcttgaagyctaaagggaagagtgctgatggatct

SEQ ID NO: 3061 - DNA, 263 bp, Zea mays
  misc_feature: Ceres CLONE 282060-F
  misc_feature: Encodes the peptide sequence at SEQ ID NO. 3062
  misc_feature (114)..(114): n is a, c, t, g, unknown, or other
  misc_feature (117)..(117): n is a, c, t, g, unknown, or other
aaaaagaaagaaaaaatcgagaggacgccagggccgattctctgcgtgacttggggcgtcgtcgcgagttttctccggccgagggcggcgcgaccggacaaccagcgtgackcnganccggcgacatgactcgcggcaaccagcgtgaccgcgaccgtgagckcgcggcggcstaatgcccaacgccaagaactcccaggacgggctcaccccggagcagcgccgcgagagggacaagaaagctctggaggagaaggcggcca

SEQ ID NO: 3062 - protein, 29 aa, Zea mays
  misc_feature: Ceres CLONE 282060-F
MPNAKNSQDGLTPEQRRERDKKALEEKAA

SEQ ID NO: 3063 - DNA, 481 bp, Zea mays
  misc_feature: Ceres CLONE 282075-F
  misc_feature: Translation starting site: 177
  misc_feature (409)..(409): n is a, c, t, g, unknown, or other
ctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaangcaaggaaggttgtaggctgctcctgtgtcgtcgtcaaggactacggtgaagaatctgagggccttaacata

SEQ ID NO: 3064 - DNA, 384 bp, Zea mays
  misc_feature: Ceres CLONE 282096-F
  misc_feature: Encodes the peptide sequence at SEQ ID NO. 3065
  misc_feature (221)..(221): n is a, c, t, g, unknown, or other
atagctagccagccatcctactgtcacacacacacacacacagacaagtggtttccaaagccaagtgtgtgtactagcaaccagctagctcgggcggcasaggcagccatcatgtcggaggagaagcaccaccacttcttcaaccaccacaagaaggacgaggagcagcccgccggcgagtacgggtactccgagaccgagttggtcaccgccaccggsanggcgagtacgagaggtacaagaaggaggagaaggagcacaagcacaagcagcacctcggcgaggccggcgccatcgcgccgggccttcgcactctacgagaagcacgaggcgaagaaggaccccgagcacgcgcacaggcacaagatcacggaggaggtcgct

SEQ ID NO: 3065 - protein, 91 aa, Zea mays
  misc_feature: Ceres CLONE 282096-F
  misc_feature (37)..(37): Xaa is any aa, unknown, or other
MSEEKHHHFFNHHKKDEEQPAGEYGYSETELVTATGXASTRGTRRRRRSTSTSSTSARPAPSRRAFALYEKHEAKKDPEHAHRHKITEEVA

SEQ ID NO: 3066 - DNA, 146 bp, Zea mays
  misc_feature: Ceres CLONE 282097-F
  misc_feature (118)..(118): n is a, c, t, g, unknown, or other
attacccaccacctgcttctgctgcttgcttgtgcggtggacgctgcggasggagsaagaaggtgaagaaagggatgaaggaggagatggtggtcgggctgtcggcgccggggccggntggggaggtggggcgccgcgccgccgca

SEQ ID NO: 3067 - DNA, 485 bp, Zea mays
  misc_feature: Ceres CLONE 282140-F
  misc_feature: Encodes the peptide sequence at SEQ ID NO. 3068
  misc_feature (101)..(101): n is a, c, t, g, unknown, or other
  misc_feature (292)..(292): n is a, c, t, g, unknown, or other
aaattaaaaacaagccacctgctgtctgctgcccgctgcgctgagcgtgagacctagctactaccttattacctctctccggtctccgcagctgtaggcgncggcggccatggacttcgtgctccaggtcctgctgcgagtggtgatgagaagaagcatccgcagctgcaagatggtcgttgacatcgccgtggacatcggcacggctgtcttcgtggccgtgcgggtctccggcctcgtcttccgccgccggctgcccacgccgactacgacatcgtskccgtcgasvtanctactactccccggggacgtcctcctcgatcggcatgcatgtccaggaggattaattattggcaggcactagatgagctagctagctagctagggccagaagatgtatacttctcgcgggggggcatttaagtaccaaggtcatatatctgtgcgttcttttttgtggaatcaaactaatttcgctagctacc

SEQ ID NO: 3068 - protein, 84 aa, Zea mays
  misc_feature: Ceres CLONE 282140-F
  misc_feature (57)..(57): Xaa is any aa, unknown, or other
  misc_feature (60)..(60): Xaa is any aa, unknown, or other
  misc_feature (61)..(61): Xaa is any aa, unknown, or other
MDFVLQVLLRVVMRRSIRSCKMVVDIAVDIGTAVFVAVRVSGLVFRRRLPTPTTTSXPSXXLLLPGDVLLDRHACPGGLIIGRH

SEQ ID NO: 3069 - DNA, 456 bp, Zea mays
  misc_feature: Ceres CLONE 282148-F
  misc_feature (228)..(228): n is a, c, t, g, unknown, or other
  misc_feature (300)..(300): n is a, c, t, g, unknown, or other
  misc_feature (312)..(312): n is a, c, t, g, unknown, or other
  misc_feature (353)..(353): n is a, c, t, g, unknown, or other
  misc_feature (395)..(395): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgscancgttcggcagcggtgcccccgtctacctcgcggccgtcctggagtacctcgccgctgaggtcctggagctcnccggcaacgctnccaaggacaacaagaagacgcgcatcgtcccgcgccacgtnctgctggcgatccgcaacgacgaggagctcgggaagctgctnaccggcgtgaccatcgcccacggsgcgtgttgcccaacatcaacccggtcctgctgcccaa

SEQ ID NO: 3070 - DNA, 441 bp, Zea mays
  misc_feature: Ceres CLONE 282212-F
  misc_feature: Encodes the peptide sequence at SEQ ID NO. 3071
gaacaccaatggcattcttgcattgaaggaaccttccctccacctccaccgcccgakagcgagckccggacggggttttggttgggcatggcccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaggtatggtggcggtggcggtggcggtcgttatggttctgaccgtggtggtgaccgatactctggccgtagccgagatggcggcactatgggggtggcgatcgctacagccgtgaccgatca

SEQ ID NO: 3071 - protein, 113 aa, Zea mays
  misc_feature: Ceres CLONE 282212-F
MLQVVILAAVLLLPFLSVPGAEAQTKKFCLTQFAIASQACAILPPTSPEHHHHHHDDEDNDEDNDEDEDEDEDRYGGGGGGGRYGSDRGGDRYSGRSRDGGTMGVAIATAVTD

SEQ ID NO: 3072 - DNA, 124 bp, Zea mays
  misc_feature: Ceres CLONE 282218-F
acacgcacaccgcgacccagtccagagccagtacgtgcgamggcacgcacgctgctggtccgcgtacsagaygacggtcaggtcggccggtgcttttcagtttggaataatgacggcgacgacg

SEQ ID NO: 3073 - DNA, 209 bp, Zea mays
  misc_feature: Ceres CLONE 282255-F
  misc_feature: Encodes the peptide sequence at SEQ ID NO. 3074
  misc_feature (103)..(103): n is a, c, t, g, unknown, or other
  misc_feature (107)..(107): n is a, c, t, g, unknown, or other
aaaccctcacagcgaaggacacaaaaacacaggtagggttaggcgacgcggcggcgagagcgcgagagtaggaggaggcgtcggccatgacggggaaggcgansaangaaagcacacggcgaaggagatcgccgcgaagatcgacgcggcgacgacgaaccggggcggcggcaaggtcgggcaggcggatcggctagggcaggacaagg

SEQ ID NO: 3074 - protein, 69 aa, Zea mays
  misc_feature: Ceres CLONE 282255-F
  misc_feature (34)..(34): Xaa is any aa, unknown, or other
  misc_feature (35)..(35): Xaa is any aa, unknown, or other
  misc_feature (36)..(36): Xaa is any aa, unknown, or other
NPHSEGHKNTGRVRRRGGESARVGGGVGHDGEGXXXKHTAKEIAAKIDAATTNRGGGKVGQADRLGQDK

SEQ ID NO: 3075 - DNA, 404 bp, Zea mays
  misc_feature: Ceres CLONE 282257-F
  misc_feature: Translation starting site: 115
  misc_feature (93)..(93): n is a, c, t, g, unknown, or other
  misc_feature (297)..(297): n is a, c, t, g, unknown, or other
gatctgagatcgacatcgatccaccgaggtttcttgtgcgtgccgccatggccatggcagtagctcaccttcttcctcagctctccgccgamnattggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccactcgccgccgctcgcgcgtcgggcttctacctggcgccgtccgccacgtccagcatggnmcgccgtcggtcggggacatggtccggcacgttgtggggcgcgcacgggctgcgtggccgaccccgccaccgggcgcttctcctgcgccacggccgactgcggcacg

SEQ ID NO: 3076 - DNA, 360 bp, Zea mays
  misc_feature: Ceres CLONE 282279-F
  misc_feature: Encodes the peptide sequence at SEQ ID NO. 3077
  misc_feature (20)..(20): n is a, c, t, g, unknown, or other
  misc_feature (266)..(266): n is a, c, t, g, unknown, or other
  misc_feature (283)..(283): n is a, c, t, g, unknown, or other
actactaccagcggtatggnccggcatcatccgtctcgtctcgtctcgcctctcctctccttttcccccctccctgcacagcgccgctcaccgtcaccggaccacagcagcgatcgatggctgaggtacacaacgagcggcccgtggggatggtgggcggcgtccgggacsgccggtgggccgcgagaacgacctcgaggccatcgagctcgcgcgcttcsstcgccgagcacaacagcaagaccaacgcgatgctggaattcganaggctggtgaaggtgangcaccaggtcgtggccgggaccctgcaccacttcaccgtcgaggtaagtatgccggcggcggcgtaaaagaagctgt

SEQ ID NO: 3077 - protein, 77 aa, Zea mays
  misc_feature: Ceres CLONE 282279-F
  misc_feature (19)..(19): Xaa is any aa, unknown, or other
  misc_feature (36)..(36): Xaa is any aa, unknown, or other
  misc_feature (50)..(50): Xaa is any aa, unknown, or other
  misc_feature (56)..(56): Xaa is any aa, unknown, or other
MAEVHNERPVGMVGGVRDXRWAARTTSRPSSSRASXAEHNSKTNAMLEFXRLVKVXHQVVAGTLHHFTVEVSMPAAA

SEQ ID NO: 3078 - DNA, 519 bp, Zea mays
  misc_feature: Ceres CLONE 282286-F
  misc_feature: Encodes the peptide sequence at SEQ ID NO. 3079
  misc_feature (274)..(274): n is a, c, t, g, unknown, or other
atccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggcgntgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccccttcaaagtctgtcgactgttacgtatacaaatctatatatcaaataaagacggcgccgtacgtgtgtatatgtctct

SEQ ID NO: 3079 - protein, 91 aa, Zea mays
  misc_feature: Ceres CLONE 282286-F
MEGKTGQLRCCFVAIVLVLGLVLESHQAEAGGKWCCETATGKYHFNRCVDSGLVDNIGFCAGNAGCIIMEDRCGGRWRCLLVMRFPWMSFD

SEQ ID NO: 3080 - DNA, 524 bp, Zea mays
  misc_feature: Ceres CLONE 282297-F
  misc_feature: Encodes the peptide sequence at SEQ ID NO. 3081
accgagccgaccgatcgtcgctcatctttgtaggacacccgcaccctccgcgtcgaacacccgatccggacaccgctccaggctccacctctctcccatctcacgccaacgctcactggaccattcctccgtgcttgggagcggcggagagctatccacctcgtctcaggcaccctctggcgtccccctccccccgccgcgtgccggcaagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgttaacattggtgcggcaaatgccccatcccaggtcctggcaacgcttagtggccactatggtcctgtgtggcgtggttgcttgggccatccaaagtatggtgcaatccttgcatcgttgcag

SEQ ID NO: 3081 - protein, 78 aa, Zea mays
  misc_feature: Ceres CLONE 282297-F
MSSKKIELDHKDMVHDSAIDYYGKRLATASSDFTVKIVNIGAANAPSQVLATLSGHYGPVWRGCLGHPKYGAILASLQ

SEQ ID NO: 3082 - DNA, 455 bp, Zea mays
  misc_feature: Ceres CLONE 282311-F
  misc_feature (77)..(77): n is a, c, t, g, unknown, or other
  misc_feature (78)..(78): n is a, c, t, g, unknown, or other
  misc_feature (139)..(139): n is a, c, t, g, unknown, or other
  misc_feature (296)..(296): n is a, c, t, g, unknown, or other
  misc_feature (379)..(379): n is a, c, t, g, unknown, or other
actcatacatttcgactctcaactcccaaggtccctttttttttctcgatctggaagcgccgcagtagcagccatgnncgtgagcggasaggcggtaaggcgaagaagggcgcggcggggcgcaaggccggcgggcgancgaagaagtcggtgtcgcggtcctccagggccgggctgcagttccccgtcagccgcgtcgggcggtacctcaaaaagggccggtacgcgcrbttaaggcacgggtgcccccgtctacctcgccgccgtcctggagtacctcgcggccgaggtgctanctcgccggcaacgscatagggacaacaagaagacgcgcatcattccgcgccacgtgctcctcgccatccgcaacgacgagganytcggcaayctgctggccggcgtcaccatcgcccacggscgttcctccccaacatccacactgtgctcctccccaa

SEQ ID NO: 3083 - DNA, 487 bp, Zea mays
  misc_feature: Ceres CLONE 282317-F
  misc_feature: Translation starting site: 61
caaacctctcctggcacgagatcacgcttctcgtcggatcgaacagctagggtttccaagatgttcgggcgcgcgcgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgt

SEQ ID NO: 3084 - DNA, 423 bp, Zea mays
  misc_feature: Ceres CLONE 282332-F
  misc_feature: Translation starting site: 70
  misc_feature (67)..(67): n is a, c, t, g, unknown, or other
  misc_feature (232)..(232): n is a, c, t, g, unknown, or other
aatcttgctctgaacgcattcctcccatctcccaagacctcctcagacccgagaagcgcmkgcgggnccatggacgccaccggcactggagctggagggaaggcgaagaagggagcggccggtcgcaaggccgsgggcgaggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcg

SEQ ID NO: 3085 - DNA, 136 bp, Zea mays
  misc_feature: Ceres CLONE 282346-F
acacgcacaccgcgacccagtccagagccagtacgtgcgamggcacgcacgctgctggctccgcgtacsagacgacggtcaggtcggccggtgcttttcagtttggaataatgacggcgacgacgacgacagccgc

SEQ ID NO: 3086 - DNA, 481 bp, Zea mays
  misc_feature: Ceres CLONE 282360-F
  misc_feature (76)..(76): n is a, c, t, g, unknown, or other
aacagccctacaacttactgcttgctctagctagctagctgctcccggcccatatccactacacaagtaggctwancagcagcagcagcaatggcctcggtgacgrttcccggccgtggcctcgtcctgctgctcgccgccagcgccttcctggccagcgaggtggcggcgtgcggcggctgccgaaaccaactcctcctcctccatcgccaccaccgccgtcgcccaccagcacgccgtscctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgcgacctggaggccgccgtctgcctctgcaccgcgctcaaggccaacgtgctcggcatcaacctcgacgtccccgtcaagctcaccctgctcctcaacta

SEQ ID NO: 3087 - DNA, 447 bp, Zea mays
  misc_feature: Ceres CLONE 282396-F
  misc_feature (168)..(168): n is a, c, t, g, unknown, or other
  misc_feature (205)..(205): n is a, c, t, g, unknown, or other
  misc_feature (239)..(239): n is a, c, t, g, unknown, or other
  misc_feature (266)..(266): n is a, c, t, g, unknown, or other
  misc_feature (298)..(298): n is a, c, t, g, unknown, or other
atccgtgcatacatgctcattgctcaccaagggcaagggaggaggagaggacacacagcagtagcgcgaaatggcggcgatgatgatggatagtaccgcggagaaagacctcgccggcgacgsttgcggtgagcgggcacgggcaggacttggagcggtcttgccatnaccaggagcccgccgctgcagatggtgcgagcagcanaggcctagccatcgggcgtttcgtacgggarctnatggtggagggcgtggcgtcgttcctnctggtgttctggtccgcggtggcgcgctgatncaggagatkcacggcacgctgackttccccatggtgtgcctcgtcgttcgcgctcaccgtcgtcttcgtgctctgctggctcggccccgcgcacttcaaccccgccgtcaccgtcaccttcaccgtattcggctacctctcctggacca

SEQ ID NO: 3088 - DNA, 211 bp, Zea mays
  misc_feature: Ceres CLONE 282420-F
  misc_feature (161)..(161): n is a, c, t, g, unknown, or other
  misc_feature (163)..(163): n is a, c, t, g, unknown, or other
atagatgagggtgagagcatttggcgtasgcttgacgagcgacgagtaaaccctaatgctttgatcgcggcggcgtcgtttgagacactcccgaatcgatccgcctacatgcctatgaatcctcctcccccgccagcctcctgggtcggcgtcttcgacgncnggggggccagctacttccctctccctttccacctgcagcagcaccagc

SEQ ID NO: 3089 - DNA, 212 bp, Zea mays
  misc_feature: Ceres CLONE 282424-F
agtgcccgcggtgctagtgacggttgctctagatccgttcatcctggtggttttgtgaggtcgaaagcggcgagcgaattagaagatgctggacaagctgtgggacgacgtggtggccgggcctcgccgaggacggcctcgagaagctccgcaaggccaccaccgcccgcccgctcgtcatcaacaaagacgcggacggcggcactacaagc

SEQ ID NO: 3090 - DNA, 270 bp, Zea mays
  misc_feature: Ceres CLONE 282426-F
  misc_feature: Encodes the peptide sequence at SEQ ID NO. 3091
  misc_feature (120)..(120): n is a, c, t, g, unknown, or other
  misc_feature (224)..(224): n is a, c, t, g, unknown, or other
aagacgtggaccgttgtttgcattgcaatggccgctgcgagttggaggacggggcacaactccctcgccgtcccgcgccgtgctccaagcagaaccggaccaccagcaatagcaagccgncggtggtgatcgcgcacgagtgccccagcgcgatgcgtgcccacgtggtgaggtgcccgcggggsgcgacgtgctgtcgtgcgtctcggcgttcgcgcggcgtnggcggcgcggcgstgggtgctgggcgcggccgggcaattcacggac

SEQ ID NO: 3091 - protein, 89 aa, Zea mays
  misc_feature: Ceres CLONE 282426-F
  misc_feature (40)..(40): Xaa is any aa, unknown, or other
  misc_feature (79)..(79): Xaa is any aa, unknown, or other
DVDRCLHCNGRCELEDGAQLPRRPAPCSKQNRTTSNSKPXVVIAHECPSAMRAHVVRCPRGATCCRASRRSRGVGGAAXGAGRGRAIHG

SEQ ID NO: 3092 - DNA, 1700 bp, Zea mays
  misc_feature: Ceres CLONE 282438
  misc_feature: Encodes the peptide sequence at SEQ ID NO. 3093
aaatcctagcccccccccaccctagcaccaccgcggcctgccttctctgggcgggtccttcccagatccatcacgggaggttaaaaaggaggcgggcaggtggtggatggacgggccgaagcgacacctgcgggtgcgcctccgcgtcactgcgcgccggcggggcgcctacggcgatggcgctggaggcgcgttggggcccakgcggcggaagtgccggatggagacccccgttctcaactccgctgccaagcttcagcgccgcgagatcgggggtykccagctcgcggcacgcggcggcggccccrccgycgccgtgccccavcgcttccggaacatgcagytccaggaggagttcratacatatgatgacaatgctaacctatttgtgaagctgcagtttcttaaaagaaratccaaaattaatgagattgttgcascaaaggatatmatatttgcccttgctaattctgggctttgtgctgcttttaaccgagtaacaaacaagcgcataggcttcttgaatttgagcccagatgaagtgattcggagcttgttctacaacaagaacaacgattcccttattaccgkttcagtttatgcatctgacaatttcagcacattgaagtgcagaacaaccccggttgagtatattagaaggaatcagttagatgctgggtttcccctctttgaatcagagtctctgaaatggcctggatttgtggagtttgatgacgtaaatggaaaagtactcacatattyagcgcaggatggtatatataaggtctttgacttgaagaactactacttcctatattcaataccagatgaaaatgtgcaggagataaagatcagtccaggaatcatgctcttgatatacgacagaacaccaagttatgtcccattgaagatattatctattgaagatgggaaacaactgaaattttttaagcacttgttacatcgcaacaagaaaattgatttcattgagcagttcaatgagaagctccttgtcaagcaagaggacgaaaacttccagatacttgatgtgcggagttctgagctaattgaagtcaatgtctccaagtttatgaccccttcagcattcatttttctttatgagaacaatctcttcttgacattccgaaacagaacagtcgctgtatggaacttccgaggagatcttgtgacttcatttgaggaccakttactttggcatcatgattgkagcaccaacaatatttacatcactagcgaccaggatcttattatctcatactgcaaatcggaggcagtggctgaggatggtacagttgttccagttggatccatcaacatgagcgagatcatgactggcaagtgtatcgccaagattactgccaacgatcctgccctaagtgcgccccctcgcagaaatggtcgcagcaagcggcggtcctcggtytggagcaccgttccagaagctytggaggacgtcacggcactgttytatgacgaggacaggaatgagatctacaccggcaacagtcatggactggtgcatgtatggtctaactagatggtaacatgtccatacatctcgcccttttgatttgacttggctagcctgactgcattctgtataatccccggcttggggctcacctagattttgtatttggcaatagaatgtgtttccttgagcaaaaaaaaaaaaaaaa

SEQ ID NO: 3093 - protein, 483 aa, Zea mays
  misc_feature: Ceres CLONE 282438
  misc_feature (33)..(33): Xaa is any aa, unknown, or other
  misc_feature (58)..(58): Xaa is any aa, unknown, or other
  misc_feature (68)..(68): Xaa is any aa, unknown, or other
  misc_feature (69)..(69): Xaa is any aa, unknown, or other
  misc_feature (73)..(73): Xaa is any aa, unknown, or other
  misc_feature (80)..(80): Xaa is any aa, unknown, or other
  misc_feature (85)..(85): Xaa is any aa, unknown, or other
  misc_feature (103)..(103): Xaa is any aa, unknown, or other
  misc_feature (112)..(112): Xaa is any aa, unknown, or other
  misc_feature (115)..(115): Xaa is any aa, unknown, or other
  misc_feature (162)..(162): Xaa is any aa, unknown, or other
  misc_feature (219)..(219): Xaa is any aa, unknown, or other
  misc_feature (367)..(367): Xaa is any aa, unknown, or other
  misc_feature (374)..(374): Xaa is any aa, unknown, or other
  misc_feature (446)..(446): Xaa is any aa, unknown, or other
  misc_feature (454)..(454): Xaa is any aa, unknown, or other
  misc_feature (461)..(461): Xaa is any aa, unknown, or other
MDGPKRHLRVRLRVTARRRGAYGDGAGGALGPXRRKCRMETPVLNSAAKLQRREIGGXQLAARGGGPXXAVPXRFRNMQXQEEFXTYDDNANLFVKLQFLKRXSKINEIVAXKDXIFALANSGLCAAFNRVTNKRIGFLNLSPDEVIRSLFYNKNNDSLITXSVYASDNFSTLKCRTTPVEYIRRNQLDAGFPLFESESLKWPGFVEFDDVNGKVLTYXAQDGIYKVFDLKNYYFLYSIPDENVQEIKISPGIMLLIYDRTPSYVPLKILSIEDGKQLKFFKHLLHRNKKIDFIEQFNEKLLVKQEDENFQILDVRSSELIEVNVSKFMTPSAFIFLYENNLFLTFRNRTVAVWNFRGDLVTSFEDXLLWHHDXSTNNIYITSDQDLIISYCKSEAVAEDGTVVPVGSINMSEIMTGKCIAKITANDPALSAPPRRNGRSKRRSSXWSTVPEAXEDVTALXYDEDRNEIYTGNSHGLVHVWSN

SEQ ID NO: 3094 - DNA, 477 bp, Zea mays
  misc_feature: Ceres CLONE 282456-F
  misc_feature: Encodes the peptide sequence at SEQ ID NO. 3095
  misc_feature (376)..(376): n is a, c, t, g, unknown, or other
  misc_feature (379)..(379): n is a, c, t, g, unknown, or other
  misc_feature (391)..(391): n is a, c, t, g, unknown, or other
aggaacaaaggaaagcaatcacagccagacgagatccgagcagagaaggggagctacctgctacgactagctagattccacacgcgatggcgcccaccaggatccgcgtggccttgctgagcttggcgctggtggggctgctcatctgccacctcgccaccaccgcctccgccggcaagaacagaatccgcatcctcgacagcgtsacgactcggccggggacaacaacagctccgacgcctcggccggggacaacagcaccgactccgagtcgaaggccgcgtcgtctattccgacatgaagctggctgatgagacgggatctgcgccggctccggcaccggcgccggggccgacgaccagttgaagcgaggaangtngccaaaacttanggcccggctactatcttttgctataactaaagatakggccaagtttaatttgtccaataaattctgtccgagcaaaaaagtatgat

SEQ ID NO: 3095 - protein, 74 aa, Zea mays
  misc_feature: Ceres CLONE 282456-F
MAPTRIRVALLSLALVGLLICHLATTASAGKNRIRILDSVTTRPGTTTAPTPRPGTTAPTPSRRPRRLFRHEAG

SEQ ID NO: 3096 - DNA, 381 bp, Zea mays
  misc_feature: Ceres CLONE 282461-F
  misc_feature (377)..(377): n is a, c, t, g, unknown, or other
atctaaattaacacaagcagtcaaacgcatgcacacacaaggttgttgttagcaatttttctgctgctgctatacatacacgagctgcgcgcgattggccgccctggcagctgcacttgttgcgctcctcgccgtgcttgctgtcgcgcatcctgtcgccgtcgcacaatcggtggcgaaccgcacctccgccgtccgccagctccgcgtagctccagcgaaggcgtttggctggcggccaaggccacctggtatggcgcgcccaacggscggcccccgacgacaacggcggcgcgtgcgggttcaagaacaccaaccggtacccgttcatgtccatgacgtcgtgcggcaaccagcccctgttccaggacggccanggct

SEQ ID NO: 3097 - DNA, 391 bp, Zea mays
  misc_feature: Ceres CLONE 282475-F
  misc_feature (238)..(238): n is a, c, t, g, unknown, or other
atacatttcgactctcaactcccaaggtcccttttttttctcgatctggaagcgccgcagtagcagccatggacgtgagcggacaggcggtaaggcgaagaagggcgcggcggggcgcaaggccggcgggcgacgaagaagtcggtgtcgcggtcctccagggccgggctgcagttccccgtcagccgcgtcgggcggtacctcaaaaagggccggtacgcgcabgtaggcacgggtncccccgtctacctcgccgccgtcctgggagtacctcgcggccgaggtgctcgagctcgccggcaacgcscaagggacaacaagaagacgcgcatcattccgcgccacgtgctcctcgccatccgcaacgacgaggagctcggcaagctgctgg

SEQ ID NO: 3098 - DNA, 114 bp, Zea mays
  misc_feature: Ceres CLONE 282489-F
acgcacaccgcgacccagtccagagccagtacgtgcgaggcagcacgcacgctgctggtccgcgtacsagacgacggtcaggtcggccggtgcttttcagtttggaataatgac

SEQ ID NO: 3099 - DNA, 493 bp, Zea mays
  misc_feature: Ceres CLONE 282520-F
  misc_feature: Encodes the peptide sequence at SEQ ID NO. 3100
atctatctttgtggtcgtggtcctcccgtcgtcgtcgactcgtcgtcgtcggtgttgctccgatgggcaaggactcgaagcctaaggacgccaaggggaagggcaagcaggcggccggctcctctggcggcgacgacggcggcggcaakggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttat

SEQ ID NO: 3100 - protein, 143 aa, Zea mays
  misc_feature: Ceres CLONE 282520-F
  misc_feature (56)..(142): Pfam Name: Rotamase Pfam Description: PPIC-type PPIASE domain
  misc_feature: SWISSPROT Homolog: EC 5.2.1.8 Peptidylprolyl isomerase
  misc_feature (29)..(29): Xaa is any aa, unknown, or other
MGKDSKPKDAKGKGKQAAGSSGGDDGGGXGGKGKGKGKGGKSADGLGTCTYVKARHVLCEKQGKINEAYKKLQDGWLNNGDKVPPAEFAKVAQEYSECPSGKKGGDLGWFPRGKMAGPFQEVAFNTPEGTVSAPFKSTHGYHF

SEQ ID NO: 3101 - DNA, 500 bp, Zea mays
  misc_feature: Ceres CLONE 282555-F
  misc_feature: Encodes the peptide sequence at SEQ ID NO. 3102
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcycgcagcagntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcga

SEQ ID NO: 3102 - protein, 100 aa, Zea mays
  misc_feature: Ceres CLONE 282555-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRWRRRRPCRASARGAARSRPSPTSCTSRR

SEQ ID NO: 3103 - DNA, 432 bp, Zea mays
  misc_feature: Ceres CLONE 282596-F
  misc_feature: Translation starting site: 53
  misc_feature: Pfam Name: Mo25 Pfam Description: Mo25-like
  misc_feature (145)..(145): n is a, c, t, g, unknown, or other
  misc_feature (271)..(271): n is a, c, t, g, unknown, or other
agcaataattggtcgctccccgatccatctgggtttcgcctgcyagcgsgagatgtccttcttcttccgggccgcatcgcgagcgcccgttgccgcagagatcgcgcgctccatcaaggactccctcgttgccctcgacaccaanaccggcgccaaggytcttgaggatgctgagaaaaacatacttacattgagggcatacactttgctggttaatgggagaaktggaaccaaatcaagagcaggttttgcagatagcccttgagatttncaaggagggtgttctttccctctttgttcagaatcttccttcattgggttgggaggctataaaggatctttttccactgctggtgtattttgttgagacagaaggttgatgaaagctattgttgcgtccagtatattgaaaatcattttgatcttttagat

SEQ ID NO: 3104 - DNA, 705 bp, Zea mays
  misc_feature: Ceres CLONE 282601-R
  misc_feature (1)..(1): n is a, c, t, g, unknown, or other
  misc_feature (683)..(683): n is a, c, t, g, unknown, or other
ncgattggtgaccgggccccccctcgaggtcgacggtatcgataagcttttttttttttttttttgggccaagatatcttgttgcgatcgatcagttgcctatgcctctcctcttccgactcccacccctctctctctcacccccaccacatcatgcctcctcctttcatggcagagacgcagacgcaacagcgagacaggaacagcatcatggccaaccagaatgctccatcgctctctccatcccctcgacagagacggagagatggggttagaaagaggggcaaggcaacaacatgctattgcaatagcatagggacactgcagctagtgctagtacgtacgtatctgactttgcttgtactacctaccatgcaaatcaagcaagcaacgagctcagcatcgttcgtttgttcatgcgaatttgtgatgatgatgatgatgctctccttcaaggcgggcaccaggtgtggtgtgaccgatccatcacatcaatggctgcacaggtcggagagctccttcctgccctcgacaatgtcgtccaggaagtcgtccagctggcacaccaggctatcggtgccggtccggagcacgtccagccacgccttcagctcctccaccttgtccttgacagcgcttccgccgccgccgccgccctcgcacttgcgtcccgccgccgcggngcgcttcacctcctcccgcgcc

SEQ ID NO: 3105 - DNA, 445 bp, Zea mays
  misc_feature: Ceres CLONE 282604-F
  misc_feature: Pfam Name: TatD_DNase Pfam Description: TatD related DNase
agaggatttctattgtagaaatgcagttaggcccattaggttttgcccttttttttcagactcggattggtccgccctccttgtgctccgccggcaatggcgtccaccgccgtcaagctcatcgacatcgcagtcaacttcacagatggcatgttcaagggcatctaccacggcaagcagtgcacgccgccgacatcccggccgtactcgcgcgcgtgggctgcaggcgtcgatcgcatcattgtcaccggagctccctkaaagagtccagagaggcattgcagatcgccgagaccgacgggagactgttctgcactgtgggagtgcacccaacaagatgcggggaattcgaggagagtggagatcccgagggtcattttcaggcactgctggctctagcgaaggagggtttakataaaagcaaggtcgttgctgttggtgaatg

SEQ ID NO: 3106 - DNA, 217 bp, Zea mays
  misc_feature: Ceres CLONE 282614-F
atcggtcgtgaaaagaaaaagggaaacaaaccaagctagctagagaaaagaagaagctggtactagctagctagctagcttagctatgggcacatcgtggacgctgacgtcgggttcgcggtgaagaggacgagcaggtcgctggtgccgcctgcktcggcgascgcgggatacgctgcggctgtcggtgatcgaccgcgtggcgggctgcgcacct

SEQ ID NO: 3107 - DNA, 153 bp, Zea mays
  misc_feature: Ceres CLONE 282664-F
aaaacaaaaaccctagccgccgcgccgccccgctccctagtggtgctccctcccccaccactgcagctccgtcccggcggccccaagagttgcggcgaggatgaacgtgaagggcggcasggattccggtacccccgccggcccagcgcgctg

SEQ ID NO: 3108 - DNA, 467 bp, Zea mays
  misc_feature: Ceres CLONE 282668-F
  misc_feature: Encodes the peptide sequence at SEQ ID NO. 3109
accgcagccctagcgcgccgccaccttcaccttcccaggccgccgccgccgccgcctccattgctgctaaacccgcaaccatgggtcccgtgctgaagcgcccgaccccgggcacgtgcagtgcttcgggcgcaagaagacggccgtggcgtggcctacacgaagccaggccgggggatgatcaaggtgaacggcgtcccgatcgagctgctccgtcccgagatgctgcggctcaakgccatggagcccgtgctgctkgcggggcggtccaggttcaaggacatcgacatgcggatccgcgtgcgcgccggcgggaakacgtcgcagatctacgccatccgccaggccgtcgccaagggtctcgtggcctactaccagaagtacgtggacgaggcggctaaaaaggagatcaaggacatcttcatgcgctacgatcsaccctcctcgtcgccgacccccgccgctgc

SEQ ID NO: 3109 - protein, 96 aa, Zea mays
  misc_feature: Ceres CLONE 282668-F
  misc_feature (1)..(87): Pfam Name: Ribosomal_S9 Pfam Description: Ribosomal protein S9/S16
  misc_feature (20)..(20): Xaa is any aa, unknown, or other
  misc_feature (47)..(47): Xaa is any aa, unknown, or other
  misc_feature (87)..(87): Xaa is any aa, unknown, or other
MIKVNGVPIELLRPEMLRLXAMEPVLLAGRSRFKDIDMRIRVRAGGXTSQIYAIRQAVAKGLVAYYQKYVDEAAKKEIKDIFMRYDXPSSSPTPAA

SEQ ID NO: 3110 - DNA, 92 bp, Zea mays
  misc_feature: Ceres CLONE 282685-F
  misc_feature: Encodes the peptide sequence at SEQ ID NO. 3111
aaagtttcgtccaccatttcgctctcgcaagtbgccaagccaccgatttgtttacaggcgccggagctcccgacgacgactgagccatgtgc

SEQ ID NO: 3111 - protein, 30 aa, Zea mays; identical to SEQ ID NO: 2126
  misc_feature: Ceres CLONE 282685-F

SEQ ID NO: 3112 - DNA, 269 bp, Zea mays
  misc_feature: Ceres CLONE 282716-F
  misc_feature: Encodes the peptide sequence at SEQ ID NO. 3113
  misc_feature (157)..(157): n is a, c, t, g, unknown, or other
agcggcasaatcccctcctcctcctccctgttcctggacgccggctccggsccggctcctcatcgtccgcgggtaaggagactgaagtggtgaacacggaagaaggttgccattttactaagttaaagttagatcattggagcaatgccgccccatnagatcgagactgggcaccaagatgtggtgcatgatgtcgccatggattactatggcaagcgcctagctacatcctcctctgataatacaataaagatcattggcgtaagtgg

SEQ ID NO: 3113 - protein, 41 aa, Zea mays
  misc_feature: Ceres CLONE 282716-F
  misc_feature (1)..(39): Pfam Name: WD40 Pfam Description: WD domain, G-beta repeat
  misc_feature (5)..(5): Xaa is any aa, unknown, or other
MPPHXIETGHQDVVHDVAMDYYGKRLATSSSDNTIKIIGVS

SEQ ID NO: 3114 - DNA, 1856 bp, Zea mays
  misc_feature: Ceres CLONE 282731
  misc_feature: Encodes the peptide sequence at SEQ ID NO. 3115
attttgaaaaccttagatcagcgatttcaagttgcaccctctcatgagctcaaaagttttagctgcttgtatgggcttgggcttcaattaaatcctagcacgctttcttgatggcgatggttgctttatcctgatagtaggtctggcggtctccggcttggcggtgagccggtgacgatgatacgacctggttggaggttggaggtggagcaggagagtttgcaggagcagttggcatgggcgctggcactcgtccactcgcgtcagccatccgacgccaccaaggtgtcggctctgacgtggcaccttgcgcttgcgcacggactccgtcgctgattcgtttgtctcttccccagtcgcgcaccgcgggccgcggttcgcctggtggctgcgacgtgagtgggcctatatcagcgcggcactcacggggagcggtggcaacccatatccatcacggcgaagagacctcgggagtgagtgggccgctgggagagcagacaacactgcaacggggtgcgcgcccgcccgtgccgttctccgtcgtcaccgttcgcccgctgccgatccatggggtgggcgctggctctgcacggcggcgccggggacgtgccgcgcacgctgccgcccgagagcagggagccgcgcctcgccacactccgccgctgcctcgacatcggcaccgccgcgctccgggagggccgcaccgcgctcgacgttgtcgagctcgtcgtgagggagctggaggactgcccgcacttcaacgccggccggggctccgtgctcacctccgccggcaccgtcgagatggaggcctgcgtcatggagggagccaccctgcactgcggcgcggtctccggactctccaccgtcgccaacgccgtctccctcgccagactcgtcatggagaagacgccgcacatctacctcgccttcgatggcgccgaggccttcgccagggaacagggggtggagactaaggatccaagccactttatcacggacaacaatatcgagcgtctgaggcaggccaaagaggccaacagggtgcagatcgactacacccagccagcagcaggccaaagccaaaaggcccaggccgtggtggacgacaactgccagacgggcacggtagggtgcgtggccgtggacgcggcgggcaacctcgcgacggcgacgtccacgggcgggctggtgaacaagatgcccggcaggatcggcgacacgcctctggtgggcgccggaacgtacgccaacgcgctgtgcgcggtgtccgccacgggcaagggcgaggagatcatccgccgcacggtggcgcgcgacgtcgcggcgctgatggagcgcggggacgcgctcccgctgcgcgacgccgcggcgcgcgtcgtggcgggggcggcccgcggcgccgtggggctggtggccgtgtcgcgccagggggaggtctgtatggcgcacaacaccaccgccatgttcagggcgtgcgccaccgaggccggccacaccgaagtcggcatctggacggacgccgccgacgcaggcacgggcgcggacggagagactgtcagcgtcgcgctctagctctaggcatttcatccccgtgtggcgtattctatcgttcgcgtcccattattgccacctgtccgatagacaacttgttctcgatccggtaatttcaccgtgcttcagctgcgtgtgtttggaaaaattgattcggtttcgggtattgttaagagatcgatgggagaagtgaaacattgttgggcgttcagtatgcttttgtaataccttttgttttcttaaataaagtcctaaggagtgttgggaaaaaaaaaaaaaaaaaaataaaaaaaaaaaaaaaa

SEQ ID NO: 3115 - protein, 335 aa, Zea mays
  misc_feature: Ceres CLONE 282731
  misc_feature (1)..(318): Pfam Name: Asparaginase_2 Pfam Description: Asparaginase
  misc_feature: SWISSPROT Homolog: EC 3.5.1.1 Asparaginase
MGWALALHGGAGDVPRTLPPESREPRLATLRRCLDIGTAALREGRTALDVVELVVRELEDCPHFNAGRGSVLTSAGTVEMEACVMEGATLHCGAVSGLSTVANAVSLARLVMEKTPHIYLAFDGAEAFAREQGVETKDPSHFITDNNIERLRQAKEANRVQIDYTQPAAGQSQKAQAVVDDNCQTGTVGCVAVDAAGNLATATSTGGLVNKMPGRIGDTPLVGAGTYANALCAVSATGKGEEIIRRTVARDVAALMERGDALPLRDAAARVVAGAARGAVGLVAVSRQGEVCMAHNTTAMFRACATEAGHTEVGIWTDAADAGTGADGETVSVAL

SEQ ID NO: 3116 - DNA, 502 bp, Zea mays
  misc_feature: Ceres CLONE 282748-F
  misc_feature: Encodes the peptide sequence at SEQ ID NO. 3117
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgckacaacggaactggcatggtcaaggctgggttcgccggcgacgacgccccgagggccgtcttccccagcatcgtggggcgcccgckcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacaccccgctatgtac

SEQ ID NO: 3117 - protein, 89 aa, Zea mays
  misc_feature: Ceres CLONE 282748-F
  misc_feature: SWISSPROT Homolog: EC 2.7.10.2 Non-specific protein-tyrosine kinase
MVGMGQKDAYVGDEAQSKRGILTLKYPIEHGIVSNWDDMEKIWHHTFYNELRVAPEEHPVLLTEAPLNPKANREKMTQIMFETFNTPLC

SEQ ID NO: 3118 - DNA, 100 bp, Zea mays
  misc_feature: Ceres CLONE 282758-F
  misc_feature: Encodes the peptide sequence at SEQ ID NO. 3119
aaaataataggaaaatactcccgtgttcttcgaccggcggcggtggtgcgamgagggcggttaagggagacgagatgagggggacgaagcggccgctcgg

SEQ ID NO: 3119 - protein, 32 aa, Zea mays
  misc_feature: Ceres CLONE 282758-F
  misc_feature (17)..(17): Xaa is any aa, unknown, or other
NNRKILPCSSTGGGGAXRAVKGDEMRGTKRPL

SEQ ID NO: 3120 - DNA, 489 bp, Zea mays
  misc_feature: Ceres CLONE 282761-F
  misc_feature: Encodes the peptide sequence at SEQ ID NO. 3121
  misc_feature (434)..(434): n is a, c, t, g, unknown, or other
actccccactcttggtgctcttgcttgaatatagtccccctcctctctctctcacacacctgttcttcgatctcggcctagctagctagctagcgagcaagctatagcttagctcggctagccgggtgtgtcgccggtcggctaggcaacgcgctagcgatcgcaaaatggcagatgcgggggaggggcggcgggtgtgcggcatgccggakaaggcgcactgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgntctgsgcatcacggcgaaccaagggttttacctcctgggcctggacaacacgttc

SEQ ID NO: 3121 - protein, 85 aa, Zea mays
  misc_feature: Ceres CLONE 282761-F
  misc_feature (68)..(68): Xaa is any aa, unknown, or other
  misc_feature (69)..(69): Xaa is any aa, unknown, or other
MLALQFGYAGFHVVSRLALNMGISKLVFPVYRNIIALCLLVPFAYFLEKKDRPQLTLNFVVQFFFLAXXASRRTKGFTSWAWTTR

SEQ ID NO: 3122 - DNA, 484 bp, Zea mays
  misc_feature: Ceres CLONE 282767-F
  misc_feature: Encodes the peptide sequence at SEQ ID NO. 3123
  misc_feature (318)..(318): n is a, c, t, g, unknown, or other
agccctagtaaccctagccgcctgaggscgacgccaactctctcctgaccgcaacggggaactcgacccccgcctccgccaccgccaccgcgccggtcgccgacccactcagatgaacacgtctccgtccagatacagggcaatgatgggaggctgggggggttcggatgggtacgagggatcaaagaggacgcgaatgatgatggaatcgaatccctacttcgcagtgaacgcagggagcccactggatgtctcaaagagggcaaggatggaaccaggtgctccctattttggggctatgggaagcagcgccabttngccggcggtggcttctaccagccctttaacagcaacctagctggtgcagggtctagcaccggttatccaaagcttcccatgtgtccggctgcgaggcctcccctttgattgcaacgacattgacgtctgcaagttctttgtgggggctggacatagtggactgcct

SEQ ID NO: 3123 - protein, 81 aa, Zea mays
  misc_feature: Ceres CLONE 282767-F
  misc_feature (68)..(68): Xaa is any aa, unknown, or other
  misc_feature (69)..(69): Xaa is any aa, unknown, or other
MNTSPSRYRAMMGGWGGSDGYEGSKRTRMMMESNPYFAVNAGSPLDVSKRARMEPGAPYFGAMGSSAXXPAVASTSPLTAT

SEQ ID NO: 3124 - DNA, 466 bp, Zea mays
  misc_feature: Ceres CLONE 282771-F
  misc_feature: Translation starting site: 58
  misc_feature: Pfam Name: SWIB Pfam Description: SWIB/MDM2 domain
atccgaagttccgaacccaagccaagccccagggtccgaccgcagaaccgacccaaaatgtcgcccgcctgctccatgctcaccaccgcgtcgctctcctccccgctcccagccccgcgcctccggscgccgccgccttcgctccgccgcgccggcgaagttcacactcgtcgtgcgcgcgggtccgcatcttccaagtcccctgccacggcggaggcggccccgaagaagaagagggcgaccggcatcacccagccgaagtccgtgtcgccggcgctgcaggcaatcgtgggcgacccggttattccccgcaccgaggtcctcaagcgcctctgggcctattatcaaggagcataacctccaggatccctctgataaaaaggtggtggtttgtgatgagaagctgaaggtcctgttcgcggggcgggacgcattgggattcctttgagatcgccaagcttctcaa

SEQ ID NO: 3125 - DNA, 193 bp, Zea mays
  misc_feature: Ceres CLONE 282776-F
  misc_feature (126)..(126): n is a, c, t, g, unknown, or other
  misc_feature (137)..(137): n is a, c, t, g, unknown, or other
actcatacatttcgactctcaactcccaaggtcccttttttttctcgatctggaagcgccgcagtagcagccatggacgtgagcggasaggcgggaaggcgaagaaaggcgcggccggcgcaaggncggcgggcrancgaagaagtcggtgtcgcggtcctccagggccgggctgcagttccccgtcacccgc

SEQ ID NO: 3126 - DNA, 112 bp, Zea mays
  misc_feature: Ceres CLONE 282788-F
acacgcacaccgcgacccagtccagagccagtacgtgcgamggcacgcacgctgctggttccgcgtacgagacgacggtcaggtcggccggtgcttttcagtttggaataat

SEQ ID NO: 3127 - DNA, 486 bp, Zea mays
  misc_feature: Ceres CLONE 282823-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgagggccttaacatagtgc

SEQ ID NO: 3128 - DNA, 443 bp, Zea mays
  misc_feature: Ceres CLONE 282910-F
  misc_feature: Encodes the peptide sequence at SEQ ID NO. 3129
  misc_feature (58)..(58): n is a, c, t, g, unknown, or other
atcggttttgcaggtcaaaaggtaacggctgggagtaaccagctccgccggcctcckngacatcgtccacgtcgacccagatttcttcagataccttcgcttcgatttcgaggcgagggggaagcttcagctataggggcgavrgtgggagccatcagccatgtgctaccaggtgaagtgcgggtcgtgcggcaagtccacgtgggcgggctgcggccgccacgtcgcctccgtgcatcgccagatcccccagggccagcactgcgcctgccgcgactggccgggcgttgcaccggckggcgacaaggcggccgcgcggaggggccttcgtccacgtctatctgcaccatcctgtgatctgagcccgcgcatkttagctctggtgtagggggttgtgcgattgtgtacggttatacttctctctctctctctctctctctctc

SEQ ID NO: 3129 - protein, 75 aa, Zea mays
  misc_feature: Ceres CLONE 282910-F
  misc_feature (71)..(71): Xaa is any aa, unknown, or other
MCYQVKCGSCGKSTWAGCGRHVASVHRQIPQGQHCACRDWPGVAPAGDKAAARRGLRPRLSAPSCDLSPRXLALV

SEQ ID NO: 3130 - DNA, 461 bp, Zea mays
  misc_feature: Ceres CLONE 282917-F
  misc_feature: Translation starting site: 250
  misc_feature: Pfam Name: IU_nuc_hydro Pfam Description: Inosine-uridine preferring nucleoside hydrolase
  misc_feature (47)..(47): n is a, c, t, g, unknown, or other
  misc_feature (264)..(264): n is a, c, t, g, unknown, or other
atccacgcgtgctgccgagccggggtctgctcagcctgtaagcgtcnggttttccagttccagcttctatttttgctccaaacaagtcgtctccactagggatcctatccagattcgtggggacacccccgtccagttccagccttccaacttccaaccctctcctctccgcagctgtagcatttgtacgggttggattgggttgttccgcttgggtagcctggtgggatcgaaatctgtgtgggatccatggcggcggtcgangggacgacgaagaagaaggtaatcatcgacaccgaccccggaattgacgacgcgatggccatcttcgtagcactgcgtcgccggagctggaggtgctgggcctcaccactaccttcggcaacgtccacaccgccctcgccacgcgcaatgcsttccacctgttggaggctgttggaaggactgacatccccgtcgca

SEQ ID NO: 3131 - DNA, 176 bp, Zea mays
  misc_feature: Ceres CLONE 282943-F
  misc_feature: Encodes the peptide sequence at SEQ ID NO. 3132
  misc_feature (95)..(95): n is a, c, t, g, unknown, or other
aattcacgcccccaccacgacttccgtgctcgccgccttctcgrctaggggggttcggctcgagatctgatttcgggcgccggagactacatgrnggttagggagatggcgatggccgcggcgstgcggctgcggcgtccggcgggggaggcgtcaactgccgccgcccaatccca

SEQ ID NO: 3132 - protein, 28 aa, Zea mays
  misc_feature: Ceres CLONE 282943-F
  misc_feature (2)..(2): Xaa is any aa, unknown, or other
  misc_feature (12)..(12): Xaa is any aa, unknown, or other
MXVREMAMAAAXRLRRPAGEASTAAAQS

SEQ ID NO: 3133 - DNA, 1466 bp, Zea mays
  misc_feature: Ceres CLONE 282952
  misc_feature: Encodes the peptide sequence at SEQ ID NO. 3134
aagtccaattccaatctctctcacacacacattgtcgcctgccttcccttccttccccagttgagttccccccgcggccccgcccccggtccccttccaccgacccaccatgtcggcgatgaggtgaggttgaggccaggtctactctccgcgaccgtcgccgacgccatcgccaacgagcagtttgctccatcttcgccatctcgcacacgaatacaatacactagttttggtagagatggaggacggcggcaaggcgccggccggcctgggcaccctgcgcgcggtgctcgccatcctccagtggtggggcttcaacgtcaccgtcatcatcatgaacaagtggatcttccagaaactggatttcaagttccctctcaccgtgtcctgcgtccacttcatctgctcttccattggagcttacattgcaatccatgtcctcaaggcgaaacccctgattcaagttgaaccggaggaccgctggaaaaggatatttccaatgtccttcgtcttctgcataaacattgtgctgggaaatgtcagcttgcgctacatcccagtctccttcatgcagacaatcaaatctttcactcctgcaaccacagttattctgcagtggctagtctggagcaagcatttcgagtggcgcatatgggcttcgctggtccctatagttggcggaatactcctgacttcggtgacagagcttagcttcaacattttcggtttctgtgctgccatggttggctgcctggctacgtctacaaagaccatcttggcagagtccctactccatggatacaagtttgacagcattaacacggtgtactacatggcaccctttgccaccatgatactggctctaccagcgatggtgcttgaaggaggaggtgtaatgaactggttctacacacatgattccatcgttcctgcgctgactatcatcctaggttcgggggtgcttgcgttctgccttaacttctccatcttctacgtcatccattcaacaacagcagtgacgttcaacgttgcaggcaaccttaaagtcgcggtggcagtgttagtgtcgtggtcgatcttccggaatccaatctctgcaatgaatgcaatcgggtgtggaatcaccctggttggttgcactttctatggctacgtgaggcatctgatctcgcagcggcaggctgcagccccagggagtctaggaacagcgcaagcaaggaatcagacggagatgcttccccttgttgtggacgagaagcaagaaaaggtttagcaatggtgctaggccttctcttcacttgttgaagagagaattatatatgtactcgtgcgtgcgtgtgtggtgagggtagtaaactggaacttcgtacaagcatcgtttcctccttccatttgtwaaaaaaaaaaaaaaaaaaaaaaaaaaaaaaaaaaaaaaaaaaaaaaaaaaaagaaaaaaaaaaaaaaaa

SEQ ID NO: 3134 - protein, 344 aa, Zea mays
  misc_feature: Ceres CLONE 282952
  misc_feature (163)..(305): Pfam Name: TPT Pfam Description: Triose-phosphate Transporter family
  misc_feature (30)..(154): Pfam Name: DUF6 Pfam Description: Integral membrane protein DUF6
MEDGGKAPAGLGTLRAVLAILQWWGFNVTVIIMNKWIFQKLDFKFPLTVSCVHFICSSIGAYIAIHVLKAKPLIQVEPEDRWKRIFPMSFVFCINIVLGNVSLRYIPVSFMQTIKSFTPATTVILQWLVWSKHFEWRIWASLVPIVGGILLTSVTELSFNIFGFCAAMVGCLATSTKTILAESLLHGYKFDSINTVYYMAPFATMILALPAMVLEGGGVMNWFYTHDSIVPALTIILGSGVLAFCLNFSIFYVIHSTTAVTFNVAGNLKVAVAVLVSWSIFRNPISAMNAIGCGITLVGCTFYGYVRHLISQRQAAAPGSLGTAQARNQTEMLPLVVDEKQEKV

SEQ ID NO: 3135 - DNA, 484 bp, Zea mays
  misc_feature: Ceres CLONE 282956-F
  misc_feature: Encodes the peptide sequence at SEQ ID NO. 3136
accccactcttggtgctcttgcttgaatatagtccccctcctctctctctcacacacctgttcttcgatctcggcctagctagctagctagcgagcaagctatagcttagctcggctagccgggtgtgtcgccggtcggctaggcaacgcgctagcgatcgcaaaatggcagatgcgggggaggggcggcgggtgtgcggcatgccggagaaggcgcacgtgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgggcatcacggcgaaccaagggttttacctcctgggcctggacaacac

SEQ ID NO: 3136 - protein, 106 aa, Zea mays
  misc_feature: Ceres CLONE 282956-F
MADAGEGRRVCGMPEKAHVHVAMLALQFGYAGFHVVSRLALNMGISKLVFPVYRNIIALCLLVPFAYFLEKKDRPQLTLNFVVQFFFLALWASRRTKGFTSWAWTT

SEQ ID NO: 3137 - DNA, 405 bp, Zea mays
  misc_feature: Ceres CLONE 283049-F
  misc_feature: Encodes the peptide sequence at SEQ ID NO. 3138
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcgg

SEQ ID NO: 3138 - protein, 68 aa, Zea mays
  misc_feature: Ceres CLONE 283049-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNA

SEQ ID NO: 3139 - DNA, 221 bp, Zea mays
  misc_feature: Ceres CLONE 283083-F
  misc_feature: Pfam Name: Cwf_Cwc_15 Pfam Description: Cwf15/Cwc15 cell cycle control protein
ataggctctagtcctctcgcatccgcagcttccccagccagctagggtttgcagatgacgaccgcggcgsccccacctgggcscggtccaatggcggcaacgagcaggggggcaccgcatcttcggyccctcccagaagttctcctcccgcgayctcgccgcgcacacctccctcaagccaagaaaagacagtcaacagacccaagaggagttacagaaga

SEQ ID NO: 3140 - DNA, 238 bp, Zea mays
  misc_feature: Ceres CLONE 283109-F
  misc_feature: Encodes the peptide sequence at SEQ ID NO. 3141
  misc_feature (189)..(189): n is a, c, t, g, unknown, or other
  misc_feature (191)..(191): n is a, c, t, g, unknown, or other
gtatttgctttgcttcctcttctccccctcctccgcgcccgcctcctctcccctaacgcttagggttagccaggcagcgacctccctcgcgaatcctccatagccgccatggyyacggcggttctcagatcccacgatgcgctcaacaaccgcctgcatctcgacgcgtacaccccgtccccggcgaangnccggcgccgtagccccaagccggcggccgcgtcttcgccgcccgcaa

SEQ ID NO: 3141 - protein, 43 aa, Zea mays
  misc_feature: Ceres CLONE 283109-F
  misc_feature (2)..(2): Xaa is any aa, unknown, or other
  misc_feature (27)..(27): Xaa is any aa, unknown, or other
  misc_feature (28)..(28): Xaa is any aa, unknown, or other
MXTAVLRSHDALNNRLHLDAYTPSPAXXRRRSPKPAAASSPPA

SEQ ID NO: 3142 - DNA, 747 bp, Zea mays
  misc_feature: Ceres CLONE 283117-R
  misc_feature: SWISSPROT Homolog: EC 6.3.5.5 Carbamoyl-phosphate synthase (glutamine-hydrolyzing)
  misc_feature (450)..(450): n is a, c, t, g, unknown, or other
  misc_feature (528)..(528): n is a, c, t, g, unknown, or other
caaattgggtaccgggccccccctcgaggtcgacggtatcgataagcttttttttttttttttttctacttgccggccagaaattcgcgagcataatctgagtatactgtaccgtgcaatttgataacatgttattctcaagaaattcaaccagttcactacttcaattcatggtacagttgcagagcatcttatgctatgtcctctggacccaaaattcaagtacatgaacatcccaaagaaaaacactaaaatgaaacaaattcttttgagcttgctgcgagagagcaccaagacaattattgacctttgccagtactcccctcctcacaatctgttgctcttcatgagctctataaactcaccgaaggctgtgtcggaatcatgcggacctggggaagactcaggatggtactggagagacacaagcttcatcttggcgtactgaangccagcacaactattgtcgttgagattgacgggagttacttctggctccttctggaatgaattctgggccaactgccntagtaatggttctggcaccctaagcccaaccctcccctcacgaaaaccaaaaccgggggattcccccctggaaacccaaatttctttttaaaagtgttccccccaaggcccggcccaaaaaattgggggccctaaaaaaggcccaaaaaagagcctttcccaatattttttggagcggccttcaaaaaaaagaaaaacgccgtgggttccccaaaaatt

SEQ ID NO: 3143 - DNA, 467 bp, Zea mays
  misc_feature: Ceres CLONE 283119-F
  misc_feature: Pfam Name: DCP2 Pfam Description: Dcp2, box A domain
attttggttccaaatcgaataacccaatgccgccgtagccgtctgcytcctcgctttcctttcgtccgtacgccgccggctcgcaccgccgacagtcctcagtccagaactccagatcgagcctctctcttcccagatcgggtcctaggctacagcagccgccgcatccgtcaccttcacaccgcgtgcgtkhtctctctcccccctccccctctccgtgcgacgactgggtgggctaccgccgccttacgcaaggtgccgagaacttcgccaaaatctgcgccggagaagagcgcccaccagatcaggagctgagaaggcgcgctggtcggtggatgacgatggcgggtggcgggggactgaaccggtcttcatcgagggggcagctgcgccgcaagagctgcttgacgatctctgcagccggttccttctgaatgtgcccaaggaggaactggagtcgttcgagc

SEQ ID NO: 3144 - DNA, 122 bp, Zea mays
  misc_feature: Ceres CLONE 283126-F
  misc_feature (86)..(86): n is a, c, t, g, unknown, or other
attggggtcgcgtccaacaagaggctggccagcatcccgcgcgasycacttcctctctcctccccatcggatccagcgccacgcgnatccgcaagcaatccatggcctctacccaggcggaa

SEQ ID NO: 3145 - DNA, 484 bp, Zea mays
  misc_feature: Ceres CLONE 283160-F
  misc_feature: Translation starting site: 101
  misc_feature: SWISSPROT Homolog: EC 2.7.1.20 Adenosine kinase
  misc_feature (63)..(63): n is a, c, t, g, unknown, or other
  misc_feature (70)..(70): n is a, c, t, g, unknown, or other
  misc_feature (159)..(159): n is a, c, t, g, unknown, or other
  misc_feature (236)..(236): n is a, c, t, g, unknown, or other
  misc_feature (237)..(237): n is a, c, t, g, unknown, or other
  misc_feature (282)..(282): n is a, c, t, g, unknown, or other
  misc_feature (410)..(410): n is a, c, t, g, unknown, or other
  misc_feature (422)..(422): n is a, c, t, g, unknown, or other
  misc_feature (449)..(449): n is a, c, t, g, unknown, or other
  misc_feature (452)..(452): n is a, c, t, g, unknown, or other
  misc_feature (456)..(456): n is a, c, t, g, unknown, or other
  misc_feature (458)..(458): n is a, c, t, g, unknown, or other
aacgcactcgagctcgagccctcgcccgctcagtcacaaagcctcagatctcagtcgcctgcnccggcgnttcgttcgtgtggaggggagaagacaggaaatggcggcgactgagggcgtgctcttggggatgggcaaccccctcctcgacatctccgncgtcgtcgatgaccccttcctgacaaagtatgacatcaagctgaacaatgctattctcgctgaggagaagcacttgnntatgtatgacgagttggctagcaagagcaatgttgaatatattgncggagagccacccagaactctatcagggttgcccaatggatgcttcaaactcctggtgcaaaagttacatgggatgcattggaaaggacaagtttggtgaggaaatcgaagaaaaacgctcaagctgnaggagttactgntcattactacgaggatgagactgctcntantggnanatgtgstgtatgtgttgttggtggtg

SEQ ID NO: 3146 - DNA, 289 bp, Zea mays
  misc_feature: Ceres CLONE 283164-F
  misc_feature: Encodes the peptide sequence at SEQ ID NO. 3147
  misc_feature (238)..(238): n is a, c, t, g, unknown, or other
  misc_feature (239)..(239): n is a, c, t, g, unknown, or other
cttcacgattgakaaaccctcacctcttcccttccttggttcctccccaccgccgccaccgccggaaggagaaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcagaaccgggagcgcagggcgtaaagcgccannattccgcgacgagcacaaggtcaccgtaagcgggcctgaggacttcgttg

SEQ ID NO: 3147 - protein, 70 aa, Zea mays
  misc_feature: Ceres CLONE 283164-F
  misc_feature (54)..(54): Xaa is any aa, unknown, or other
MGADGEEASRIVVPMAVEGTSEQLAFVEESKLQKRKENADWAVRTGSAGRKAPXFRDEHKVTVSGPEDFV

SEQ ID NO: 3148 - DNA, 472 bp, Zea mays
  misc_feature: Ceres CLONE 283166-F
  misc_feature: Encodes the peptide sequence at SEQ ID NO. 3149
  misc_feature (49)..(49): n is a, c, t, g, unknown, or other
  misc_feature (283)..(283): n is a, c, t, g, unknown, or other
  misc_feature (293)..(293): n is a, c, t, g, unknown, or other
  misc_feature (387)..(387): n is a, c, t, g, unknown, or other
  misc_feature (427)..(427): n is a, c, t, g, unknown, or other
  misc_feature (450)..(450): n is a, c, t, g, unknown, or other
  misc_feature (456)..(456): n is a, c, t, g, unknown, or other
  misc_feature (465)..(465): n is a, c, t, g, unknown, or other
aagcgttctacggctccaatttctctgacttctccctgagcctttgcsncggctggagctggacggtccccgggcagcsaggcagccggactgcgggagtcacctccatggcctcggctgctactgcaaccctccccaaggcttcagttgasgccaagatgcaacagctactttcaggtgaccggtcaagtccatgcccacaccaaaacatgcsttgcctgcaagtstccgacccatatccacgggttgcttgtytcagctggaggaaggaggacattcctgncggtgtctgnagttggatcaggtcagggstcatcggtcactgaggccgacaggaagagcgatttgtcgctggagaacgtcaagacgtccgttgtatcccgcgangatgaaaagattaatgtacgagtgcagttgcctggaaagngagcaaaaggtgtttgatgaggntctgangttcttggncgtgatg

SEQ ID NO: 3149 - protein, 72 aa, Zea mays
  misc_feature: Ceres CLONE 283166-F
  misc_feature (15)..(15): Xaa is any aa, unknown, or other
  misc_feature (36)..(36): Xaa is any aa, unknown, or other
  misc_feature (50)..(50): Xaa is any aa, unknown, or other
  misc_feature (59)..(59): Xaa is any aa, unknown, or other
  misc_feature (62)..(62): Xaa is any aa, unknown, or other
  misc_feature (69)..(69): Xaa is any aa, unknown, or other
MASAATATLPKASVXAKMQQLLSGDRSSPCPHQNMXCLQVSDPYPRVACXSWRKEDIPXGVXSWIRSGXIGH

SEQ ID NO: 3150 - DNA, 163 bp, Zea mays
  misc_feature: Ceres CLONE 283169-F
  misc_feature (54)..(54): n is a, c, t, g, unknown, or other
  misc_feature (63)..(63): n is a, c, t, g, unknown, or other
caaacacctccgatccgtccccgatcatcgcaccacctgtagcccacctcgtcnctcgagtyncgacccagcgacgagatggccgcggtggatctgaccccaaggacgcccaagaaggcctacggggcgacggcggcgctaactacgagtggagccccgccga

SEQ ID NO: 3151 - DNA, 497 bp, Zea mays
  misc_feature: Ceres CLONE 283214-F
  misc_feature: Translation starting site: 256
  misc_feature (369)..(369): n is a, c, t, g, unknown, or other
  misc_feature (371)..(371): n is a, c, t, g, unknown, or other
  misc_feature (380)..(380): n is a, c, t, g, unknown, or other
  misc_feature (384)..(384): n is a, c, t, g, unknown, or other
  misc_feature (423)..(423): n is a, c, t, g, unknown, or other
ctcttgtttcgccgaaccccaaaccctagcttcgctcgttgcggcggcgagcsgcgatggcgaagtctctgcgatccaaacgcgagaagcggcttcggacgttgcgccgggagatagcggascgttctacgacaagaaggaggccgccaagctcgccgcgcaggccgccgccctagctgctgccccgctcccggtccgcgggcccccgccatcccaggatgccggcagctcccgcgcactagctcggcctcggctatggatgtggagatgtctgatgcagggaacaacaggtctaagaccttcttgaggccacttggcagcattagcaagaagaaggtgcagcttcatttgaagatcaagaaagacaananaaaakctangaanaagggaaagttttctttttaagaagtagaggagtgtatnataaatcatgcagtttttgttcccagttttttaaaacaaacgcactgcagtcatgtcatgtggtgcacctacct

SEQ ID NO: 3152 - DNA, 505 bp, Zea mays
  misc_feature: Ceres CLONE 283259-F
  misc_feature: Encodes the peptide sequence at SEQ ID NO. 3153
  misc_feature (137)..(137): n is a, c, t, g, unknown, or other
  misc_feature (455)..(455): n is a, c, t, g, unknown, or other
aatcgcctccaccgctctctcttcctctgctcttctctgcctgcctgagctcaccgcacctcgcctcctcaccgcgtttcctccgttaatccggtagaaaatggccgatgccgaggatatccagcccctcgtctgcnacaacggaactggcatggtcaaggctgggttcgctggcgacgacgcccgagggccgtcttccccagcatcgtggggcgcccgcgcacactggtgtcatggtcgggatggggcadaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgatgcgcccctgaaccccaaggctaacaggganaagatgacccagatcatgttcgagaccttcaacacccccgctatgtacgt

SEQ ID NO: 3153 - protein, 132 aa, Zea mays
  misc_feature: Ceres CLONE 283259-F
  misc_feature: SWISSPROT Homolog: EC 2.7.10.2 Non-specific protein-tyrosine kinase
  misc_feature (48)..(48): Xaa is any aa, unknown, or other
  misc_feature (116)..(116): Xaa is any aa, unknown, or other
MPRISSPSSATTELAWSRLGSLATTPEGRLPQHRGAPAHTGVMVGMGXKDAYVGDEAQSKRGILTLKYPIEHGIVSNWDDMEKIWHHTFYNELRVAPEEHPVLLTDAPLNPKANRXKMTQIMFETFNTPAMY

SEQ ID NO: 3154 - DNA, 494 bp, Zea mays
  misc_feature: Ceres CLONE 283298-F
  misc_feature: Encodes the peptide sequence at SEQ ID NO. 3155
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcgcgcgctctcgtccatcacccacctcgtgtacgtctc

SEQ ID NO: 3155 - protein, 77 aa, Zea mays
  misc_feature: Ceres CLONE 283298-F
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRLGTW

SEQ ID NO: 3156 - DNA, 477 bp, Zea mays
  misc_feature: Ceres CLONE 283309-F
  misc_feature: Translation starting site: 179
  misc_feature (147)..(147): n is a, c, t, g, unknown, or other
tactgtgcctttatcttcaacccaaaccatccattaccatattcctaagctatcatggtgcaccggacttccatagccgatgtgcatgtgatgtgcatggatctaagcccaaagaaacccaacaaggccagcgccabdcgggcggantaactacgactggtcccccgccgatctgcccatgctcggcgttgcctccattggtgccgccaagctctgcctcaccgccggagtcttgccctacccagctactccgactctgccaagatcgcctacgtcctccaaggcaaaggtatattcggcgtggttctcccggagcgaccaaggagaaggtcatctccgtcaaggaaggcgacgcgctggcgcttccccttcggcgtcgtcacctggtggcacaacaacgccgacgccgctatctccgacctcgtggtgctcttcctcggcgacacctccacgggccacaagccgggccagttcaca

SEQ ID NO: 3157 - DNA, 515 bp, Zea mays
  misc_feature: Ceres CLONE 283316-F
  misc_feature: Encodes the peptide sequence at SEQ ID NO. 3158
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgttagactcggtacgtggtgatgtcggatgagatcctcaagaactacccggagctggcgcaggaggggctgccgacgatgaatcagcgtctggacatctcgaacgcggcggtgaccsagatggcgacggaggcgtccctgtcgtgcgtccgctcgtggggcggcgcgctctcgtccatcacccacctcgtgtacgtctcgtcgagcgaggcgcgcttc

SEQ ID NO: 3158 - protein, 66 aa, Zea mays
  misc_feature: Ceres CLONE 283316-F
  misc_feature: SWISSPROT Homolog: EC 2.3.1.95 Trihydroxystilbene synthase
  misc_feature (33)..(33): Xaa is any aa, unknown, or other
MSDEILKNYPELAQEGLPTMNQRLDISNAAVTXMATEASLSCVRSWGGALSSITHLVYVSSSEARF

SEQ ID NO: 3159 - DNA, 681 bp, Zea mays
  misc_feature: Ceres CLONE 283332-R
  misc_feature: Encodes the peptide sequence at SEQ ID NO. 3160
  misc_feature (423)..(423): n is a, c, t, g, unknown, or other
  misc_feature (426)..(426): n is a, c, t, g, unknown, or other
ccaattgggtaccgggccccccctcgaggtcgacggtatcgatattttttttttttttttttatccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccccaccgatagaagccgtgntcncccgccactccgagggctcctcccacgtcgtcgctgccgtctccggcggcaagtgcaaggacaggtgcctcagcgagtgcttcgaggacctgccggccctctgctaccaccagtgcgtcgccaccaactgcctctgctacccaccctttagcaacgagaaagtgatgtgcctgaagagctgctgcaacaagtgcttccaccacggcccgccgcctgccccgaagccgaggccgccaatgcctggtcctccgaagc

SEQ ID NO: 3160 - protein, 30 aa, Zea mays
  misc_feature: Ceres CLONE 283332-R
MCLKSCCNKCFHHGPPPAPKPRPPMPGPPK

SEQ ID NO: 3161 - DNA, 397 bp, Zea mays
  misc_feature: Ceres CLONE 283350-F
  misc_feature: Encodes the peptide sequence at SEQ ID NO. 3162
  misc_feature (27)..(27): n is a, c, t, g, unknown, or other
attcgcaccaccgccgcgccgcccaantcacagccaccgccgccatggccgcctccagccgccctctcgtctccgtgaaagccctggagggcgacatggtcacggacgcccccggcatcgcttgccgcccgtcttcggtgcgccgatccgcccggacgtggtccgcttcacccacaagctgctgtcctgcaacaagcgccascttacgcakctcccgccgcgctggccaccagacgtcggccgagtcctggggtacgggccgcgctgtgtcccgtatcccccgcgtccccggcggcggcacccaccgcgccggccagggagcattcggcaacatgtgccgcggcggacgcatgttcgcgcccaccaagatctggcgcaagtggcaccgccgcgtcaa

SEQ ID NO: 3162 - protein, 117 aa, Zea mays
  misc_feature: Ceres CLONE 283350-F
  misc_feature (53)..(53): Xaa is any aa, unknown, or other
  misc_feature (56)..(56): Xaa is any aa, unknown, or other
MAASSRPLVSVKALEGDMVTDAPGIACRPSSVRRSARTWSASPTSCCPATSAXLRXSRRAGHQTSAESWGTGRAVSRIPRVPGGGTHRAGQGAFGNMCRGGRMFAPTKIWRKWHRRV

SEQ ID NO: 3163 - DNA, 319 bp, Zea mays
  misc_feature: Ceres CLONE 283355-F
  misc_feature: Encodes the peptide sequence at SEQ ID NO. 3164
atcaatcaaatactcagacaaccatggggcacagcaggcgcmsacggcaaggacgacaccgaggagctgcttgcagccaccggcagctgtggtgccatgccctgggctacgtcaagtccatggcgctcaagtgcgcctggacctgcgcatccccgacaccatcgaccgctgcggcggagcgccaccctgggcgagctgctcgcgccagcgaratcccggcgtccaaccacgactacctccggcgggtcatgcgcacgctgacagccatgcgcatttycgcggccagccacgaccccgccaaggccgacgacgcggcggc

SEQ ID NO: 3164 - protein, 98 aa, Zea mays
  misc_feature: Ceres CLONE 283355-F
  misc_feature (7)..(7): Xaa is any aa, unknown, or other
  misc_feature (85)..(85): Xaa is any aa, unknown, or other
MGHSRRXRQGRHRGAACSHRQLWCHALGYVKSMALKCAWTCASPTPSTAAAERHPGRAARASEIPASNHDYLRRVMRTLTAMRIXAASHDPAKADDAA

SEQ ID NO: 3165 - DNA, 138 bp, Zea mays
  misc_feature: Ceres CLONE 283381-F
  misc_feature (100)..(100): n is a, c, t, g, unknown, or other
ctcttcgcttctaactccgctgggccaccastttgaccgccgcctcccttcccctccgctactgctcctccccaccccactcccccgcagagcgcggcgncggcggcgaggtcgtaccccacatcggcgagcggcggc

SEQ ID NO: 3166 - DNA, 160 bp, Zea mays
  misc_feature: Ceres CLONE 283384-F
aacactcactcgagtactcgacaccgcccctctgatatggctcaggcacgcgtgcgccttactccggccggccgcacgccgccccaaccgtttcctctcgggctccaaccccagacccgcccacctcaccttcttcccgaagcttacccctacctccctc

SEQ ID NO: 3167 - DNA, 197 bp, Zea mays
  misc_feature: Ceres CLONE 283412-F
gcccgcggtgctagtgacggttgctctagatccgttcatcctggtggttttgtgaggtcgaaagcggcgagcgaattagaagatgctggacaagctgtgggacgacgtggtggccgggcctcgccgaaggacggcctcgagaagctccgcaagccaccaccgcccgcccgctcgtcatcaacaaagacgcggacggc

SEQ ID NO: 3168 - DNA, 287 bp, Zea mays
  misc_feature: Ceres CLONE 283426-F
atcaaaggtgcagcttcaggaggagctctcgtggcgtcatagtctctggaaggtccaaattaagattagaagatggacgaggacgcgctgacggagatccttgcgaggctgccgtgcaggtcgctggcgcggttccagtgcgtctccacgtcgtgctccgcatcatctcgagcgactacctccgccgccggctgccgctcatcacgtcgggggtgctctaccacgacgacacgcgccgcggcgacstaccgggcggcaggaggcagcaggtgtacacgtacgcgtgc

SEQ ID NO: 3169 - DNA, 406 bp, Zea mays
  misc_feature: Ceres CLONE 283445-F
  misc_feature: Encodes the peptide sequence at SEQ ID NO. 3170
  misc_feature (156)..(156): n is a, c, t, g, unknown, or other
  misc_feature (304)..(304): n is a, c, t, g, unknown, or other
  misc_feature (309)..(309): n is a, c, t, g, unknown, or other
aacgagaaggccagggagacgtcttgcttctccttcgctcgtctacctgcttcctagttgttccatcatccatggcgcgcttcgcctccgctgtcctcttcgccgctgtcctgctcatggctggacggctgacccatgcggggccgtcgacggcgnaggtgctttggcggcgcgcagtcctgccgggctccgcgtgccgaacgccgtcctccggctcctacgcccctatagccacttcgtaagcgaascaatgccgaggayaccgggcgatccaacgctccgttcaactaccwataactacwancbysncctctgcgactgcgacctcacctccaggtgaccgcagtgaagcagggctcgctgggtggcagcggcgcgagagatgacacgccgttcagctacagct

SEQ ID NO: 3170 - protein, 56 aa, Zea mays
  misc_feature: Ceres CLONE 283445-F
  misc_feature (29)..(29): Xaa is any aa, unknown, or other
MARFASAVLFAAVLLMAGRLTHAGPSTAXVLWRRAVLPGSACRTPSSGSYAPIATS

SEQ ID NO: 3171 - DNA, 457 bp, Zea mays
  misc_feature: Ceres CLONE 283474-F
  misc_feature: Encodes the peptide sequence at SEQ ID NO. 3172
  misc_feature (192)..(192): n is a, c, t, g, unknown, or other
  misc_feature (243)..(243): n is a, c, t, g, unknown, or other
  misc_feature (307)..(307): n is a, c, t, g, unknown, or other
  misc_feature (308)..(308): n is a, c, t, g, unknown, or other
atctcgcaaagtcgcataacttgtcttctcgaatcggctgcaaccccaccccagaccccaccgccgccgccgctaggttttkgggtgaggatcgccgatgtcgacggctcccaggcgtcccttccgaggccgcggcgccatgccctcgggcaccggctacgtccgccgcggccccgccccaggctccgcgancgccgccaagcccctgcgcaasccgtcttcaccaccgtygayyakctwckncccagacacacggtcacactctcacagcccgcgtcattgccgtccgcaccgtcctcgacaagcnntccacgcacctcggccgcacccgcgttcgccgagtkcytcgttcggakaagcaccggcwccgtcctcgtcaccgcccgctaacgaacaggttgaycttttgawgccagatacaacagtgatcttccgcaatgccaagattgatatgttc

SEQ ID NO: 3172 - protein, 120 aa, Zea mays
  misc_feature: Ceres CLONE 283474-F
  misc_feature (32)..(32): Xaa is any aa, unknown, or other
  misc_feature (39)..(39): Xaa is any aa, unknown, or other
  misc_feature (45)..(45): Xaa is any aa, unknown, or other
  misc_feature (46)..(46): Xaa is any aa, unknown, or other
  misc_feature (47)..(47): Xaa is any aa, unknown, or other
  misc_feature (48)..(48): Xaa is any aa, unknown, or other
  misc_feature (49)..(49): Xaa is any aa, unknown, or other
  misc_feature (71)..(71): Xaa is any aa, unknown, or other
  misc_feature (83)..(83): Xaa is any aa, unknown, or other
  misc_feature (87)..(87): Xaa is any aa, unknown, or other
  misc_feature (105)..(105): Xaa is any aa, unknown, or other
MSTAPRRPFRGRGAMPSGTGYVRRGPAPGSAXAAKPLRXPSSPPXXXXXPDTRSHSHSPRHCRPHRPRQAXHAPRPHPRSPSXSFGXAPAPSSSPPANEQVDLLXPDTTVIFRNAKIDMF

SEQ ID NO: 3173 - DNA, 345 bp, Zea mays
  misc_feature: Ceres CLONE 283488-F
  misc_feature: Encodes the peptide sequence at SEQ ID NO. 3174
atcaccaagttttggattccagcagcggcgcccccaggccaggccccacccgctcagcctcctcagctgcccaaccttctccccatctgctcagcctcagctgtcattcccgcgavcgtctcccggctctatcgatggaccgagtcgccgccctcgtcgtcgcgctcctcgccctcttcttcgccgccggggccacggcgcaggccccggcctcgtcgcccaagcgcactccagcgccasccacccaggacggccttcctcccgccgccgccgccagggcgcctatggcctccccgccctcgcctcccgcgatggcgccggtgcccgcgccctccgccggcgtgc

SEQ ID NO: 3174 - protein, 70 aa, Zea mays
  misc_feature: Ceres CLONE 283488-F
  misc_feature (36)..(36): Xaa is any aa, unknown, or other
MDRVAALVVALLALFFAAGATAQAPASSPKRTPAPXTQDGLPPAAAARAPMASPPSPPAMAPVPAPSAGV

SEQ ID NO: 3175 - DNA, 104 bp, Zea mays
  misc_feature: Ceres CLONE 283501-F
agtagccagtgcgagtkgagtgagcggcccggacgagcggaggaggaagacaggatggctgccggacgagcggttgcktggccatggtggcggcggcggcgctg

SEQ ID NO: 3176 - DNA, 498 bp, Zea mays
  misc_feature: Ceres CLONE 283570-F
  misc_feature: Encodes the peptide sequence at SEQ ID NO. 3177
  misc_feature (85)..(85): n is a, c, t, g, unknown, or other
  misc_feature (445)..(445): n is a, c, t, g, unknown, or other
  misc_feature (449)..(449): n is a, c, t, g, unknown, or other
ccccaaaacccaagcccctgcgaccccgagataccaaagccagcagaagaagggatgcagcagccgatgcacatgcagccgcasncgggcgatasccagctgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccgcagactgctgtaascgcactcagatggcgccgctggtggatctcctggagtagggcagtacatgtcacaggtgcctatgttcccaccgaggacacctctaacaccccagcagatgcaggagcagcagcttcagcagcagcaggctcagttgctaaacttcagtggccaaatggttnctanacaggcatggtcaacggcatggctcagtccatgcaagctcagctaccac

SEQ ID NO: 3177 - protein, 165 aa, Zea mays
  misc_feature: Ceres CLONE 283570-F
  misc_feature (30)..(96): Pfam Name: SSXT Pfam Description: SSXT protein (N-terminal region)
  misc_feature (28)..(28): Xaa is any aa, unknown, or other
  misc_feature (31)..(31): Xaa is any aa, unknown, or other
  misc_feature (94)..(94): Xaa is any aa, unknown, or other
  misc_feature (148)..(148): Xaa is any aa, unknown, or other
  misc_feature (149)..(149): Xaa is any aa, unknown, or other
PKPKPLRPRDTKASRRRDAAADAHAAAXGRXPAAGITTEQIQKYLDENKQLILAILENQNLGKLAECAQYQSQLQKNLLYLAAIADAQPQTAVXALRWRRWWISWSRAVHVTGAYVPTEDTSNTPADAGAAASAAAGSVAKLQWPNGXXTGMVNGMAQSMQAQLP

SEQ ID NO: 3178 - DNA, 400 bp, Zea mays
  misc_feature: Ceres CLONE 283585-F
  misc_feature: Translation starting site: 75
  misc_feature (265)..(265): n is a, c, t, g, unknown, or other
  misc_feature (279)..(279): n is a, c, t, g, unknown, or other
  misc_feature (337)..(337): n is a, c, t, g, unknown, or other
  misc_feature (367)..(367): n is a, c, t, g, unknown, or other
aagcctaatccccacgaaaaccctaaaccctcgctacccggcggcggctacaagctcttcgtcggttcagcaccatgaggccaccggctagaggaggacgtggtgggaggggtggcaggttcgatggcggcggccgtgggggcggcggcggcggcstgggtttggcggtggtagaggcgggagaggggacaggggagggagaggtggcaggacccccagaggcggccgtggcggcggtggcaggggtggccgcggcggtggcatnaagggcgggacaangccgtcgtggtggcgcacaagcacgccggtgtcttcatctccaagtccaaggaggatncgctctgcaccaagaacatggtcccggganattccgtgtacgagagaagcgtgtctccgttca

SEQ ID NO: 3179 - DNA, 1329 bp, Zea mays
  misc_feature: Ceres CLONE 283598
  misc_feature: Encodes the peptide sequence at SEQ ID NO. 3180
acgccacagtgcctcctcgcagcttcatccactcgtctcccctccccacaccaaaaaaacaagcaagggtcagcagatagccgcattaaaaggagggaggtcacgtaaacttaatccaatccaccaaaccccaaatctctgtctcgcgctggcgcagcgcagggcaccgccacgcgcgcctcatccggtaccggcatgacgagcgcctccgagctcttcaccgcgcgccgtgccgcccgtggggcccgcctctccgacctcgacctggatccgcacgccgacgcgctccgggaccagcacggacttggcgcccggcaccggcgccgcgggtgccgcccgcgacgccagctcgacgccgccggggacgtgcggcagcacctgcacaccggggccccgccaccgcgtcgccgcgggtcgtacaccgatcagatcttatcgtacatagacaacaacaaccttggggttggggattctgcagctcggaggaacagacttgataggctgatgttcaggacaaatgagcggcttcctggtgctgtactgcaagcacaagcgcgtgtcctggagagactcagaggcatttctcttggttcatctgtgtccaggccatccatctcattagatgaattttcagctagcgatgtattcagaatcatcgacttcagaaacagggaagcacggcatgaagaaaatcggcaccactcatcgtcgttccacccaagcagtgaatcagatgaagaaagaccaaccsgtcggttccactcactccaacccgggtcaaccggacttaccaaggcagctttcctgcgtctgcaggtcgagatttttgaggctagcaaagatgatagcagagaggcatcgcctgaatgttctatttgccttgatggattttacgatggagatgagctgataaggttgcgctgtgggcacaggttccactcgacatgcttggagccatgggcgcggaaatgtgcagactgcccatactgtcgaacgaacatacggtcacgatcctgacgacaaacccttagttcagagtaagcttataaccaccatggagtttcactgttgtaaaattcgctgttgtgggcatgccagttaatccggtgctcctatggcgacatgtaatttctaatatcctgaatattttgtgttgtgtcactcagagaggtttatggtgttgtgtgcgagtggaggctagtagcagtatagcttagaaagcacccttttgtgtgtatgtagcgagggatcacgcaaatgatcctgtactactaatgataatgttctgatgtctgaatttcagttgttactgcaaaaaaaaaaaaaaaa

SEQ ID NO: 3180 - protein, 273 aa, Zea mays
  misc_feature: Ceres CLONE 283598
  misc_feature (225)..(265): Pfam Name: zf-C3HC4 Pfam Description: Zinc finger, C3HC4 type (RING finger)
  misc_feature (186)..(186): Xaa is any aa, unknown, or other
MTSASELFTARRAARGARLSDLDLDPHADALRDQHGLGARHRRRGCRPRRQLDAAGDVRQHLHTGAPPPRRRGSYTDQILSYIDNNNLGVGDSAARRNRLDRLMFRTNERLPGAVLQAQARVLERLRGISLGSSVSRPSISLDEFSASDVFRIIDFRNREARHEENRHHSSSFHPSSESDEERPTXRFHSLQPGSTGLTKAAFLRLQVEIFEASKDDSREASPECSICLDGFYDGDELIRLRCGHRFHSTCLEPWARKCADCPYCRTNIRSRS

SEQ ID NO: 3181 - DNA, 468 bp, Zea mays
  misc_feature: Ceres CLONE 283686-F
  misc_feature: Encodes the peptide sequence at SEQ ID NO. 3182
  misc_feature (253)..(253): n is a, c, t, g, unknown, or other
  misc_feature (307)..(307): n is a, c, t, g, unknown, or other
  misc_feature (310)..(310): n is a, c, t, g, unknown, or other
  misc_feature (312)..(312): n is a, c, t, g, unknown, or other
ctctgctcctctcaccctcacgctccaaggcggcggcgcatgcacggcggaggcgcggcctcgccgatgccgccatatgcatctccccagaagctgggcccatcgtcggggtcgcccccgcckgatcagggtcgaaaactgctacgtgttcaagakccggctgcaggagtatgctcagagggttggcattccaacccggagtaccacacgctgaaagaaggcccgtctcatgaacctgtcttcaagtccacantgttcgttaataataccaagtatgaatcgctgcctgggttcttcagccggaagntcnangaacagtctgccgcggaagttgcgctcatggagatagccatgtccgctccggtgaccgaaattaggaacatgccagcagttcaagaaactggactktgcaagaatctccttcaggagtatgctcagaagatgaattatgccattccatcttatatt

SEQ ID NO: 3182 - protein, 134 aa, Zea mays
  misc_feature: Ceres CLONE 283686-F
  misc_feature: SWISSPROT Homolog: EC 3.1.26.3 Ribonuclease III
  misc_feature (30)..(30): Xaa is any aa, unknown, or other
  misc_feature (63)..(63): Xaa is any aa, unknown, or other
  misc_feature (81)..(81): Xaa is any aa, unknown, or other
  misc_feature (82)..(82): Xaa is any aa, unknown, or other
MPPYASPQKLGPSSGSPPPDQGRKLLRVQXPAAGVCSEGWHSNPEYHTLKEGPSHEPVFKSTXFVNNTKYESLPGFFSRKXXEQSAAEVALMEIAMSAPVTEIRNMPAVQETGLCKNLLQEYAQKMNYAIPSYI

SEQ ID NO: 3183 - DNA, 470 bp, Zea mays
  misc_feature: Ceres CLONE 283693-F
  misc_feature: Translation starting site: 37
  misc_feature (119)..(119): n is a, c, t, g, unknown, or other
  misc_feature (128)..(128): n is a, c, t, g, unknown, or other
atcccaaaccatccattaccatattcctaagctatcatggtgcaccggacttccatagccgatgtgcatgtgatgtgcatggatctaagcccaaagaaacccaacaaggccagcgccantcggcggantactacgactggtcccccgccgacctgcccatgctcggcgttgcctccattggtgccgccaagctctgcctcaccgccggagtcttgccctacccagctactccgactctgccaagatcgcctacgtcctccaaggcaaaggtatcttcggcgtggttctcccggagcgaccaaggagaagttcatctccgtcaaggaaggcgacgcgatggcgctccccttcggcgtcgtcacctggtggcacaacaacgccgacgccgctatctccgacctcatggtgctcttcctcggcgacacctccacgggccacaagccgggccagtttacaaacttccagctcac

SEQ ID NO: 3184 - DNA, 434 bp, Zea mays
  misc_feature: Ceres CLONE 283702-F
  misc_feature (134)..(134): n is a, c, t, g, unknown, or other
  misc_feature (135)..(135): n is a, c, t, g, unknown, or other
  misc_feature (329)..(329): n is a, c, t, g, unknown, or other
acctaacaccaactcctctccaacctcctcgtcccgtccccgtcgattcgattcggtcgaagcgggcgggcggaggaggaggaggctagggattccggatgggcgcggcgccgaggaggctctagaggcgccanngtttggtggtccggggggagagggagcggcgggagggcgggcggcgatggaggagaaggcgtcgtcgcgcttgatcccgccgccgtcgagatcgacctggaggcgggcggcggcggcggcggcggcggagagcagctccaktgccggatctgcctcgagaccgacgggagggacttcatcgctccctgcaagtncaaggggacgtccaagtacgtgcaccgcgactgcctcgaccactggagggcgtaaaggagggatttscattttctcattgtactacctgcaagctccatattact

SEQ ID NO: 3185 - DNA, 401 bp, Zea mays
  misc_feature: Ceres CLONE 283721-F
  misc_feature: Encodes the peptide sequence at SEQ ID NO. 3186
  misc_feature (31)..(31): n is a, c, t, g, unknown, or other
  misc_feature (71)..(71): n is a, c, t, g, unknown, or other
  misc_feature (86)..(86): n is a, c, t, g, unknown, or other
  misc_feature (355)..(355): n is a, c, t, g, unknown, or other
atccggtcccaaaagtagaaaagggcaagcnacgagcacagcacagcacgccttccgttttgggaaggcangagaggggaacccgnggagagttgggggatcggcggcggaggagatggaggagcgggagaagctcgtgtgcctggccaagcttgccgagcaggcggasggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatanatgcctataagaagaaagtagaagaggaactaaggaaggtttgcaa

SEQ ID NO: 3186 - protein, 73 aa, Zea mays
  misc_feature: Ceres CLONE 283721-F
  misc_feature (59)..(59): Xaa is any aa, unknown, or other
MVEFMKNLARMDVDMSAEERHLFSVGFKNTIGAKRASWRIICSHEQKVAADRQTGVMIXAYKKKVEEELRKVC

SEQ ID NO: 3187 - DNA, 460 bp, Zea mays
  misc_feature: Ceres CLONE 283731-F
  misc_feature: Encodes the peptide sequence at SEQ ID NO. 3188
gagccgaccgatcgtcgctcatctttgtaggacacccgcaccctccgcgtcgaacacccgatccggacaccgctccaggctccacctctctcccatctcacgccaacgctcactggaccattcctccgtgcttgggagcggcggagagctatccacctcgtctcaggcaccctctggcgtccccctccccccgccgcgtgccggsagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgttaacattggtgcggcaaatgccccatcccaggtcctggcaacgcttagtggccactatggt

SEQ ID NO: 3188 - protein, 58 aa, Zea mays
  misc_feature: Ceres CLONE 283731-F
MSSKKIELDHKDMVHDSAIDYYGKRLATASSDFTVKIVNIGAANAPSQVLATLSGHYG

SEQ ID NO: 3189 - DNA, 99 bp, Zea mays
  misc_feature: Ceres CLONE 283768-F
araacccatccgatttcgattcgatttgccggcggtgccgcsgcggagaagatggcgagctccttctccttcccgctgatgaatccggcggacattgcc

SEQ ID NO: 3190 - DNA, 344 bp, Zea mays
  misc_feature: Ceres CLONE 283781-F
  misc_feature: Encodes the peptide sequence at SEQ ID NO. 3191
agactctcacacactctagctgctgctctctcccactgtctcgccgtcttgctcaaacgcabsccggtggtctggtcggtcgctctctcgacccatgggagttggccggggttcctgctccagccactgaagacgcggcggcgctcctgctcatggcaggastcaatgcgccacagggccgcgcgccgccgcttcctcctcgtcctcgtcctcgtcctgtgcggcttccttgtgctgctcgtgcctacgtctcggcgcggggacgacgacgagacagaggagttccccgtcgcgtcttccgcttcgtcgtcgtcgtggcactggcacgccgctgatgggcgccg

SEQ ID NO: 3191 - protein, 59 aa, Zea mays
  misc_feature: Ceres CLONE 283781-F
MRHRAARRRFLLVLVLVLCGFLVLLVPTSRRGDDDETEEFPVASSASSSSWHWHAADGR

SEQ ID NO: 3192 - DNA, 289 bp, Zea mays
  misc_feature: Ceres CLONE 283785-F
  misc_feature: Pfam Name: Peptidase_S24 Pfam Description: Peptidase S24-like
  misc_feature (198)..(198): n is a, c, t, g, unknown, or other
ttgccttcgtgttcgtgattcgtgatttcgccgccggaaasccgagggagagggascgatatggggttcgtcggagmacgatggagtcgatccgctccatgcagatccgccaagtgctcatgcagatcatcagcctcggtatgattgttacctctgcattaatcatatggaagggtttgatagtttttcacgggggancgagttcaccagttgtagtgggtgctctcgggtagcatggagcctggatttaaaaggggtgatatcctgtttttgcatatgagcaargatc

SEQ ID NO: 3193 - DNA, 506 bp, Zea mays
  misc_feature: Ceres CLONE 283796-F
  misc_feature: Translation starting site: 223
  misc_feature: SWISSPROT Homolog: EC 3.2.1.39 Glucan endo-1,3-beta-D-glucosidase
caaggaaacacacaattcagcacacgcaccaccaaaaagagggagaagaggggatctcggagaagagtcttcgcctcggagagacgtgctctgcctagcatatatagccacgaaagakagtgctggccctgccggccttcgtctagctatagctaactagccagcagcagcgtgcgtgcgtgcgttcaaggcagcagaggtagagaggttttgagagagagaatggcaagcaggcaaggtgtagccgcctccatgttcgccacggcattgctcctcggcgtctttgcatccatcccacaaagtgctgaggccatcggggtgtgctacggcatgagcgccaacaacctgccggckgcgagcacggtggtgagcatgtacaaggcgaacggcatctcggcgatgcggctgtacgcgccggaccagggcgcctgcaggstttgggcggcacgggcatcagcgtggccgtgggcgcccccaacgacgtgctgtcgaacatcgcgggcagc

SEQ ID NO: 3194 - DNA, 198 bp, Zea mays
  misc_feature: Ceres CLONE 283798-F
  misc_feature (39)..(39): n is a, c, t, g, unknown, or other
  misc_feature (91)..(91): n is a, c, t, g, unknown, or other
ccaaatctcgcgcactgtcagctgacgccaccgcctgcnccascctcgcyaagccggtgaaaacctcgtgccctccgcygyytccgcccknctcttccagagtaccgcggtctcatctcctcccgggacgcatgcagagcacggctgccatcggtctcgttcggccatgcgccgcgcggccactccccaccttaccct

SEQ ID NO: 3195 - DNA, 385 bp, Zea mays
  misc_feature: Ceres CLONE 283823-F
  misc_feature: Translation starting site: 69
  misc_feature (51)..(51): n is a, c, t, g, unknown, or other
aaaagcyacctccccaaacccaatcccgtcactatctcattcccctgacynccggaacaccctaggcwatggagcccaaatccaccacccctcccccgccccccgttatgggcgcgcccatcgcgtatcctcccccgcccggcgccghktaccccgccggccgtacgtgcacgcgccggcgccgcgctctaccctcctcctcccctgcygccgggcccccctcctcgcagcagggcgccgcggcggsaccagcagcagctattctgggcggacaattaccgcgagatcgaggccaccaccgacttcaagaaccacaacctggccgctcgcccgcatcaagaagatcatgaaggccgacgaggacgtgcgcatgatcgccgccgag

SEQ ID NO: 3196 - DNA, 155 bp, Zea mays
  misc_feature: Ceres CLONE 283828-F
  misc_feature (27)..(27): n is a, c, t, g, unknown, or other
  misc_feature (121)..(121): n is a, c, t, g, unknown, or other
akgtgaaacgtcatggcgacggtcgcngcccgccgctcctccagccgcgatgggtggccggtgggcggtgcggctgctgggcacgagcggaggcttctccgggcggagatkggcgcgcgangagggggaggtggatccggcgacgcgatctttgt

SEQ ID NO: 3197 - DNA, 190 bp, Zea mays
  misc_feature: Ceres CLONE 283833-F
  misc_feature (159)..(159): n is a, c, t, g, unknown, or other
aaccttatcggtttatctatccttctatccccattcccatcccgagacaggagagggcaaggatgctgctcctgagctcccccttcgtgtccgcgtcgccgccgccgccgccgctcagctcccatggcgctcgccggcgctgcggatcgaggcggccangcagctgacggggcgggtgggtgacgaccaa

SEQ ID NO: 3198 - DNA, 482 bp, Zea mays
  misc_feature: Ceres CLONE 283838-F
  misc_feature: Translation starting site: 61
  misc_feature (2)..(2): n is a, c, t, g, unknown, or other
  misc_feature (461)..(461): n is a, c, t, g, unknown, or other
gnacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaakgaaatacgtcataatcaaggagcttgatgagccagttaccttaaatgatgggacagtggtcctgcagtttgaagtkagacttcagaatggccttgaatgtggaggtgcctacattaagtacatccgccctcaggatgctggatgggatgaccaaggagtttgataatgagactccatacactattatgtttngtccagataaatgtkggtcaa

SEQ ID NO: 3199 - DNA, 451 bp, Zea mays
  misc_feature: Ceres CLONE 283842-F
  misc_feature: Encodes the peptide sequence at SEQ ID NO. 3200
cactttcgatcgacacagaaaattccccaccaaaatctcctccccctgaagtcccgaagctcgcggaasccgagatgtaccatcccacgagaggcggcgtccgcggcggcagagatcaattcaaatgggacgatgtgaaggttgacaagcatcgggagaattaccttggtcatagtgttaagkgctccwggttvtgtagatggcagaaaggaaaggatctttactggtatactcgggataagaaatccgacacgggagatgctcttaaggaagaaatcaggagagtgaaggaagaggaggaacaggctatgcgtgaggctcttggcttagctcctaagcgcmsaattcgaactcagggtaatcgcttggataagcatgaatatgctgagctgattaagagaggatcaactgcggaggacttgggagcaggacacgctgaagcagcacaagt

SEQ ID NO: 3200 - protein, 125 aa, Zea mays
  misc_feature: Ceres CLONE 283842-F
  misc_feature (37)..(37): Xaa is any aa, unknown, or other
  misc_feature (39)..(39): Xaa is any aa, unknown, or other
  misc_feature (40)..(40): Xaa is any aa, unknown, or other
  misc_feature (90)..(90): Xaa is any aa, unknown, or other
MYHPTRGGVRGGRDQFKWDDVKVDKHRENYLGHSVKXSXXCRWQKGKDLYWYTRDKKSDTGDALKEEIRRVKEEEEQAMREALGLAPKRXIRTQGNRLDKHEYAELIKRGSTAEDLGAGHAEAAQ

SEQ ID NO: 3201 - DNA, 167 bp, Zea mays
  misc_feature: Ceres CLONE 283847-F
  misc_feature: Encodes the peptide sequence at SEQ ID NO. 3202
  misc_feature (9)..(9): n is a, c, t, g, unknown, or other
  misc_feature (70)..(70): n is a, c, t, g, unknown, or other
aacaaagcntcttgagtgttcgacagcdagcyatggagaagacgtccgagaacgccatcccgccggcgcnwccccgctgatgctgttcgggtcgtgggcgakctcgtacacgcaccgcgtcacgctggcgctcggctcaagggcctrgagtacgactacgtggagga

SEQ ID NO: 3202 - protein, 29 aa, Zea mays
  misc_feature: Ceres CLONE 283847-F
  misc_feature (8)..(8): Xaa is any aa, unknown, or other
  misc_feature (23)..(23): Xaa is any aa, unknown, or other
MLFGSWAXSYTHRVTLALGSRAXSTTTWR

SEQ ID NO: 3203 - DNA, 501 bp, Zea mays
  misc_feature: Ceres CLONE 283863-F
  misc_feature: Encodes the peptide sequence at SEQ ID NO. 3204
tctagctgattgatctctggtttaccactctttccttccctccttcaattctaaataccacwaatcaaagttgctttscgatggtgagcakcagcatggacacgacgagtgacaaacgtgcgtcatccatgctggctcctaaccctggcaaggccrcgatcctcgcccttggccacgccttcccgcagcagcttgtcatgcaggactacgtcgtcgasgcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtcttcgtcgagcga

SEQ ID NO: 3204 - protein, 92 aa, Zea mays
  misc_feature: Ceres CLONE 283863-F
  misc_feature: SWISSPROT Homolog: EC 2.3.1.74 Naringenin-chalcone synthase
MKNTNCDDPELKEKLTRLCKTTTVRTRYVVMSDEILKNYPELAQEGLPTMNQRLDISNAAVTRWRRRRPCRASARGAARSRPSPTSCTSSSS

SEQ ID NO: 3205 - DNA, 267 bp, Zea mays
  misc_feature: Ceres CLONE 283864-F
  misc_feature: Translation starting site: 63
  misc_feature (49)..(49): n is a, c, t, g, unknown, or other
aaagcctccgacccccttcctctctccctccgccgccgctgcgcacgcnggtaacaagcgacatggcgtctacaccttcgtktgccgcaacaacggcggcgaktggaccgccaagcagcactccggcgagatcgaggcttccgccgcttaccccatacgagctgcagcgccgcctcgtcgccgctgcctccgcggccgactctgcctacgggtcccagtcgtccttctccatggtcaccccagctccgccgtgttccaggtgatcgt

SEQ ID NO: 3206 - DNA, 472 bp, Zea mays
  misc_feature: Ceres CLONE 283865-F
  misc_feature: Encodes the peptide sequence at SEQ ID NO. 3207
atccatgatccatctcatcgacaccccctccgctctccttatcccttccattcgcccaaacccccgccgccgtgacccctgccagcccgcggccttcccctcgttctaggcttcaactgccggcctcgtgtcttctgcgcgtccctgtggcagggcaagtgaagagagagatggcgtcgcaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgttaactccatcgtcggggagaggatcgccactgtcagcgctttccagtctgagggtctgagaccgatgatgtggtcgcgcacaagggcagggttcaccttgaacattatcgacactcctgggcttattgaaggtggatacatt

SEQ ID NO: 3207 - protein, 59 aa, Zea mays
  misc_feature: Ceres CLONE 283865-F
MGKGGVGKSSTVNSIVGERIATVSAFQSEGLRPMMWSRTRAGFTLNIIDTPGLIEGGYI

SEQ ID NO: 3208 - DNA, 115 bp, Zea mays
  misc_feature: Ceres CLONE 283876-F
acacgcacaccgcgacccagtccagagccagtacgtgcgamrgcacgcacgctgctggtccgcgtacsagaacgacggtcaggtcggccggtgcttttcagtttggaataatgac

SEQ ID NO: 3209 - DNA, 482 bp, Zea mays
  misc_feature: Ceres CLONE 283889-F
  misc_feature (371)..(371): n is a, c, t, g, unknown, or other
atcccttgatcaaaaacccacaggccacaacaccaagaaaccagcatcttctgcagctctgaagaaaactcgatcaccatggacatgccttctcttgttctcctcctgctcgtcttcattgcaacaggcagccgcgccgcgggcaggtgttctgccgctcgcagttcaacctggccaacgaggcctgcagcctgcgcaccttctccgggcccaacccggcgcaaccgctgcagctgcacagcaacagctcctcggcatcctacgmgatacaggcggaccaccacgagcacgagcacagccacgagcacgagcacgagcacgagcatagccacgagcacgagcacgagcacagccacgaacacgagcgcgangagcacacgcacagccggcggcacggcttcgggcacggcggccgcgacccctacgacaccgcctgctgccgccgcctcatggggcatcgacaacgcctgcatctgccaggc

SEQ ID NO: 3210 - DNA, 355 bp, Zea mays
  misc_feature: Ceres CLONE 283891-F
  misc_feature (84)..(84): n is a, c, t, g, unknown, or other
  misc_feature (91)..(91): n is a, c, t, g, unknown, or other
  misc_feature (105)..(105): n is a, c, t, g, unknown, or other
  misc_feature (139)..(139): n is a, c, t, g, unknown, or other
actcatacatttcgactctcaactcccaaggtccctttttttttctcgatctggaagcgccgcagtagcagccatggacgtgancggacangcggtaaggcgaanaagggcgcggcggggcgcaaggccggcgggcgancgaagaagtcggtgtcgcggtcctccagggccgggctgcagttccccgtcagccgcgtcgggcgtacctcaaaaagggccggtacgcgcwbgttaggcacgggtgccccgtctacctcgccgccgtcctggagtacctcgcggccgaggtgctcgagctcgccggcaacgscaaagggacaacaagaakacgcgcatcattccgcgccacgtgctc

SEQ ID NO: 3211 - DNA, 423 bp, Zea mays
  misc_feature: Ceres CLONE 283913-F
  misc_feature: Encodes the peptide sequence at SEQ ID NO. 3212
  misc_feature (387)..(387): n is a, c, t, g, unknown, or other
gcgttcatctgcagtgcacgaacaatcgagccagcaacataaacgatcgaggcgcggtggccgttagcaaccgcagcaagcatgaataactcgcgcgctctagtgttggtgctcctgctgctggccatcgccatggcgagctgcaggctctcgctcgccgcccacgagagcagcaccagcctcgcgacaccctcggccgcgacctgcgggctccatcgccagggccgccggcaacctcttcataccggacggtggctggcgcgccgcgaacgtcaccgccgacgcagaggcaaagaacctgagggccgtggcgtcccggagcggcggcccgccaccaggaagtcctccggcggcggcgcgggctgcgtcagccgggtcgttgccggnaagaggcgggtcatctgcggcaagaggtgctacgac

SEQ ID NO: 3212 - protein, 114 aa, Zea mays
  misc_feature: Ceres CLONE 283913-F
MNNSRALVLVLLLLAIAMASCRLSLAAHESSTSLATPSAATCGLHRQGRRQPLHTGRWLARRERHRRRRGKEPEGRGVPERRPATRKSSGGGAGCVSRVVAGKRRVICGKRCYD

SEQ ID NO: 3213 - DNA, 826 bp, Zea mays
  misc_feature: Ceres CLONE 283925
  misc_feature: Encodes the peptide sequence at SEQ ID NO. 3214
gtagcatccaattgattgttctatcctcttctctgttctcacccccttgcaagcgccaagcaacaatcgttcaccgatcgatccagtgcgtcctgcatggaaactgccgccgtcgccgcctccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgccgaccatccgcacgtcaaggtggagacgatggtggagagcggggacccgcgggacgtcatctgcgacgcagccaacaagatggccgtgggcagccatggttacggcttcatccaaagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatgggcgaccatataggcatatatgtacacacctcacatcccattgcatggcagtcttcccttccctagttcaacaactagctttctgctggaataaggtgttcagacagagtatgtactgtacatactatcttcttgcatttggtactcttgtttggagagaagcgttccgtaaccttcggttgcctaaaaaaaaaaaaaaa

SEQ ID NO: 3214 - protein, 160 aa, Zea mays
  misc_feature: Ceres CLONE 283925
  misc_feature (12)..(156): Pfam Name: Usp Pfam Description: Universal stress protein family
METAAVAASGAGRRIMVAVDEGEESLHALNWCLANVVSPAGGDTLVLVHARRPRPVYAAMDSAGYMMTSDVLASVERHANAVSAAAVDKAKRVCADHPHVKVETMVESGDPRDVICDAANKMAVGSHGYGFIQRAFLGSVSNHCAQNCKCPVLIVKRPKE

SEQ ID NO: 3215 - DNA, 250 bp, Zea mays
  misc_feature: Ceres CLONE 283977-F
  misc_feature: Encodes the peptide sequence at SEQ ID NO. 3216
  misc_feature (175)..(175): n is a, c, t, g, unknown, or other
atcacacactaatcaacaagcaggaccagctagctagctcctctcactgctatcacccgcccagccatctcgctgaaagasaaaagcgcacatgaagactactagctcgggcattgcagtcgtcctatggtggccatgctggcagtccattccgccgttggccgacatctcgtgntccgacgtgctcaacgacctgtcgccgtgcctgtccttcctgcagggcaaggcagccaaacccagcgagacaaaa

SEQ ID NO: 3216 - protein, 53 aa, Zea mays
  misc_feature: Ceres CLONE 283977-F
  misc_feature (28)..(28): Xaa is any aa, unknown, or other
MKTTSSGIAVVLWWPCWQSIPPLADISXSDVLNDLSPCLSFLQGKAAKPSETK

SEQ ID NO: 3217 - DNA, 95 bp, Zea mays
  misc_feature: Ceres CLONE 283978-F
  misc_feature: Encodes the peptide sequence at SEQ ID NO. 3218
ataagaaaaatactcccgtgttcttcgaccggcggcggtggtgcgamsagggcggttaagggagacgagatgagggggacgaagcggccgctcgg

SEQ ID NO: 3218 - protein, 31 aa, Zea mays
  misc_feature: Ceres CLONE 283978-F
  misc_feature (16)..(16): Xaa is any aa, unknown, or other
IRKILPCSSTGGGGAXRAVKGDEMRGTKRPL

SEQ ID NO: 3219 - DNA, 492 bp, Zea mays
  misc_feature: Ceres CLONE 284013-F
  misc_feature: Encodes the peptide sequence at SEQ ID NO. 3220
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgcaacactggtgtcatggtcgggattgggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgttggctcccgaggagcaccccgtcctcctcaccgaggcgcccctgaaccccaaggctaacagggagaagatgacccagatcatgttcgagaccttcaacac

SEQ ID NO: 3220 - protein, 116 aa, Zea mays
  misc_feature: Ceres CLONE 284013-F
  misc_feature (4)..(117): Pfam Name: Actin Pfam Description: Actin
  misc_feature: SWISSPROT Homolog: EC 2.7.10.2 Non-specific protein-tyrosine kinase
MADAEDIQPLVCDNGTGMVKAGFAGDDAPRAVFPSIVGRPRNTGVMVGIGQKDAYVGDEAQSKRGILTLKYPIEHGIVSNWDDMEKIWHHTFYNELRVGSRGAPRPPHRGAPEPQG

SEQ ID NO: 3221 - DNA, 429 bp, Zea mays
  misc_feature: Ceres CLONE 284034-F
  misc_feature: Encodes the peptide sequence at SEQ ID NO. 3222
  misc_feature (196)..(196): n is a, c, t, g, unknown, or other
  misc_feature (416)..(416): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagnatggcgacggagg

SEQ ID NO: 3222 - protein, 76 aa, Zea mays
  misc_feature: Ceres CLONE 284034-F
  misc_feature: SWISSPROT Homolog: EC 2.3.1.74 Naringenin-chalcone synthase
  misc_feature (72)..(72): Xaa is any aa, unknown, or other
MQDYVVDGFMKNTNCDDPELKEKLTRLCKTTTVRTRYVVMSDEILKNYPELAQEGLPTMNQRLDISNAAVTXMATE

SEQ ID NO: 3223 - DNA, 484 bp, Zea mays
  misc_feature: Ceres CLONE 284039-F
  misc_feature: Encodes the peptide sequence at SEQ ID NO. 3224
ataacacactccaccctctccgcgactccgcctcgsgcgaacgtgcccgcggccattcgtacggcgtggctaggagcactccttcgaatcggcatcgcaattcatacggctacaacgtctattctgtgggcgcttcgtctccgatcgattcacggcaagagcgagagttcatggattcgacagggcccatgagggtctccatcaaagcccaccgccccgaatggaaatcggagcttagaacaaattgcctcagaagagttagaaaggacagaaatgacttgctttggaagatcaggaagcagggactsccggcaatgtcatggaaaaggtcagatctgctgtcaggagcgtcatatctgatgaggtagagaaactcaaacagtccaatacagaaaacgaggaccaagaaatggatgtcatatgggagtatcaaggactgcatgctgctaasctgctgaaattgaaagtgaagatatattgcttg

SEQ ID NO: 3224 - protein, 55 aa, Zea mays
  misc_feature: Ceres CLONE 284039-F
  misc_feature (44)..(44): Xaa is any aa, unknown, or other
MEKVRSAVRSVISDEVEKLKQSNTENEDQEMDVIWEYQGLHAAXLLKLKVKIYCL

SEQ ID NO: 3225 - DNA, 476 bp, Zea mays
  misc_feature: Ceres CLONE 284053-F
  misc_feature: Encodes the peptide sequence at SEQ ID NO. 3226
cccctctgcgccgccctcacccaccgccgtcgccacctctctcaccgcggaacaagacgctgaggaagaagagccggtacgagacggcaagaagacgcggasagtacgatgttggtaaggttcttcctgatttgaacgacaagctcactgataatgagttcctggaagagaaagctagacagtttctgttagaggaggaaaaagaggatgatgaactcttcttagtaattgtccctgctgttctcttggccatgcaagaagagaaaaggtcagtccgtgcttccggtacgtcagcacatggaagcgcgaaawagcggaagaaaaatcaggttgcaagtgttctggaagactatttggagcacaggaagaagcaaacggagaagactgtagaggcgttacttgagatgaagagtcgtgaagaggagtactctattgagaggtgtcttgacatagttgatgcattggagggagttgac

SEQ ID NO: 3226 - protein, 158 aa, Zea mays
  misc_feature: Ceres CLONE 284053-F
  misc_feature (34)..(34): Xaa is any aa, unknown, or other
  misc_feature (104)..(104): Xaa is any aa, unknown, or other
PLRRPHPPPSPPLSPRNKTLRKKSRYETARRRGXYDVGKVLPDLNDKLTDNEFLEEKARQFLLEEEKEDDELFLVIVPAVLLAMQEEKRSVRASGTSAHGSAKXRKKNQVASVLEDYLEHRKKQTEKTVEALLEMKSREEEYSIERCLDIVDALEGVD

SEQ ID NO: 3227 - DNA, 441 bp, Zea mays
  misc_feature: Ceres CLONE 284092-F
  misc_feature: Encodes the peptide sequence at SEQ ID NO. 3228
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
gcacacgagaaggccagggagacgtcttgcttctccttcgctcgtctacctgcttcctagttgttccatcatccatggcgcgcttcgcctccgctgtcctcttcgccgctgtcctgctcatggctggacggctgacccatgcggggccgtcgacggcgaggtgctttggcggcgcgcagtcctgccgggctccgcgtgccgaacgccgtcctccggctcctacgcccctatagccacttcgtaagcgaascaatgccgaggacaccgggcgatccaacgctccgttcaactaccaataactacaagcnnncctctgcgactgcgacctcacctccaggtgaccgcagtgaagcagggctcgctggtggcagcggcgcgagakatgacacgccgttcagctacagctacagggcgccgagccaacaaggggtacggtccagc

SEQ ID NO: 3228 - protein, 101 aa, Zea mays
  misc_feature: Ceres CLONE 284092-F
  misc_feature (38)..(38): Xaa is any aa, unknown, or other
  misc_feature (57)..(57): Xaa is any aa, unknown, or other
  misc_feature (58)..(58): Xaa is any aa, unknown, or other
  misc_feature (82)..(82): Xaa is any aa, unknown, or other
MRGRRRRGALAARSPAGLRVPNAVLRLLRPYSHFVSEXMPRTPGDPTLRSTTNNYKXXSATATSPPGDRSEAGLAGGSGARXDTPFSYSYRAPSQQGVRSS

SEQ ID NO: 3229 - DNA, 405 bp, Zea mays
  misc_feature: Ceres CLONE 284133-F
  misc_feature: Encodes the peptide sequence at SEQ ID NO. 3230
  misc_feature (136)..(136): n is a, c, t, g, unknown, or other
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcnacaacggaactggcatggtcaaggctgggttcgccktgcgacgacgccccgagggccgtcttccccagcatcgtggggcgcccgckcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgttggctcccgagga

SEQ ID NO: 3230 - protein, 102 aa, Zea mays
  misc_feature: Ceres CLONE 284133-F
  misc_feature: SWISSPROT Homolog: EC 2.7.10.2 Non-specific protein-tyrosine kinase
  misc_feature (13)..(13): Xaa is any aa, unknown, or other
  misc_feature (25)..(25): Xaa is any aa, unknown, or other
MADAEDIQPLVCXNGTGMVKAGFAXRRRPEGRLPQHRGAPAHTGVMVGMGQKDAYVGDEAQSKRGILTLKYPIEHGIVSNWDDMEKIWHHTFYNELRVGSRG

SEQ ID NO: 3231 - DNA, 90 bp, Zea mays
  misc_feature: Ceres CLONE 284160-F
aatcgccaccgcctctccgctcctcgacaagaccaatggcggctgctgcgtcctccgctctgcacgccgttggccgtcgctccgccaagc

SEQ ID NO: 3232 - DNA, 199 bp, Zea mays
  misc_feature: Ceres CLONE 284179-F
  misc_feature: Encodes the peptide sequence at SEQ ID NO. 3233
  misc_feature (97)..(97): n is a, c, t, g, unknown, or other
  misc_feature (100)..(100): n is a, c, t, g, unknown, or other
  misc_feature (195)..(195): n is a, c, t, g, unknown, or other
attagagagagctacaacaagcatgaagctaagactggtagcgctagtkctggcggtasgtcggtgtacgcttgctcgtcggcggcatcagcgttcncgngggacgacgtcgtccgtgtcgcgctaaagcatgtcgacgctgggaagcagctgtccaggcccgagctgatccggcgcgccattcgtaggagcaangcga

SEQ ID NO: 3233 - protein, 66 aa, Zea mays
  misc_feature: Ceres CLONE 284179-F
  misc_feature (17)..(17): Xaa is any aa, unknown, or other
  misc_feature (20)..(20): Xaa is any aa, unknown, or other
  misc_feature (33)..(33): Xaa is any aa, unknown, or other
  misc_feature (34)..(34): Xaa is any aa, unknown, or other
  misc_feature (65)..(65): Xaa is any aa, unknown, or other
IRESYNKHEAKTGSASXGGXSVYACSSAASAFXXDDVVRVALKHVDAGKQLSRPELIRRAIRRSXA

SEQ ID NO: 3234 - DNA, 367 bp, Zea mays
  misc_feature: Ceres CLONE 284209-F
  misc_feature: Translation starting site: 77
  misc_feature: SWISSPROT Homolog: EC 1.1.1.1 Alcohol dehydrogenase
  misc_feature: SWISSPROT Homolog: EC 1.2.1.66 Mycothiol-dependent formaldehyde dehydrogenase
  misc_feature (141)..(141): n is a, c, t, g, unknown, or other
  misc_feature (142)..(142): n is a, c, t, g, unknown, or other
  misc_feature (264)..(264): n is a, c, t, g, unknown, or other
  misc_feature (282)..(282): n is a, c, t, g, unknown, or other
  misc_feature (288)..(288): n is a, c, t, g, unknown, or other
  misc_feature (308)..(308): n is a, c, t, g, unknown, or other
  misc_feature (336)..(336): n is a, c, t, g, unknown, or other
actcgtagtcctaggcactttcatctgtggcctctgcgttcgagatcgatctgagctggcaccgtcccacttcgccatggcggaggaccggagccccaagcccatccactgcaaagcggcggtgtgcagagccgccggcrnnccactcaccatcgaggagatcgtcgtcgacccgccgaaagcgtacgagatccgcatccgggtcgtctgcacctcactctgccacabbsgatatcaccttctggaaagctaaggtggcaccgntgtttccaagaatactanggcatnaggcgtacggggtagtgganatcgtgggggatcacgtggagggcttcncggcgggggacaccgtggtgccgacgttcct

SEQ ID NO: 3235 - DNA, 434 bp, Zea mays
  misc_feature: Ceres CLONE 284233-F
  misc_feature (157)..(157): n is a, c, t, g, unknown, or other
  misc_feature (177)..(177): n is a, c, t, g, unknown, or other
  misc_feature (190)..(190): n is a, c, t, g, unknown, or other
  misc_feature (329)..(329): n is a, c, t, g, unknown, or other
  misc_feature (335)..(335): n is a, c, t, g, unknown, or other
atttttttcgaccgccgccgcccccagtccccgatccgaagctgtgcctcgtaccatttcgatccaatggcgccgacgtcgaagctgtcgacgggcatcaagcgcgcttcsgtcgcacacgtaccatcgccgtgggctgtgggccatcaaggccaanaacggcggcgcttccccaangccgacaaggccncgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatngggaanagagtggtgtttctcaagcagctcaagtctggcctgctccttatctctgggcctttcaagatcaatggagtaccgatccgccgttttaaccagacctat

SEQ ID NO: 3236 - DNA, 135 bp, Zea mays
  misc_feature: Ceres CLONE 284242-F
  misc_feature (110)..(110): n is a, c, t, g, unknown, or other
acgctcgcagcctcgcttagacagacacacacacacactcaacagcaacagctaagcctctcccaccagacagcaacatggctgaggaggaggccaagaaggtggaggtnggaggtcaccaaggagcccgaggcg

SEQ ID NO: 3237 - DNA, 331 bp, Zea mays
  misc_feature: Ceres CLONE 284255-F
  misc_feature: Encodes the peptide sequence at SEQ ID NO. 3238
  misc_feature (1)..(1): n is a, c, t, g, unknown, or other
  misc_feature (157)..(157): n is a, c, t, g, unknown, or other
  misc_feature (220)..(220): n is a, c, t, g, unknown, or other
  misc_feature (256)..(256): n is a, c, t, g, unknown, or other
ntttcctatttttcctctcctcccccacagcagcccggcgaaaaccctagtaagcaaaccaccggagcagcggcgcttgcbsagcggagccatggcgacgacgattacaacgaaattgacatggggtatgaggatgagcccccagaaccggagattnaggaaggagctgaagaagagcctgagaacaatgaagatgcccctgatgacgtcataggtggtnagggtgaagataaggaacaggaaaagaccaagcgtnaacgcaaaacaacaaaatacatgacgaakacgaacgtgcgcgcatcctgggtacacgagccttkcagataagcat

SEQ ID NO: 3238 - protein, 107 aa, Zea mays
  misc_feature: Ceres CLONE 284255-F
  misc_feature (27)..(27): Xaa is any aa, unknown, or other
  misc_feature (52)..(52): Xaa is any aa, unknown, or other
  misc_feature (73)..(73): Xaa is any aa, unknown, or other
  misc_feature (85)..(85): Xaa is any aa, unknown, or other
  misc_feature (94)..(94): Xaa is any aa, unknown, or other
  misc_feature (106)..(106): Xaa is any aa, unknown, or other
SYFSSPPPQQPGENPSKQTTGAAALAXRSHGDDDYNEIDMGYEDEPPEPEIXEGAEEEPENNEDAPDDVIGGXGEDKEQEKTKRXRKTTKYMTXTNVRASWVHEPXR

SEQ ID NO: 3239 - DNA, 114 bp, Zea mays
  misc_feature: Ceres CLONE 284267-F
acacgcacaccgcgacccagtccagagccagtacgtgcgamggcacgcacgctgctggtccgcgtacsagacgacggtcaggtcggccggtgcttttcagtttggaataatgac

SEQ ID NO: 3240 - DNA, 429 bp, Zea mays
  misc_feature: Ceres CLONE 284274-F
  misc_feature: Encodes the peptide sequence at SEQ ID NO. 3241
  misc_feature (121)..(121): n is a, c, t, g, unknown, or other
  misc_feature (296)..(296): n is a, c, t, g, unknown, or other
  misc_feature (298)..(298): n is a, c, t, g, unknown, or other
  misc_feature (305)..(305): n is a, c, t, g, unknown, or other
  misc_feature (313)..(313): n is a, c, t, g, unknown, or other
  misc_feature (361)..(361): n is a, c, t, g, unknown, or other
  misc_feature (397)..(397): n is a, c, t, g, unknown, or other
atcaccctttctcggcggccggcctcttctcttcacggactcgcaggtcatcgagatgtcgtcggcggaggcgaaggcgcggcgaaggcggtcccggagtctgtgctgcgcaaskcaagbngaggagcagtgggcagcggacaagaaggagaaggccctcgcagacaggaaggaggcgcttgayagccgcaagatcatatttgctcgcgccaagcagtacgcccaggagtacgacgcccaggagaaggagcttgtgcagctcaagcgtgaggctcggttaaagggtgggttctatntnascccanaggccaancttctgtttgtggtccgcatccgtggtatcaatgccatacaccccaanacccgcaagatcttgcagctcctgcgtttgaggcanatcttcaatggtgtctttctcaaggttaacaa

SEQ ID NO: 3241 - protein, 124 aa, Zea mays
  misc_feature: Ceres CLONE 284274-F
  misc_feature (15)..(85): Pfam Name: Ribosomal_L30_N Pfam Description: Ribosomal L30 N-terminal domain
  misc_feature (87)..(124): Pfam Name: Ribosomal_L30 Pfam Description: Ribosomal protein L30p/L7e
  misc_feature (20)..(20): Xaa is any aa, unknown, or other
  misc_feature (22)..(22): Xaa is any aa, unknown, or other
  misc_feature (81)..(81): Xaa is any aa, unknown, or other
  misc_feature (82)..(82): Xaa is any aa, unknown, or other
  misc_feature (84)..(84): Xaa is any aa, unknown, or other
  misc_feature (86)..(86): Xaa is any aa, unknown, or other
  misc_feature (102)..(102): Xaa is any aa, unknown, or other
  misc_feature (114)..(114): Xaa is any aa, unknown, or other
MSSAEAKARRRRSRSLCCAXQXEEQWAADKKEKALADRKEALDSRKIIFARAKQYAQEYDAQEKELVQLKREARLKGGFYXXPXAXLLFVVRIRGINAIHPXTRKILQLLRLRXIFNGVFLKVN

SEQ ID NO: 3242 - DNA, 400 bp, Zea mays
  misc_feature: Ceres CLONE 284275-F
  misc_feature: Encodes the peptide sequence at SEQ ID NO. 3243
  misc_feature (168)..(168): n is a, c, t, g, unknown, or other
  misc_feature (306)..(306): n is a, c, t, g, unknown, or other
  misc_feature (311)..(311): n is a, c, t, g, unknown, or other
actctgcctctgctctcacctgtttcgctgctcgcccgatctcgcgctgccggcagcgatctgagatcgagcgavkaagctttttcatcgagatggtgcttgtactgcatgctaacagtggtaacaaaaatgcattcaaaacactaattkccgcagaatacagcggtntcaaggttcagttggtcaaggactttcaaatgggtgtctccaacaaaactccagagttcctcaagatgaaccctattgggaagattcctgtcctggagactcctgatggtcctgtttttgagagcaatgcaattcaanatatnttactcgcttaaaggctgataacccactttatggatcttcactgattgattatgcccatattgagcaatggattgactttgctgcaaca

SEQ ID NO: 3243 - protein, 76 aa, Zea mays
  misc_feature: Ceres CLONE 284275-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (20)..(20): Xaa is any aa, unknown, or other
  misc_feature (26)..(26): Xaa is any aa, unknown, or other
  misc_feature (72)..(72): Xaa is any aa, unknown, or other
  misc_feature (73)..(73): Xaa is any aa, unknown, or other
MVLVLHANSGNKNAFKTLIXAEYSGXKVQLVKDFQMGVSNKTPEFLKMNPIGKIPVLETPDGPVFESNAIQXXLLA

SEQ ID NO: 3244 - DNA, 438 bp, Zea mays
  misc_feature: Ceres CLONE 284290-F
  misc_feature: Pfam Name: AUX_IAA Pfam Description: AUX/IAA family
  misc_feature (179)..(179): n is a, c, t, g, unknown, or other
  misc_feature (245)..(245): n is a, c, t, g, unknown, or other
  misc_feature (303)..(303): n is a, c, t, g, unknown, or other
  misc_feature (335)..(335): n is a, c, t, g, unknown, or other
  misc_feature (360)..(360): n is a, c, t, g, unknown, or other
  misc_feature (375)..(375): n is a, c, t, g, unknown, or other
  misc_feature (396)..(396): n is a, c, t, g, unknown, or other
  misc_feature (409)..(409): n is a, c, t, g, unknown, or other
  misc_feature (430)..(430): n is a, c, t, g, unknown, or other
  misc_feature (434)..(434): n is a, c, t, g, unknown, or other
aggaaggcagagagcagcgccgcgattgagaggaggaggagcggggcccactcggcgttcatktccgacgagccgcctccagccgacgcggaagaggtggaggagaactccggcgccgaggaggaggacgaggagacggtggtggagcaggacgacgacgagctggagctggggctctnctcggctccaagcaacagcagcagcagcatccgccgccgtgccggatcctcacggcccgggacctncagccgaggtccctttcaccggattcctccgtgtcctcttcctcccccgcggcaggtncaggtaccgcggcgccaagcaagagggccaangcggatgcggcgcccaactcgccanggacggtcgcgtctngccacccacagagcagctttngagtggtgggatngccacccataagaactttcangatnaaca

SEQ ID NO: 3245 - DNA, 180 bp, Zea mays
  misc_feature: Ceres CLONE 284317-F
  misc_feature: Encodes the peptide sequence at SEQ ID NO. 3246
  misc_feature (42)..(42): n is a, c, t, g, unknown, or other
  misc_feature (44)..(44): n is a, c, t, g, unknown, or other
atccaacccacacacaggctgaccccaccaacagcaagcganantctcccgatcccctctagtctccgcggcgaagatgtcggggcgcggcaagggcgggaagggcctgggcaagggcggassacgcaccgggaaggtgctccgcgacaacatccaggggatcacgaagccggcgatccg

SEQ ID NO: 3246 - protein, 34 aa, Zea mays
  misc_feature: Ceres CLONE 284317-F
  misc_feature (16)..(16): Xaa is any aa, unknown, or other
MSGRGKGGKGLGKGGXRTGKVLRDNIQGITKPAI

SEQ ID NO: 3247 - DNA, 428 bp, Zea mays
  misc_feature: Ceres CLONE 284351-F
  misc_feature: Translation starting site: 178
  misc_feature: SWISSPROT Homolog: EC 3.2.1.51 Alpha-L-fucosidase
  misc_feature (251)..(251): n is a, c, t, g, unknown, or other
  misc_feature (357)..(357): n is a, c, t, g, unknown, or other
atcagccaaagtataagcgcagatcgagtcatcaagctagctagcccggagcacgcctagacacgccagcagcaatggsgctcagctggccgtcgcgtttctcgccttgttgtcctcctctgccttcttggccgtgtctggcagaagttcaacgccatcttcagcttcggcgactccatgtccgacaccggcaacctgtgcgtgaacggtccccccgccggcctgacgctcacccagccgccctacgsagnaccttctttggccgcgcacctgccgctgctccgacggccgcctcgtcgtcgacttcctggccgagaagttcgggctgccgctgctgaagccgtcgaagcagggcgnctcagacttcaagcagggcgccaacatggsatcattggcgcgaccaccatggactcgggcttcttccagtc

SEQ ID NO: 3248 - DNA, 161 bp, Zea mays
  misc_feature: Ceres CLONE 284354-F
gattttsagatcagaaccaaactcggctcgagagagatcgcatacgcctgcctgyyywyccacctccccttttccttcctcttcgccccagcacgsccgcccggagaccgagcgaggcaggcaactaaccaccgagagcagggacaggaacaggaagccgg

SEQ ID NO: 3249 - DNA, 472 bp, Zea mays
  misc_feature: Ceres CLONE 284379-F
  misc_feature: Translation starting site: 157
acggacgcttcgctctagtcggaaggtttcgaggaactcccgggctcgaggagatcgggacgatgatgggagggcgcgctctgctgctgctcctgggtctcgggcgcytgctcgttcagatccgcgcctctgacccgctgctgtacgagccgtttgatgaggacttcgagggtagatggatcgtctcccaagaaggatgaataccaaggtgtatggaagcatgccaagagtgatgggcatgaggactatggcctccttgttagtgacaaggcaaggaaatacgccataatcaaggagcttgatgagcccagttaccttaaatgatgggacagtggtcctgcagtttgaagtgagacttcagaatggccttgaatgttggaggtgcctacattaagtacatccgccctcaggatgctggatgggatgccaaggagtttgataatgagactccatacactattatgtttgggtc

SEQ ID NO: 3250 - DNA, 241 bp, Zea mays
  misc_feature: Ceres CLONE 284383-F
  misc_feature: Encodes the peptide sequence at SEQ ID NO. 3251
  misc_feature (86)..(86): n is a, c, t, g, unknown, or other
gatttgatcggctcctagtgacatgtctctgaaatcatctttataccaggtcatcggaatcggacgttcccgttggagcagcagcnrtacgagcagccatgtccaccacggtctcgccgccgccagactctttcggcgatgcccaacggcacccggcacccccagctccaacttcacgctgctgtacatcatcatcgcggtgctcaccggcgtgatactgtacgtggccatccgccatggc

SEQ ID NO: 3251 - protein, 73 aa, Zea mays
  misc_feature: Ceres CLONE 284383-F
  misc_feature (22)..(22): Xaa is any aa, unknown, or other
MSLKSSLYQVIGIGRSRWSSSXTSSHVHHGLAAARLFRRCPTAPGTPSSNFTLLYIIIAVLTGVILYVAIRHG

SEQ ID NO: 3252 - DNA, 476 bp, Zea mays
  misc_feature: Ceres CLONE 284393-F
  misc_feature: Encodes the peptide sequence at SEQ ID NO. 3253
ccgccgctccccccaactccaccaggctccagtgtctcctccgcttctcgccgctttcccctcctccgcctgggcgcggcgccgcccgcacctcccgatcccgtggacgtcctcgcaggcggcgtgttgcacgagagcttagggaatgttttaccagtattgttcatggtaaactcagagtttctatcaactgcccgggaaagtgaacttgttttccactccatctttagtgtcaaaaccaatttcttctacaggggcaacggaactacttcgaagtgaattatgggtggggttctgctgctgcctcagtgctgaagaatttgatgaatatgtctatccaaacaaccctatctattaggcaatgcgtatccttggaggcatctttttccacaacatttttggcgggtatactgcaacattccagaggcttgagtctaggccaaacaacccagctcaagggggttgctccactgggg

SEQ ID NO: 3253 - protein, 38 aa, Zea mays
  misc_feature: Ceres CLONE 284393-F
MRILGGIFFHNIFGGYTATFQRLESRPNNPAQGGCSTG

SEQ ID NO: 3254 - DNA, 170 bp, Zea mays
  misc_feature: Ceres CLONE 284411-F
  misc_feature: Encodes the peptide sequence at SEQ ID NO. 3255
aytcgccgcctcctccccactgcctcgtgtggccgtcgtctcccgttcgaacgccaagcccccctccggcgaaatggcccccaagcgaggtggcagggcgccggtgccggccaagaagaagacggataaagtgacgaaccctctgtttgagaagaggccgaagcagttcg

SEQ ID NO: 3255 - protein, 32 aa, Zea mays
  misc_feature: Ceres CLONE 284411-F
MAPKRGGRAPVPAKKKTDKVTNPLFEKRPKQF

SEQ ID NO: 3256 - DNA, 125 bp, Zea mays
  misc_feature: Ceres CLONE 284413-F
attccgcagacgcgcggcgagggagtaggaggggacggcgggtgcgaggcccgcagcacggggaagctacctgcttgcgtmcgggcgggctcgcgctgtgctgtcgctccatgtcggtcgccggc

SEQ ID NO: 3257 - DNA, 131 bp, Zea mays
  misc_feature: Ceres CLONE 284418-F
acacgcacaccgcgacccagtccagagccagtacgtgcgamrcacgcacgctgctggtccgcgtacsagacgacggtcaggtcggccggtgcttttcagtttggaataatgacggcgacgacgacgacagc

SEQ ID NO: 3258 - DNA, 447 bp, Zea mays
  misc_feature: Ceres CLONE 284427-F
  misc_feature: Encodes the peptide sequence at SEQ ID NO. 3259
  misc_feature (169)..(169): n is a, c, t, g, unknown, or other
  misc_feature (336)..(336): n is a, c, t, g, unknown, or other
  misc_feature (339)..(339): n is a, c, t, g, unknown, or other
  misc_feature (420)..(420): n is a, c, t, g, unknown, or other
atttcatttaccacaccctgctctcgctcttgttgtgacggtcgattcgsttkkwamaascwagcaaccttgagatccagccaagatccagccatgagggagattctccacatccagggtggacaktgcggcaaccagatcggttccaagttctgggaggtcgtctgcnmsagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtcgcaccgggccgtacgnagnatcttccgccccgacaacttcgtcttcggccagtctggcgcggggaacaactgggccaagggcactacacagagggcgctnagctcatcgactctgtgctttacgtcg

SEQ ID NO: 3259 - protein, 53 aa, Zea mays
  misc_feature: Ceres CLONE 284427-F
  misc_feature (17)..(17): Xaa is any aa, unknown, or other
  misc_feature (18)..(18): Xaa is any aa, unknown, or other
  misc_feature (45)..(45): Xaa is any aa, unknown, or other
MDLEPGTMDSVAPGRTXXLPPRQLRLRPVWRGEQLGQGHYTEGAXLIDSVLYV

SEQ ID NO: 3260 - DNA, 165 bp, Zea mays
  misc_feature: Ceres CLONE 284469-F
  misc_feature: Encodes the peptide sequence at SEQ ID NO. 3261
agcagccgtcgggcttctctgccttgtacttgcgatcgagtccaagacttgcggagataggatctactagtcgaccgatccggatccttcccttccgtctcacgctgcttgctcgggacgggaacggaggcggggttgcgatggcgctgcagtacgtggaggcgc

SEQ ID NO: 3261 - protein, 54 aa, Zea mays
  misc_feature: Ceres CLONE 284469-F
QPSGFSALYLRSSPRLAEIGSTSRPIRILPFRLTLLARDGNGGGVAMALQYVEA

SEQ ID NO: 3262 - DNA, 499 bp, Zea mays
  misc_feature: Ceres CLONE 284496-F
  misc_feature: Translation starting site: 116
acaagaacactcctagctagctgaagatctcgagtgcaacgaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggcaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaaactggcgagtgggctgttgttgggggcacggccagtttgctatggcgaacggcatcyatct

SEQ ID NO: 3263 - DNA, 446 bp, Zea mays
  misc_feature: Ceres CLONE 284503-F
  misc_feature: Encodes the peptide sequence at SEQ ID NO. 3264
cagtttcaaacttctcgactcgcccctccccgtccggccgtcccccatcccacccacgcttcctccccctccgcgccgctcctccaggctccaaccatggcggtcgccaccgagtcgcgcggcasaggacagggcttcagccatgcgaaccaggagaagcggtgggtgctgtctgatttcgaggttgggaaacctcttgggaggggcaagtttggccatgtttatcttgccagagaaaaaaggagtagtgagattgtggctttgaaagttcttttcaagagccagctcaagcaatcacaggttgagcatcagctgcgacgtgaagtggagattcagagtcatcttcgccatcctaatattcttcgcctgtatgggtacttctatgatcagaccagggtttacctaatcctggaatacgctgccaagggtgaactgtataaggaact

SEQ ID NO: 3264 - protein, 116 aa, Zea mays
  misc_feature: Ceres CLONE 284503-F
  misc_feature: SWISSPROT Homolog: EC 2.7.11.1 Non-specific serine/threonine protein kinase
  misc_feature (10)..(10): Xaa is any aa, unknown, or other
MAVATESRGXGQGFSHANQEKRWVLSDFEVGKPLGRGKFGHVYLAREKRSSEIVALKVLFKSQLKQSQVEHQLRREVEIQSHLRHPNILRLYGYFYDQTRVYLILEYAAKGELYKE

SEQ ID NO: 3265 - DNA, 344 bp, Zea mays
  misc_feature: Ceres CLONE 284513-F
  misc_feature: Encodes the peptide sequence at SEQ ID NO. 3266
  misc_feature (74)..(74): n is a, c, t, g, unknown, or other
aaaacccttgckgcgtcgcactcacactagcgaccaacccccaaccccagaccttcctctccggcggcggccgncgcgcgcgcbtagggagatggaccgcccttccggcacatcgtaccagcgctttccccgcgttcggatccgcgagctcaaggacgactacgccaagttcgaactccgcgacaccgacgctagcatggccaacgccctccgccgcgtcatgatcgccgaagtcccaactgtcgccatcgatctcgtagaatmgggttaactcctccgtcctcaacgacgagttcatcgcccaccgtctgggggctcatcccgctcacctccgccggccgcca

SEQ ID NO: 3266 - protein, 59 aa, Zea mays
  misc_feature: Ceres CLONE 284513-F
  misc_feature: SWISSPROT Homolog: EC 2.7.7.6 DNA-directed RNA polymerase
  misc_feature (58)..(58): Xaa is any aa, unknown, or other
MDRPSGTSYQRFPRVRIRELKDDYAKFELRDTDASMANALRRVMIAEVPTVAIDLVEXG

SEQ ID NO: 3267 - DNA, 448 bp, Zea mays
  misc_feature: Ceres CLONE 284527-F
  misc_feature: Encodes the peptide sequence at SEQ ID NO. 3268
  misc_feature (380)..(380): n is a, c, t, g, unknown, or other
atccaattcacaggctcaccacaccaaccaacaagcaaaaattccccaatcctctcgtctccgcggcgaagatgtcggggcgcggcaagggcggcaagggcctgggcaagggcggcgcgamstcaccggaaggtctgcgcgacaacatccaggggatcacgaagccggcgatccggagctggcgcggcggggcggcgtgaacsatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagscagggccgcaccctctacggcttcggcggctaggcctnccgcgccgccttcgccgtcgctgcggttctggtgttsctgcagttcgcaagttgtttgtgtgggcgga

SEQ ID NO: 3268 - protein, 42 aa, Zea mays
  misc_feature: Ceres CLONE 284527-F
  misc_feature (17)..(17): Xaa is any aa, unknown, or other
MSGRGKGGKGLGKGGAXSPEGLRDNIQGITKPAIRSWRGGAA

SEQ ID NO: 3269 - DNA, 478 bp, Zea mays
  misc_feature: Ceres CLONE 284534-F
  misc_feature: Encodes the peptide sequence at SEQ ID NO. 3270
  misc_feature (345)..(345): n is a, c, t, g, unknown, or other
  misc_feature (351)..(351): n is a, c, t, g, unknown, or other
  misc_feature (433)..(433): n is a, c, t, g, unknown, or other
aaaaactgaaccagcaacaaaccgatgcccatgagattgacatggtgatcgagctacaggccggtcgtcttctccaacgctagacaacgaagaaggagcaattaatcaagtagatcgattcaatccaatccaatggggttgctgataccagcccgtccggagcaatgcacgttgagccgtgtcgtgtctctcatcaccgtcggttcgtcatcgtggtttgcacgtacgtcacatcttctccggccggtggcgacgccgggaaggaggagttcttcagcatatggcaccgtcgatcatcggattttgtccccgacgatctggaggtggcgctgcgcggcgcastancgcganacaggacgctgatcctgaccatgctgaacaaggcttattcggaggagggcggcctcctcgacctcttcctcgagagcctganggaaggggacggcaccgagcagttgatcgaccacgtcctcttcgt

SEQ ID NO: 3270 - protein, 104 aa, Zea mays
  misc_feature: Ceres CLONE 284534-F
  misc_feature (60)..(60): Xaa is any aa, unknown, or other
  misc_feature (61)..(61): Xaa is any aa, unknown, or other
  misc_feature (63)..(63): Xaa is any aa, unknown, or other
  misc_feature (90)..(90): Xaa is any aa, unknown, or other
MHVEPCRVSHHRRFVIVVCTYVTSSPAGGDAGKEEFFSIWHRRSSDFVPDDLEVALRGAXXRXRTLILTMLNKAYSEEGGLLDLFLESLXEGDGTEQLIDHVLF

SEQ ID NO: 3271 - DNA, 374 bp, Zea mays
  misc_feature: Ceres CLONE 284540-F
  misc_feature: Translation starting site: 91
  misc_feature (202)..(202): n is a, c, t, g, unknown, or other
aacctctagctgattgatctctggtatttaccactctttccttccttccttccttcaattctaaataccacaaatcaaagttgctttgcgatggtgagcagcagcatggacacgacgagtgacaagcgtgcgtcatccatgctggcccctaaccctggcaaggccacgatcctcgcccttggccacgctkkcycgcagcakntgtcatgcaggactacgtcgtcgacggacttcatgaaagaacaccaactgtgacgacccggagctcaaggagaagctcaccagactctgcagacgacgaccgtgagactcggtacgtggtgatgtcggatgagatcctcaagaactacccggagctggccccaggaggggct

SEQ ID NO: 3272 - DNA, 450 bp, Zea mays
  misc_feature: Ceres CLONE 284577-F
  misc_feature: SWISSPROT Homolog: EC 3.1.2.15 Ubiquitin thiolesterase
gattctagatcaagcgagtcctcccgtttcatcgcctcgaaaaaaggcgagaaatctgcaacagaagaagcagcagcgacasatttccttcctcgtacctttcgttgctctcgcgcactcggatcgacccctctagggtttcgcatcggcctcccgccagctcctatccctcccctctccctccgccgcgcacccgsssggagccaccaaaccctaggacggcaaatccggtgcgatcgcccacggtggaggcctcgtcggcggccgagaggagccgctcagggctcgggtcagggttccggtacctcgccggcgccgcttctggctggtggggaccggtggatggtcatgggagccagcggctcatatgcttgagaaggccctcggagaccagttcccggaaggcgagcgctacttcggcctcgagaacttcggcaacacctgctactg

SEQ ID NO: 3273 - DNA, 600 bp, Zea mays
  misc_feature: Ceres CLONE 284592-R
acgattgggtaccgggccccccctcgaggtcgacggtatcgataagcttttttttttttttttttggatggataaatagatgacattacattacagaaatttttacagcttctataaagagaagatgatgacattattgtcacagtaatctaaactctaataatactagaataggacacagctacttttttcgatctatttcttttttaatccaaaccttaatagcagactcgctctgttagttatgtgggagtgggagccttgggccttcaacactagatcctgcctctttttaatctaaactctaatagcaaacactccctctgttgccttcgccgcgggcatccaagaaggagctactttcttggacaggtagggtagtgcgcacgccggctgtgctgccgtcggcgcggtgtcgcacatgttgcagcgctgagaggagctgcagcactgctggtttgcctcgcggtggaaagacggctgccagaggatggcccctgcaactcctgggtgctcttgacgcgtcccatccctgttgctggagggccccacgcccagtaccgttccctttggtggggccccattccctggaaggggggg

SEQ ID NO: 3274 - DNA, 261 bp, Zea mays
  misc_feature: Ceres CLONE 284623-F
  misc_feature: Encodes the peptide sequence at SEQ ID NO. 3275
  misc_feature (105)..(105): n is a, c, t, g, unknown, or other
  misc_feature (165)..(165): n is a, c, t, g, unknown, or other
  misc_feature (220)..(220): n is a, c, t, g, unknown, or other
awagataaaatcgagaggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagckcgcggcggcsnaatgcccaacgccaagaactcccaggacgggctcaccccggagcagcgccgcganagggacaagaaagctctggaggagaaggcggccaagaaggc

SEQ ID NO: 3275 - protein, 31 aa, Zea mays
  misc_feature: Ceres CLONE 284623-F
  misc_feature (18)..(18): Xaa is any aa, unknown, or other
MPNAKNSQDGLTPEQRRXRDKKALEEKAAKK

SEQ ID NO: 3276 - DNA, 265 bp, Zea mays
  misc_feature: Ceres CLONE 284638-F
  misc_feature: Encodes the peptide sequence at SEQ ID NO. 3277
  misc_feature (175)..(175): n is a, c, t, g, unknown, or other
  misc_feature (177)..(177): n is a, c, t, g, unknown, or other
gaaacaaagaaagaaaaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcggcssnanagcccaacgccaagaactcccaggacgggctcaccccggagcagcgccgcgagagggacaagaaagctctggaggagaaggcggccaa

SEQ ID NO: 3277 - protein, 46 aa, Zea mays
  misc_feature: Ceres CLONE 284638-F
  misc_feature (1)..(46): Pfam Name: 4F5 Pfam Description: 4F5 protein family
  misc_feature (17)..(17): Xaa is any aa, unknown, or other
  misc_feature (18)..(18): Xaa is any aa, unknown, or other
MTRGNQRDRDRERAAAXXPNAKNSQDGLTPEQRRERDKKALEEKAA

SEQ ID NO: 3278 - DNA, 147 bp, Zea mays
  misc_feature: Ceres CLONE 284647-F
agtaatcagagtccaggcggcasacagcagcttcctttcctccggcgatggcgaagaatcccaaagatgccgctccggagaagatgcccgcygcggccgaggaacaggcagcgctcygcgacggtgaaggtgctcttcttcgcccgc

SEQ ID NO: 3279 - DNA, 305 bp, Zea mays
  misc_feature: Ceres CLONE 284675-F
  misc_feature: Encodes the peptide sequence at SEQ ID NO. 3280
  misc_feature (234)..(234): n is a, c, t, g, unknown, or other
acagctgaaasagccaaaacgcagaagctgcactgcatacatcgagctaactatctgcagcgatgtctcgctcctgctgcgtcgccgtgtcggtgcttctcgctgtcgccgcgacacgcagcgccaccgcscggcatggctgcacgaggaggccatggccacgggccgctggtcgcagagggtgcaagggtggcgccctccgcttccacctgggctgccgacaaggcgtcgcgncgaggccgagcggcggcatggccacgcagggcgacgaccagagctcgtcgggcggcagtggcagcagcggt

SEQ ID NO: 3280 - protein, 56 aa, Zea mays
  misc_feature: Ceres CLONE 284675-F
MAARGGHGHGPLVAEGARVAPSASTWAADKASRRGRAAAWPRRATTRARRAAVAAA

SEQ ID NO: 3281 - DNA, 1533 bp, Zea mays
  misc_feature: Ceres CLONE 284686
  misc_feature: Encodes the peptide sequence at SEQ ID NO. 3282
agtggaatctctctgttcttagttctgttctacttctccaccaagtccctaacacgcgggtggcgggtccgccgccgccgccgttcgaagactcgaggctcgagcacctcttctgctcgcccggcccctcctatccctcgcgcgactgtctccgccgacgaccataagccgcctgcctcatcgctggccacacaacgatccgtggcaaggaaagcacgaggacgtacagtagaattgtgaatcgccggaaaaacatctgttggcggcgtcatgaataagcggccccrcgacgaccactccttcgcctccgcgcccaagcgccagtatggcgmaggcggagggtatggcccgcagcagggttactcggaagagcggagcagcgcgcggcgggtggccgaccactacagcgcgcggtccaaccagacactcgaggaacgcgagaacagccccatcatccacctcaagaagctcaacaactggatcaagagtgttttggtccagttgtatgcacgcccgggtgactgcgttcttgatcttgcttgcgggaagggaggtgatttgataaagtgggataaagccaaggttggctactatgtaggggttgatattgctgaaggctcgataaaagattgcatgactcgctacaatggtgacacagatcaacaaagaaggaaaaggttcagtttccctgcacggcttatttgtactgattgctatgaggctcgtttggatgaatatttatatgaggatgctccgtttgatatatgtagctgtcagtttgctttacactattcatggtcaactgaagcacgcgctagacaagccttggcaaatgtgtctgcattacttcgtcctggaggcatttttattgggacaatgcctgatgccaatgtcattatcaaaaggcttcgagaatctgaagggttggaatttgggaacagtgtttactgcattagctttggcaatgagtacgctgaaaagaaattccctgcatccagaccgtttggtatcaagtacaagtttcacttagaggatgctgttgattgcccagaatgggttgttccattccatctcttcaaattattggcagaggagtatgatctcgagctggttctgatgaagaacttccatgaatttgtacacgagtacttgcaaaaaccagagttcgccgagctgatgcggaggctgggtgccctcggtgatggaaggcaggaccaaagtacactgtcacaagatgagtgggaggtttcctatctctatctcgcgtttgtcctgcggaagcgaggccaaccgcctacccaacgaagagccagcaacgcaaacagagggaaaatgtttctcaccgagggtgacatcgaggttctcggtgtataagcatgagtatatcctggaagggcttgctaacagcttaccgattatatgctccacagaccacatagcataaaagaaagttgtaacattagtggctcacctgctactccatccgtttataaataaatgacaacgttgacttttttaaaaaaaaaaaaaaaa

SEQ ID NO: 3282 - protein, 367 aa, Zea mays
  misc_feature: Ceres CLONE 284686
  misc_feature (28)..(339): Pfam Name: Pox_MCEL Pfam Description: mRNA capping enzyme
  misc_feature: SWISSPROT Homolog: EC 2.1.1.56 mRNA (guanine-N(7)-)-methyltransferase
  misc_feature (6)..(6): Xaa is any aa, unknown, or other
  misc_feature (21)..(21): Xaa is any aa, unknown, or other
MNKRPXDDHSFASAPKRQYGXGGGYGPQQGYSEERSSARRVADHYSARSNQTLEERENSPIIHLKKLNNWIKSVLVQLYARPGDCVLDLACGKGGDLIKWDKAKVGYYVGVDIAEGSIKDCMTRYNGDTDQQRRKRFSFPARLICTDCYEARLDEYLYEDAPFDICSCQFALHYSWSTEARARQALANVSALLRPGGIFIGTMPDANVIIKRLRESEGLEFGNSVYCISFGNEYAEKKFPASRPFGIKYKFHLEDAVDCPEWVVPFHLFKLLAEEYDLELVLMKNFHEFVHEYLQKPEFAELMRRLGALGDGRQDQSTLSQDEWEVSYLYLAFVLRKRGQPPTQRRASNANRGKMFLTEGDIEVLGV

SEQ ID NO: 3283 - DNA, 420 bp, Zea mays
  misc_feature: Ceres CLONE 284694-F
  misc_feature: Encodes the peptide sequence at SEQ ID NO. 3284
  misc_feature (282)..(282): n is a, c, t, g, unknown, or other
  misc_feature (283)..(283): n is a, c, t, g, unknown, or other
  misc_feature (285)..(285): n is a, c, t, g, unknown, or other
  misc_feature (350)..(350): n is a, c, t, g, unknown, or other
ttcctgttcccctcggcgacgcagtacggcagtacgccacgccagkcccagttgcattgactcctccccggtccccacatcttgccgccaatggatgtcgacgggcccgcccccgccgacgcctctgccaggcccgccaccaacggcgaggccccctccggcgcccgckaggtcgacgtcggcgaggaggacacgctcgccggcgtcctccgcagcttcgtcgacggcgtctggtacccggacgagcctctgctccggcggctccgggcggcgtcctgcganncncgcgcctgaggggggcgtcccggaactccgcgcgggacctgcttgagtggaccaggcgggggcancggcctccgcgccatcctcgtcatctcggtcgggacaatcacgcttatagcattgactggccttctgacc

SEQ ID NO: 3284 - protein, 67 aa, Zea mays
  misc_feature: Ceres CLONE 284694-F
  misc_feature (27)..(27): Xaa is any aa, unknown, or other
  misc_feature (64)..(64): Xaa is any aa, unknown, or other
  misc_feature (65)..(65): Xaa is any aa, unknown, or other
MDVDGPAPADASARPATNGEAPSGARXVDVGEEDTLAGVLRSFVDGVWYPDEPLLRRLRAASCXXRA

SEQ ID NO: 3285 - DNA, 507 bp, Zea mays
  misc_feature: Ceres CLONE 284709-F
  misc_feature: Translation starting site: 304
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctgtccgcagtgtcctctgct

SEQ ID NO: 3286 - DNA, 507 bp, Zea mays
  misc_feature: Ceres CLONE 284748-R
  misc_feature: Encodes the peptide sequence at SEQ ID NO. 3287
gcacccgacgcgccagcgccagcgccagcgggagcgcgaggggctccggytcgcggagccaccggagctgggcttgggcgctggcgagccccatgagggcgctcaggccgaccagctcctcgtccagcaagagcatcatggccgcgcccacagccgcgtgagtgaagggcagcggcagcatgcatgcagatgcgggcgtagcttcatggggttgatgctgccgctgcgtgagcgatcaatggccggtgaatcatcatccatccctcgaccatatatactagtactacataaatgtctccatctttattagtgttctcatgtccatgccttacgatttttaagcagaacctggtcctgtttatgttggaaatgttgctatggatctagctatagctactgcctttacatttgggattcctgtctccagtggccaagagaactgtggaacttgttaatctgtttaacccctggagtatttgtctgggcaattcaaaaaaaaaaaaaaaa

SEQ ID NO: 3287 - protein, 52 aa, Zea mays
  misc_feature: Ceres CLONE 284748-R
TRRASASASGSARGSGSRSHRSWAWALASPMRALRPTSSSSSKSIMAAPTAA

SEQ ID NO: 3288 - DNA, 410 bp, Zea mays
  misc_feature: Ceres CLONE 284764-F
  misc_feature: Encodes the peptide sequence at SEQ ID NO. 3289
aataattggtcgctccccgatccatctgggtttcgcctgccagcggsgagatgtccttcttcttccgggccgcatcgsaggcccgtttgccgcagagatcgcgcgctccatcaaggactccctcgttgccctcgacaccaagaccggcgccaaggctcttgaggatgctgagaaaaacatacttacattgaggcatacacttgctgggtgatgggagaagtggaaccaaatcaagagcaggttttgcagatagcccttgagatttcaaggagggtgttctttccctctttgttcaggaatcttccttcattgggttgggaggctagaaaggatcttgtccactgctggtgtatttttkttgagacagaaggttgatgaaagctattgtgcgtccagtatattgaaaatca

SEQ ID NO: 3289 - protein, 69 aa, Zea mays
  misc_feature: Ceres CLONE 284764-F
  misc_feature (16)..(16): Xaa is any aa, unknown, or other
  misc_feature (26)..(26): Xaa is any aa, unknown, or other
IIGRSPIHLGFACQRXDVLLLPGRIXGPFAAEIARSIKDSLVALDTKTGAKALEDAEKNILTLRHTLAG

SEQ ID NO: 3290 - DNA, 410 bp, Zea mays; identical to SEQ ID NO: 3288
  misc_feature: Ceres CLONE 284764-F2

SEQ ID NO: 3291 - DNA, 414 bp, Zea mays
  misc_feature: Ceres CLONE 284793-F
  misc_feature: Encodes the peptide sequence at SEQ ID NO. 3292
  misc_feature (33)..(33): n is a, c, t, g, unknown, or other
  misc_feature (89)..(89): n is a, c, t, g, unknown, or other
acagcgagtaccgagtaggagcaaccgcttgcncagacgcacactgacggagagtgatcactgatttctggtcatggcaaccgtaactnggaagttgctccggtcgtcaccgtctccgaggagccggcgccggaagckgcaaggaggtggtggagaagccggagaggggaagaatgcccgacgaggagggtgacgagaggaagaaggccgaccccgccgccgagaaggagaagaaggcgaggaagccgcggasaggaagcccaagtccgccgggctgcaccacccgccctatttcgagatgatcaaggaggcgatcctgtcgcaggacggcgggaaggtcggggcgagcccgtacgcgatcgccaagcacatgggggataagcaccgggacgtgctcccgcccaattaccgcaa

SEQ ID NO: 3292 - protein, 38 aa, Zea mays
  misc_feature: Ceres CLONE 284793-F
MIKEAILSQDGGKVGASPYAIAKHMGDKHRDVLPPNYR

SEQ ID NO: 3293 - DNA, 405 bp, Zea mays
  misc_feature: Ceres CLONE 284806-F
  misc_feature: Encodes the peptide sequence at SEQ ID NO. 3294
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcg

SEQ ID NO: 3294 - protein, 107 aa, Zea mays
  misc_feature: Ceres CLONE 284806-F
  misc_feature (10)..(107): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNA

SEQ ID NO: 3295 - DNA, 1225 bp, Zea mays
  misc_feature: Ceres CLONE 284827
  misc_feature: Encodes the peptide sequence at SEQ ID NO. 3296
gtagaccgcagccggcaccatctcttgccgcaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaaggcgcccaaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatctaaaaaaaaaaaaaaaa

SEQ ID NO: 3296 - protein, 273 aa, Zea mays
  misc_feature: Ceres CLONE 284827
  misc_feature (8)..(245): Pfam Name: 14-3-3 Pfam Description: 14-3-3 protein
  misc_feature: The sequence is a functional homolog of SEQ ID NO 1777 in the 11/479,226 US patent application
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREGAQSATRVRGSKAGFMCLETSS

SEQ ID NO: 3297 - DNA, 435 bp, Zea mays
  misc_feature: Ceres CLONE 284856-F
  misc_feature: Encodes the peptide sequence at SEQ ID NO. 3298
aggaaagctgaaccatggcgagagtagaagcggtggtcatctgcctcctggtcctcgccatggacgtcgccgccggstgctcggtgtctacgcggagaaggctcagaaccagggcaggcacctgcggatcctgttcgtcgagtgccggcagccggtccggcggcctacgagctcggcatggcggcggccgcggtgctggcggcggcgcacgcatcgccgaacgcgtccggcggatgcgcgtgcgcctgctccggcgacaagctccgccgggcgtcgccaaccggcagatggcgtccttcgccttggtcctcacatggatggtcctcgtcgtcgcgctctcgctgctggtgctcggcgcgctgcccaacgcgavcaagctggccggagtgcggggtggcgcggcaccggttcctctctatcggcggcgtcctctgc

SEQ ID NO: 3298 - protein, 140 aa, Zea mays
  misc_feature: Ceres CLONE 284856-F
  misc_feature (120)..(120): Xaa is any aa, unknown, or other
MARVEAVVICLLVLAMDVAAGCSVSTRRRLRTRAGTCGSCSSSAGSRSGGLRARHGGGRGAGGGARIAERVRRMRVRLLRRQAPPGVANRQMASFALVLTWMVLVVALSLLVLGALPNAXKLAGVRGGAAPVPLYRRRPL

SEQ ID NO: 3299 - DNA, 644 bp, Zea mays
  misc_feature: Ceres CLONE 284859-R
ccaattgggtaccgggccccccctcgaggtcgacggtatcgataagcttttttttttttttttttctttttttttttttttttttttttttttttttttttttttttttttttttttatttaaaacggtaggcgaccacatttagtggattgggcattttgtatacttacgggacctctccaaaaatcaaaataagctacaacaggaacaagtagagatgaacaaatggaacaataaataagctaccctatgcctctgctcagcaatctgagtctggctgaatgacttgacttttaggccgaagggaaaaagcggatgaggttgaatggcaagcggtaaaactccacgttcccgatgacccccttgaacgtccggaaccgctgccaccccgggatcccccgggccatgccgacttgcttcacctccagcgggttgtccagcaacacggccaccatcagccccacggccggggggaacgaaaaaaaggagttgatgtaatcgttgaaccatccagctttcgggtgcccaggaccacggagagcagccctggcgtagcggaaaaagaattccgggccgaacaggccaaggaaaatggaaaccccgacaataaagaggttgcgcatggagttcaagttaaggaactg

SEQ ID NO: 3300 - DNA, 498 bp, Zea mays
  misc_feature: Ceres CLONE 284865-F
  misc_feature: Encodes the peptide sequence at SEQ ID NO. 3301
  misc_feature (25)..(25): n is a, c, t, g, unknown, or other
accgagaaaccctagttcgaacgcnccgccatcaccgtcgtctctcgctcgttccctcgcgctctccgctcgtkagtactcccacggatcggagcgagagtaggggcgtgtcggcggtgaaagckaccgcgtcascatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacatacccttggkagggaactgatcgggattataaatatgaagagctgct

SEQ ID NO: 3301 - protein, 120 aa, Zea mays
  misc_feature: Ceres CLONE 284865-F
  misc_feature (109)..(109): Xaa is any aa, unknown, or other
MADEEHSERREEASELAPFDPTKKKKKKKVVIQEPSDEVDKLAEKTETLAVAEPAELNFTGMKKKKKKPVDLDSTLDELGDGEDTQDDQAVEEQGEGIVLGSVPTYPWXGTDRDYKYEEL

SEQ ID NO: 3302 - DNA, 480 bp, Zea mays
  misc_feature: Ceres CLONE 284904-F
  misc_feature: Encodes the peptide sequence at SEQ ID NO. 3303
  misc_feature (177)..(177): n is a, c, t, g, unknown, or other
  misc_feature (179)..(179): n is a, c, t, g, unknown, or other
  misc_feature (270)..(270): n is a, c, t, g, unknown, or other
atccagtcgcatctccctctccgaaatcaaggtagcgtacaccgctgcattttctagagccctctctgccactcgtgatcccactagtcacaatgcctgcyctcgccaagcccccctcccgcaccgccaagcccgccgcggctccgaagccgaagcctgccgccgccaagccgavgncncaccgctggtgcctcccacccgccttacttcgagatgatcaaggaggctatcacggcgctcaaggagaggaccggctccagctcgcaagcnatcgccaagtatgtgggggacaagcacggcgcttctctgccggccaacttcaagaagatgctttccatccagctccgtgtgtccgcagccaagggcaagctcgtgaacgtcaaggcttcgtacaagctctcggacgccgccaagaaggcatcccccaagaccaaggctaagcgscaaaggccgccgctgccaagaccaccgcccccaagc

SEQ ID NO: 3303 - protein, 89 aa, Zea mays
  misc_feature: Ceres CLONE 284904-F
  misc_feature (1)..(64): Pfam Name: Linker_histone Pfam Description: linker histone H1 and H5 family
MIKEAITALKERTGSSSQAIAKYVGDKHGASLPANFKKMLSIQLRVSAAKGKLVNVKASYKLSDAAKKASPKTKAKRQRPPLPRPPPPS

SEQ ID NO: 3304 - DNA, 517 bp, Zea mays
  misc_feature: Ceres CLONE 284923-F
  misc_feature: Encodes the peptide sequence at SEQ ID NO. 3305
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
aacctctagctgattgatctctggtttaccactctttccttccctccttcaattgctaaataccacaaatcaaagttgctttgcgatggtgakyagcagcatggacacgacgagtgacaaacgtgcgtcatccatgctggctcctaaccctggcaaggccacgatcctcgcccttggccacgccttcccgcagcannntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcgcgcgctctcgtccatcacccacctcgtgtacgtctcgtcgagcgagggcgcgcttcc

SEQ ID NO: 3305 - protein, 144 aa, Zea mays
  misc_feature: Ceres CLONE 284923-F
  misc_feature (10)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (3)..(3): Xaa is any aa, unknown, or other
  misc_feature (37)..(37): Xaa is any aa, unknown, or other
  misc_feature (38)..(38): Xaa is any aa, unknown, or other
MVXSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLDISNAAVTRWRRRRPCRASARGARALVHHPPRVRLVERGRAS

SEQ ID NO: 3306 - DNA, 448 bp, Zea mays
  misc_feature: Ceres CLONE 284937-F
  misc_feature: Encodes the peptide sequence at SEQ ID NO. 3307
  misc_feature (242)..(242): n is a, c, t, g, unknown, or other
aggagaggggagccgagcggcaaaggggagcgcggcgacagacatggcggasagcacaaggaggagtcgggcgtgacagtgctggacaagatctccgacaagctccacgggcgcgggggcggctcgtcttcgtcgccgactcggacgacgagcgctcgtcggcgacgccgccgtgaaggccaagatctaccgcatcttcgggcgcgagaagcccgtgcactccgtcctcggcggcggcaagngcccgattctgtttctatggaggaacaagaggatctctggtggggtgctcgcaggcgcaactgccttctggctgctgtttgaggtcatggattaccacctcctcaccctgctatgccactgcctcatcctcaccctggccatcctgttcctctggtccaattcyacgactttcatcaacaagttctcctcctaacatccccgaggt

SEQ ID NO: 3307 - protein, 35 aa, Zea mays
  misc_feature: Ceres CLONE 284937-F
MDYHLLTLLCHCLILTLAILFLWSNSTTFINKFSS

SEQ ID NO: 3308 - DNA, 115 bp, Zea mays
  misc_feature: Ceres CLONE 284942-F
ccggttcagttcagtgghgccgtcgtgcctcgacgacgsggagacgccgcaagcaggtgagagtgagacgggcggtgactagcgggcgcttaggccgacatcggcccgcagcggc

SEQ ID NO: 3309 - DNA, 423 bp, Zea mays
  misc_feature: Ceres CLONE 284965-F
  misc_feature: Encodes the peptide sequence at SEQ ID NO. 3310
acctgtggcagcggccgcgctsttgcytcgccttgctctcggttcgtggggcatggcggcttccttgtgctccggggctcatctccggccccaccctccctcccctgcccgttgccttccgctgctactgggcccaaaagccctcctccgcgtcgacctcctccaggcgcccgtgccgcmggttacgttcccgttgcagctgcctccacccgcacctcctctgcggctgctcgggggcctcgacgccgacgacttccgccacccgctcgacaagcagaacactcttctgctgagagcaattccagggctcaacgacgtggggcaaagctttcctaggacccgtctcggagcaagttatggtactccagaacattggaacatcagttctcgtctccccgaaccagcttccagatctccaccaac

SEQ ID NO: 3310 - protein, 123 aa, Zea mays
  misc_feature: Ceres CLONE 284965-F
  misc_feature (43)..(43): Xaa is any aa, unknown, or other
MAASLCSGAHLRPHPPSPARCLPLLLGPKALLRVDLLQAPVPXVTFPLQLPPPAPPLRLLGGLDADDFRHPLDKQNTLLLRAIPGLNDVGQSFPRTRLGASYGTPEHWNISSRLPEPASRSPP

SEQ ID NO: 3311 - DNA, 476 bp, Zea mays
  misc_feature: Ceres CLONE 284990-F
  misc_feature: Encodes the peptide sequence at SEQ ID NO. 3312
atcacaacaaaaggcgcaabaccgcacggagagcaagcwagawaagcaaccaccgcactaccactacctaacaatggcccgcgcctacgtgtttctcgtcgtgctcctcctggccgctgtcatcgtggcaccgttcacggagcgacgckgtcgacgtcgttgagggcaggtccatggcgtccgcgacsgccggascgccgcaccatcacccgggcctgaytccgcctcgtcaccggactcctcgtcggatgcgccctccagcagcagctcgtcggactagatagctagccgctcgacgcacgatctcgctctccatctacacggcgatcgagttctagctttgtcggcatgcaatcaaaattccgattcttcgggaataatcaagcaccaaaggaatgtgcttgccttcactcactactagtaccttgtttttatatatggtttcctctcctgacgctctccgattttaatcttca

SEQ ID NO: 3312 - protein, 29 aa, Zea mays
  misc_feature: Ceres CLONE 284990-F
  misc_feature (26)..(26): Xaa is any aa, unknown, or other
MARAYVFLVVLLLAAVIVAPFTERRXRRR

SEQ ID NO: 3313 - DNA, 1422 bp, Zea mays
  misc_feature: Ceres CLONE 285003
  misc_feature: Encodes the peptide sequence at SEQ ID NO. 3314
aggcttggttccccgtgaccttgccagccgcgctagatacacactcttcatcacccggagtcccggacggacgcacacgcatcgcttgcttgtcgttctccactcctcttcccccgctgctcgcctctcgattccgcctcatcgcgtccgcgaactccatgtccactgcgaccgcgaccctggccgccgcgcgatccccggctgtcgcgcttctcagcctgcgccgccgcgcacccgcggctgcccccattcgcttccccggtctccgcgtcgtctctggttgccgtcacatagctatggcttccgcggcgcactcccgcgcccccaccgacccgcttcccaagggtgctgatttatttttccgggcagtaatctcgaacatggaaaaggtttatttgagcaggaatcctacagccaaaaccattctggagcttgtacgatcttatgatggtgatcacatttgctatgatcactttgctttccggacatttggggtcaatggttatggtataaactcactttctgattttttcactgattttggttatttacctcgcgaagaactcagatttccagctaaaaagcttagggcactatggttttccccgcccactaatgatggctactctggaactggtacatatggacctttgccaaggatattcatttcagaacttcttgtggatgagttgactactcaaagccaggaaattatacataaatacattaaaacttctggcaatggaaataatcatgctgctattgcaagtacatctggggagctaacatgggagaagcccatttattcagatttccagattttgtctagggaaagtgaatatgctgcatggactcttgttaatggctatgcactaaatcatgccacaattgccacccatcgcctagaatcagatatcagaagtattaataagttcaacaaatttgtggaggacaatggcttcaagttaaattcagaaggagggattctgaaagtgagtcctgatggtctccttcaacaaagttcaacagtagctgactcatcattgtttacgtttgctgatggaataactgaatctattcctcgatcatacattgaatttgctgaacgtctcctgttaccacagttcaaagatttacaagatgaagaggtgaaagaataccacaggcgtgatggttttgaggtgggcaatgcggacaagatattcgaaagtacatcgaaggatcagctgacgcggagatctgcatgaacagtgaactctagatctgcatatgaccccgtgaactctctagatctgcaaacaacccagtgtgcctcttggaagtgtgttggtgactgtgaaatgattgtacctacttgggtgaaataaagcatgggagtcaataaaaagtaactgtttctttattccaaaaaaaaaaaaaaaa

SEQ ID NO: 3314 - protein, 362 aa, Zea mays
  misc_feature: Ceres CLONE 285003
MSTATATLAAARSPAVALLSLRRRAPAAAPIRFPGLRVVSGCRHIAMASAAHSRAPTDPLPKGADLFFRAVISNMEKVYLSRNPTAKTILELVRSYDGDHICYDHFAFRTFGVNGYGINSLSDFFTDFGYLPREELRFPAKKLRALWFSPPTNDGYSGTGTYGPLPRIFISELLVDELTTQSQEIIHKYIKTSGNGNNHAAIASTSGELTWEKPIYSDFQILSRESEYAAWTLVNGYALNHATIATHRLESDIRSINKFNKFVEDNGFKLNSEGGILKVSPDGLLQQSSTVADSSLFTFADGITESIPRSYIEFAERLLLPQFKDLQDEEVKEYHRRDGFEVGNADKIFESTSKDQLTRRSA

SEQ ID NO: 3315 - DNA, 430 bp, Zea mays
  misc_feature: Ceres CLONE 285006-F
  misc_feature: Encodes the peptide sequence at SEQ ID NO. 3316
  misc_feature (132)..(132): n is a, c, t, g, unknown, or other
  misc_feature (135)..(135): n is a, c, t, g, unknown, or other
acatagtactagaaaaatggccatggcagccgccaccgcgaatgccatcttgctcttggctctcttcttcgccggcgctcacgcgaatgtcccatgcatactccccgtatgcaagacggtgggtggcggganggnttcttcgacgtgcagttctgcctggcggcactcggctccgatggccggagcgtcgaccactgcctcgactaccaggtctactccgccattgccgctgacctcctcgcggccaacctcaccgctacggcgccaagatcaacggcctgctccggaagagcggcggctccgcacatggccacgacgcgctgtctccggtcctgtcaagcgttgtacggcgacatggaacggaggcagactggctgcgcggctgccgtccggggcgtcaggaagggttaggcaccaggtgcttggagga

SEQ ID NO: 3316 - protein, 100 aa, Zea mays
  misc_feature: Ceres CLONE 285006-F
  misc_feature (8)..(8): Xaa is any aa, unknown, or other
MQDGGWRXGFFDVQFCLAALGSDGRSVDHCLDYQVYSAIAADLLAANLTATAPRSTACSGRAAAPHMATTRCLRSCQALYGDMERRQTGCAAAVRGVRKG

SEQ ID NO: 3317 - DNA, 441 bp, Zea mays
  misc_feature: Ceres CLONE 285010-F
  misc_feature: Encodes the peptide sequence at SEQ ID NO. 3318
  misc_feature (320)..(320): n is a, c, t, g, unknown, or other
aaaaacccccctctttgtgctgtttcttctcgccgccgccgccgccgtcgttgccgctagccggcgtacgtgattaggaaacctgaccacctgagccttctgtagaccagcctcagcgcaactcccaaccacttctcttatggcgctcctccttcgccgaggcgtggccctcgccgcccgctccttccgcgccggccgcctcctccgcttccaccactgtgcaccgcctcccagccggggcgtcccttgcgggcgccggggaattggctccggcgcacstcttcttcttcgagaaccgaagaggcttcgcgaaggggaanaaatcgaaggatgatcggaggtgacactgttcaagctgttcctgacattgggccaactggtcaaatcagctgccaccgcacaaattggacgctgcagtgatcgcactgtcacgagagctga

SEQ ID NO: 3318 - protein, 29 aa, Zea mays
  misc_feature: Ceres CLONE 285010-F
MIGGDTVQAVPDIGPTGQISCHRTNWTLQ

SEQ ID NO: 3319 - DNA, 1968 bp, Zea mays
  misc_feature: Ceres CLONE 285037
  misc_feature: Encodes the peptide sequence at SEQ ID NO. 3320
gtgggtggcggtctggcggaggacaggaagaaaaaacaaggcgaaaaaggaggttcggggcgggttccatggcgctgccttcctagcccagccgcctcaccaacctccctcctcaccgaggagagaccgaggcgccaacagagaacaggacactgcgagaagaggaggttcatttccgcgtcgtctccgcccgcagccccacccaccacatggcagccatgccgggtggggcccacgccgccggcgccgcggaccagatgcaggtggaccagccgctccccgctgcggccgcacacggccccgccgtcgccaagcatgctggttctatgattgaagggagtgatccagtcacgggtcatataatctcaacaaccattggagggaagaatggagagcctaaaaagactatcagctacatggcagagagagttgtgggaactggatcattcggaatcgtcttccaggcaaaatgtctggagactggtgagactgttgctatcaagaaggttttgcaggacaagcgctacaagaacagggagctgcaaatcatgcgatccatggatcactgcaatgctgtttccttgaagcattgtttcttctccaccacaagcagagatgaactttttcttaacttagtgatggagtttgttcctgagtcactatatcgtgtgctgaagcactacagcaatatgaaccagaggatgccgcttatttatgttaaattatatacctaccagatatttcgaggtttagcctatattcacacagtacctggtgtttgtcacagggatgtgaaaccacagaatcttttggttgatccattgactcaccaagtgaagatatgtgattttgggagtgccaaaatgttggtcaaaggtgaagcaaacatttcatatatatgctcacgttattaccgtgctccagagctcatatttggggcaaccgagtacacaacatcaattgatatttggtcagctggatgtgttcttgctgagctgcttcttggccagcctctcttccctggcgaaagtgctgtggatcaacttgttgagataataaaggttcttggtactccaacacgtgaggaaatccgttgtatgaatccaaactacaccgagtttagatttcctcagatcaaagctcacccatggcacaagattttccacaagcggatgcctccagaagctatagatctcgcttcacgtttgctccagtactcaccaaatctaagatgcactgctcttgaagcgtgtgcacatccattctttgatgagttgcgagagccacatgcgaggttgccaaatggacggccatttcctccactgttcaactttaaacaggaactagcaaatgcctccccggagctcatcaacaggctgatcccagaccatgctaggcggcatcttgggctcactttattgcccaccactggaccataggcgaaggctctatggtgttytaaacctttgctctttctgattcttcgttgttgccataggcaattcaaggtgtagaatctgaccattattggaaagccaaacacgagctggcgccaatgtgttgcataaggagaggcggtatgttcgtgcagccagccttttgtcgcctgttttaatgcaaaatctgattttacttaagcagtgtgaggggaagtgggttggtgtattgttaagctattgaaggaattcaatccctggtattgtattactttctccaacgttaaatgttgtagttcgcctgtaagtgttccacatcgcctgttgttcagtccgcaatccttcctgtaaatgttattaatgaaaaaaaaacatcttgctatgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 3320 - protein, 409 aa, Zea mays
  misc_feature: Ceres CLONE 285037
  misc_feature (69)..(353): Pfam Name: Pkinase Pfam Description: Protein kinase domain
  misc_feature: SWISSPROT Homolog: EC 2.7.11.1 Non-specific serine/threonine protein kinase
MAAMPGGAHAAGAADQMQVDQPLPAAAAHGPAVAKHAGSMIEGSDPVTGHIISTTIGGKNGEPKKTISYMAERVVGTGSFGIVFQAKCLETGETVAIKKVLQDKRYKNRELQIMRSMDHCNAVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTTGP

SEQ ID NO: 3321 - DNA, 198 bp, Zea mays
  misc_feature: Ceres CLONE 285049-F
  misc_feature: Encodes the peptide sequence at SEQ ID NO. 3322
  misc_feature (139)..(139): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcgcaaggycggcgggcgancgaagaagtcggtgtcgcggtcctccagggccgggctgcagttccccgtcagccgcgtc

SEQ ID NO: 3322 - protein, 66 aa, Zea mays
  misc_feature: Ceres CLONE 285049-F
  misc_feature (43)..(43): Xaa is any aa, unknown, or other
  misc_feature (47)..(47): Xaa is any aa, unknown, or other
THTFRLSTPKVPFFFSIWKRRSSSHGRERTGGKAKKGAAGRKXGGRXKKSVSRSSRAGLQFPVSRV

SEQ ID NO: 3323 - DNA, 282 bp, Zea mays
  misc_feature: Ceres CLONE 285056-F
  misc_feature: Encodes the peptide sequence at SEQ ID NO. 3324
gatctgagatcgacatcgatccaccgaggtttcttgtgcgtgccgccatggccatggcagtagctcaccttcttcctcagctctccgccgamratttggagctagcaggaacagaatggccattctcttgattcttcagctttttctcttgacggcgctatgstggatggagcggcgtcgttcatcttcaccaacgcctgcaagcacgcggtgtgggtgggcgcgctccacggcgccactcgccgccgctcgcgcgtccgggcttctacctggcgccgtccg

SEQ ID NO: 3324 - protein, 41 aa, Zea mays
  misc_feature: Ceres CLONE 285056-F
  misc_feature (2)..(2): Xaa is any aa, unknown, or other
MXDGAASFIFTNACKHAVWVGALHGATRRRSRVRASTWRRP

SEQ ID NO: 3325 - DNA, 459 bp, Zea mays
  misc_feature: Ceres CLONE 285059-F
  misc_feature: Translation starting site: 57
attactgtgcctttatcttcaacccaaaccatccattaccacattcctaagctatcatggtgcaccggacttccatagccgatgtgcatgtkatgtgcatggatctaagcccaaagaaacccaacaaggccagcgccabdcgggcggastactacgactggtcccccgccgatctgcccatgctcggcgttgctccattggtgccgccaagctctgcctcaccgccggagtcttgccctacccagctactccgactctgccaagatcgcctacgtcctccaaggcaaaggtatattcggcgtggttctcccggagcgaccaaggagaaggtcatctccgtcaaggaaggcgacgcgctggcgctccccttcggcgtcgtcaccttggcacaacaacgccgacgccgctatctccgacctcgtggtgctcttcctcggcgacacctccacgggccacaag

SEQ ID NO: 3326 - DNA, 100 bp, Zea mays
  misc_feature: Ceres CLONE 285102-F
acgcacaccgcgacccagtccagagccagtacgtgcgamgcaacgcacgctgctggtccgcgtacsagacgacggtcaggtcggccggtgcttttcagtt

SEQ ID NO: 3327 - DNA, 502 bp, Zea mays
  misc_feature: Ceres CLONE 285106-F
  misc_feature: Encodes the peptide sequence at SEQ ID NO. 3328
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggwtgagatcctcaagaactacccggagctggcgcaggaggggctgccgacgatgaatcagcgtctggacatctcgaacgcggcggtgacsaratkgcgacggaggcgtccctgtcgtgcgtccgctcgtggggcggcgcgctctcgtccatcacccacctcgtgtacgtctcgtcgag

SEQ ID NO: 3328 - protein, 139 aa, Zea mays
  misc_feature: Ceres CLONE 285106-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (81)..(81): Xaa is any aa, unknown, or other
  misc_feature (111)..(111): Xaa is any aa, unknown, or other
  misc_feature (112)..(112): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSXEILKNYPELAQEGLPTMNQRLDISNAAVTXXRRRRPCRASARGAARSRPSPTSCTSRR

SEQ ID NO: 3329 - DNA, 462 bp, Zea mays
  misc_feature: Ceres CLONE 285144-F
  misc_feature (439)..(439): n is a, c, t, g, unknown, or other
cttcgcaaaccctcctaccccattccgccgcccgccgcccgccgcccgccccgcgaccccgaggaggaggcaagatgaagacgatcctggcgtcggagvatggacatcccggagcgtcacggtgacggtggcggccaagctggtgacggtggagggcccccgcggtaagctcacccggaacttcaagcacctcaacctcgacttccagctgcaggagggcggccgcaagctcaaggtggatgcatggttcggcacccgccgcaccatggccgccatccgcaccgccatctcccacgtccagaacctcatcaaggggggtcaccaagggctaccgctacaagatgaggttcgtctacgcccatttccccatcaacgcgtccatcaccaactccaacaccgccatccagataaggaacttcctcggcgataagaaggtcanaaaggtgacatgcttgacggcgt

SEQ ID NO: 3330 - DNA, 416 bp, Zea mays
  misc_feature: Ceres CLONE 285211-F
  misc_feature: Encodes the peptide sequence at SEQ ID NO. 3331
  misc_feature (35)..(35): n is a, c, t, g, unknown, or other
gccagcgtttcaacagtaatctctctgtgcctgcnacgacgactaggtgggttaccgccgtcgcgccgccgccgccgccgccgtcatactacaggtgcgaggccttcatcggtatcttaacaggcgacgaacaccaaccagtctgcactctacgatggcggcgctccggccacggctcccgcggcctcccggtgtctctccggtgccaagtcgtgctgggctgctgagcggastccagctcgttttgccgtctcgsgccttctactgacctccggcaaagtaggagccgcatcctcagcgtccgtrccaaggttgccactggcgtgcagagagccagcactgtggatgatggagcaaaaaggccgtggaagctcagtgatgctcgtcttgtcctggaagatggttcagtgtggagg

SEQ ID NO: 3331 - protein, 37 aa, Zea mays
  misc_feature: Ceres CLONE 285211-F
  misc_feature (27)..(27): Xaa is any aa, unknown, or other
MAALRPRLPRPPGVSPVPSRAGLLSGXQLVLPSRAFY

SEQ ID NO: 3332 - DNA, 353 bp, Zea mays
  misc_feature: Ceres CLONE 285218-F2
  misc_feature (317)..(317): n is a, c, t, g, unknown, or other
actaccaccagtaccacaccactccgcgctastgaggacggtacagcggcacagaggtgcgacgtacgacgacgacgacgcaggsgccacacatggcatcccagctctccgccgccgtgccccggttccacgccctccggggctacgcgcgcccaggtccgcggtggtagcgctgccgtccgtgagggtgggcaggaagaggtcgtcgtcgcagggcatccgctgcgactacatcggctccgcaccaacctgatcatggtgacgacgacgacgctgatgctgttcgcggggcggttcgggctggcgccgtcggcaanccgcaagcgacggcggggctgaagctggaggcgcgc

SEQ ID NO: 3333 - DNA, 353 bp, Zea mays; identical to SEQ ID NO: 3332
  misc_feature: Ceres CLONE 285218-F
  misc_feature: Encodes the peptide sequence at SEQ ID NO. 3334
  misc_feature (317)..(317): n is a, c, t, g, unknown, or other

SEQ ID NO: 3334 - protein, 83 aa, Zea mays
  misc_feature: Ceres CLONE 285218-F
  misc_feature (11)..(11): Xaa is any aa, unknown, or other
LPPVPHHSALXRTVQRHRGATYDDDDAGATHGIPALRRRAPVPRPPGLRAPRSAVVALPSVRVGRKRSSSQGIRCDYIGSAPT

SEQ ID NO: 3335 - DNA, 412 bp, Zea mays
  misc_feature: Ceres CLONE 285227-F
  misc_feature: Encodes the peptide sequence at SEQ ID NO. 3336
  misc_feature (210)..(210): n is a, c, t, g, unknown, or other
  misc_feature (215)..(215): n is a, c, t, g, unknown, or other
  misc_feature (301)..(301): n is a, c, t, g, unknown, or other
  misc_feature (359)..(359): n is a, c, t, g, unknown, or other
  misc_feature (391)..(391): n is a, c, t, g, unknown, or other
agggattcctaccgagggaggccgcacgcagccatggatttcctgcaggagcaaagckccgagaccacagtggccgtcgcgtcgctgtcgccgccgtcgccgcrgscctttccctcctccttcgatccaggaagcccaagggctgcttggatcctgagaacttcaggaakttcaaactkgttgaaaagaascaaataagtcataatgttnccagnttcaatttcgctcttccaactccaacttctgtattgggccttccawtcggtcaacatatcagctscagatgacaagacgctacagntaaagaaktaatcaagccttatacccctactacatkggattctgatctgggatatttngagcttgtcataaagatgtatccccaaggganaatttcccatcatttccgcga

SEQ ID NO: 3336 - protein, 94 aa, Zea mays
  misc_feature: Ceres CLONE 285227-F
  misc_feature: SWISSPROT Homolog: EC 1.6.2.2 Cytochrome-b5 reductase
  misc_feature (19)..(19): Xaa is any aa, unknown, or other
  misc_feature (35)..(35): Xaa is any aa, unknown, or other
  misc_feature (56)..(56): Xaa is any aa, unknown, or other
  misc_feature (63)..(63): Xaa is any aa, unknown, or other
  misc_feature (70)..(70): Xaa is any aa, unknown, or other
  misc_feature (71)..(71): Xaa is any aa, unknown, or other
  misc_feature (87)..(87): Xaa is any aa, unknown, or other
  misc_feature (93)..(93): Xaa is any aa, unknown, or other
GFLPREAARSHGFPAGAKXRDHSGRRVAVAAVAAXLSLLLRSRKPKGCLDPENFRXFKLVEKXQISHNVXXFNFALPTPTSVLGLPXGQHISXR

SEQ ID NO: 3337 - DNA, 341 bp, Zea mays
  misc_feature: Ceres CLONE 285240-F
  misc_feature: Translation starting site: 54
  misc_feature (241)..(241): n is a, c, t, g, unknown, or other
acactatagaccacagccagtcagccacatcactagctacctgtgcagaggcaatggcgtccaaggttgagctggtggtggaggtcaagtccccggctgacaactgtgggcggcgctgcgtgactcgacggagctgttccccaagatcttccccgagcagtacaagagcatcgagaccgtcgagggcgacgcaagtbgccggcaccgtccgcctcctcaagtacaccgaggcggtgccgantgctgacgttcgccaaggagaagcttgagacggcggacgacgagaacaaggtggtgtcgtacagcggtggtggacggcgagctggcggacttctacaaga

SEQ ID NO: 3338 - DNA, 205 bp, Zea mays
  misc_feature: Ceres CLONE 285256-F
atcttctctttctccgtcccctccccaacacgcgttccccaaattctcccaccctactagaaatccccatatccgcggcggcgcsgccttcggattcgatcctcctagcgagtcgactccatctgatcggcggaggtcaccagccaccatgtggcggcatcgtgcctggcgtcgtgctgcgcggcgtgcscttgcgaggcgtgcc

SEQ ID NO: 3339 - DNA, 485 bp, Zea mays
  misc_feature: Ceres CLONE 285270-F
  misc_feature: Encodes the peptide sequence at SEQ ID NO. 3340
ctcatttttbtctctcctgcgccgcgacgtccctcgccttcgccgccgaatccgagactccgatctcgggttcaccgcagcgcacagagcagccccgactcccggcccgatccgcgctctcctctccgtcgcttcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcagcagagaggaattgttcccttctgcaagggtcttgatgtcattcagcaagcacaatctggtacaggaaagacagcaactttctgttctgggatcttgcagcagctggactatggcctggttgaatgccaggccctggtccttgctcccaccc

SEQ ID NO: 3340 - protein, 115 aa, Zea mays
  misc_feature: Ceres CLONE 285270-F
MAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPT

SEQ ID NO: 3341 - DNA, 213 bp, Zea mays
  misc_feature: Ceres CLONE 285281-F
attccttcactgccagtbttgcatcccgtccccgtccgckccggccgacgccgccttttcgtccccgcgtcvtcgcgctccactgagcgtgcgtgtcaccggcgggaggcaagggcaggcggtggtggcgatggcgtccgctgacsgcgcttggcggggatcgctcctccatccgcgtcatccccgacttccccaagccagggatcatgttcc

SEQ ID NO: 3342 - DNA, 142 bp, Zea mays
  misc_feature: Ceres CLONE 285313-F
  misc_feature (13)..(13): n is a, c, t, g, unknown, or other
aaccggtccaccnhgcatcgaacccccacttgtgccgattctgctgatccctcgccgacaacggccggcgaatcgacaccatggccgctccgsgccggggccgtggcgacasaccaacggcgtcgtccgtccccgcccccgc

SEQ ID NO: 3343 - DNA, 275 bp, Zea mays
  misc_feature: Ceres CLONE 285361-F
  misc_feature: Translation starting site: 87
ctcatccattccatcatcccctttgcagtatagtctctctgctaagcgamstagctcaaagctagtctcggcggctctagaagacgatgggcaaggacgacgtgatcgagagcggcgcttggcggcggcgagttcsctgccaaggactacacggaccctcccccggcgctgctgatcgacgcggcggactggggttcctggtcgctgtaccgcgccgtgatcgccgatttcatcgccacgctgctgttcctgtacatcacggtggccaccgtgat

SEQ ID NO: 3344 - DNA, 480 bp, Zea mays
  misc_feature: Ceres CLONE 285367-F
  misc_feature: Encodes the peptide sequence at SEQ ID NO. 3345
  misc_feature (394)..(394): n is a, c, t, g, unknown, or other
gtggtgtggactcctgcactgtgctccttcgtctcctcctcccctgcctgccaccaactgccaaggtgccaagcaagtgcagataccttccctgcctcacaaacaacgccatcagggtcttcaaccagggcagggagcagtttggcaagtttgacagcgtgcttgagccaggatgccactgcatgccttggttcgccggcaagcgtgtagctgggcatctcacactcaggctgcagcaactggatgtgcgctgtgagacaaaaacaaaggacaatgtttttgtgaatgtggtggcatctattcagtaccgcgctctggctgacaaagcaagtgacgctttctacaaactgagcaacacaaggtcccagatccaagcctacgtctttgacgtgantcagagcaagcgttcccaagctccatttggacgatgctttcgagcagaaggacgagatcgcaagggcggtggaggaagagcttgag

SEQ ID NO: 3345 - protein, 158 aa, Zea mays
  misc_feature: Ceres CLONE 285367-F
  misc_feature (131)..(131): Xaa is any aa, unknown, or other
GVDSCTVLLRLLLPCLPPTAKVPSKCRYLPCLTNNAIRVFNQGREQFGKFDSVLEPGCHCMPWFAGKRVAGHLTLRLQQLDVRCETKTKDNVFVNVVASIQYRALADKASDAFYKLSNTRSQIQAYVFDVXQSKRSQAPFGRCFRAEGRDRKGGGGRA

SEQ ID NO: 3346 - DNA, 178 bp, Zea mays
  misc_feature: Ceres CLONE 285419-F
  misc_feature: Encodes the peptide sequence at SEQ ID NO. 3347
  misc_feature (72)..(72): n is a, c, t, g, unknown, or other
  misc_feature (84)..(84): n is a, c, t, g, unknown, or other
  misc_feature (90)..(90): n is a, c, t, g, unknown, or other
agagtttccgtgccgtagcaacagacaagggagagtgggagactagcgcaacaggacagcgcacggaaagcnaggggaaggganacgganagggcgcatcggacggcggcgagatgctggcggtgttcgatcccacggtggccaagtgcccggagtctccgcagccccccggtcgccg

SEQ ID NO: 3347 - protein, 58 aa, Zea mays
  misc_feature: Ceres CLONE 285419-F
  misc_feature (24)..(24): Xaa is any aa, unknown, or other
  misc_feature (28)..(28): Xaa is any aa, unknown, or other
  misc_feature (30)..(30): Xaa is any aa, unknown, or other
SFRAVATDKGEWETSATGQRTESXGKGXGXGASDGGEMLAVFDPTVAKCPESPQPPGR

SEQ ID NO: 3348 - DNA, 482 bp, Zea mays
  misc_feature: Ceres CLONE 285441-F
  misc_feature: Encodes the peptide sequence at SEQ ID NO. 3349
agtcaaggagaccgtgcctacgcttttbttctccctccattcattcacacaccacacctcccgaactccgaactacaagtttcgcttctcgtcgcgacgactgggcgagaccgccgccgccgccgccgcctgagttctttagaaatggctgatggtcaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctacaacgagcttcgtgttgccccagaggagcaccctgtgttgctcactgaggctcctttgaa

SEQ ID NO: 3349 - protein, 112 aa, Zea mays
  misc_feature: Ceres CLONE 285441-F
  misc_feature (4)..(112): Pfam Name: Actin Pfam Description: Actin
  misc_feature: SWISSPROT Homolog: EC 2.7.10.2 Non-specific protein-tyrosine kinase
MADGQDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPL

SEQ ID NO: 3350 - DNA, 137 bp, Zea mays
  misc_feature: Ceres CLONE 285444-F
  misc_feature (2)..(2): n is a, c, t, g, unknown, or other
  misc_feature (26)..(26): n is a, c, t, g, unknown, or other
  misc_feature (86)..(86): n is a, c, t, g, unknown, or other
tngtctccactgctctgctgctcctngcgccgccgcagcgacgtaatggcttccgccgcggtgctccggaacgccggctcccggcncttcttctcctaccctactctccgcgccgctgcgatatatgtaccttctgc

SEQ ID NO: 3351 - DNA, 254 bp, Zea mays
  misc_feature: Ceres CLONE 285480-F
aaagaaaaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcggcsaaagcccaacgccaagaactcccaggacgggctcaccccggagcagcgccgcgagagggacaagaaagctctggaggagaaggcggccaa

SEQ ID NO: 3352 - DNA, 439 bp, Zea mays
  misc_feature: Ceres CLONE 285503-F
  misc_feature: Encodes the peptide sequence at SEQ ID NO. 3353
gtcgatttggattcgcagcggcggcggcggccaatcaaagcaatcatcacccagtcgcccagbmcaacagacgctccagtccccagccctcccacccgcatcgatcgatssaaggcacaatgccggccaccgactcctcctcctcgtcgtcgccggcgsgcgcstggttccctctatcggccgctccatccgctcgctccgccgtgaccagaaccagatccactcydwcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggattcgcccgccgctcgccccccgctcgaccgccttcgtcgccga

SEQ ID NO: 3353 - protein, 146 aa, Zea mays
  misc_feature: Ceres CLONE 285503-F
  misc_feature (21)..(21): Xaa is any aa, unknown, or other
  misc_feature (37)..(37): Xaa is any aa, unknown, or other
  misc_feature (53)..(53): Xaa is any aa, unknown, or other
  misc_feature (55)..(55): Xaa is any aa, unknown, or other
  misc_feature (76)..(76): Xaa is any aa, unknown, or other
SIWIRSGGGGQSKQSSPSRPXQQTLQSPALPPASIDXRHNAGHRLLLLVVAGXRXVPSIGRSIRSLRRDQNQIHSXPPPPDATDAFQRRAAQLLADLPAADDVLSLAWTRRLLESFLLCLEEFRALLFGSGDSPAARPPLDRLRRR

SEQ ID NO: 3354 - DNA, 390 bp, Zea mays
  misc_feature: Ceres CLONE 285504-F
  misc_feature: Encodes the peptide sequence at SEQ ID NO. 3355
  misc_feature (35)..(35): n is a, c, t, g, unknown, or other
  misc_feature (134)..(134): n is a, c, t, g, unknown, or other
ctagccgccgcyagaccattcgtttctcgcgagcnatcgcttctgcatccggaagaaatggccaagtcgaagaaccacacggcgcacaaccagtcgttcaaggcgcacaagaacggcattaagaaacccaagcnccaccgccagacctccaccaaggggatggaccccaagttcctgaggaacctgaggtattctaggaagggcaacaaaaagagtggtgaggctgaagctgggcgctgtctggccggcggcgttgcccgaccatccattccacgagaagcaggacgctgtctggccggcggcgctaccggatcacccgttccacaagaagcaggacgctgtctggccggcggcgttgcctgaccatccattccacaagaagcaggacac

SEQ ID NO: 3355 - protein, 101 aa, Zea mays
  misc_feature: Ceres CLONE 285504-F
  misc_feature (3)..(42): Pfam Name: Ribosomal_L29e Pfam Description: Ribosomal L29e protein family
  misc_feature (26)..(26): Xaa is any aa, unknown, or other
MAKSKNHTAHNQSFKAHKNGIKKPKXHRQTSTKGMDPKFLRNLRYSRKGNKKSGEAEAGRCLAGGVARPSIPREAGRCLAGGATGSPVPQEAGRCLAGGVA

SEQ ID NO: 3356 - DNA, 506 bp, Zea mays
  misc_feature: Ceres CLONE 285611-F
  misc_feature: Encodes the peptide sequence at SEQ ID NO. 3357
  misc_feature (83)..(83): n is a, c, t, g, unknown, or other
  misc_feature (383)..(383): n is a, c, t, g, unknown, or other
aagctagctggctagcatggccgggaaagagcttacgctgctggggttatgggcgagcccgttcgtgctccgggcgcgcatcntccagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttcccggccgccacacctaatttccttccatccgacccctacgaccgcgccattgctcgcttctgggcctcctacgtcgacgacaagttctacagcgcgtggatacccgtgttcaggggcaggacggcggagganatggcggaggcggcgaggcaggccgtcgcggcgctggagacgctggagcaggcgttcagggagtgctccaaggggaaggccttcttcggaggggacactgtggggctcgtcgacgtcgtgctc

SEQ ID NO: 3357 - protein, 168 aa, Zea mays
  misc_feature: Ceres CLONE 285611-F
  misc_feature (9)..(81): Pfam Name: GST_N Pfam Description: Glutathione S-transferase, N-terminal domain
  misc_feature: SWISSPROT Homolog: EC 4.4.1.5 Lactoylglutathione lyase
  misc_feature (127)..(127): Xaa is any aa, unknown, or other
ASWLAWPGKSLRCWGYGRARSCSGRASSSLKGLTYAYSEENLDDKSELLLSSNPVLKKVPVLIHHGKPVCESQIIVQYVDEAFPAATPNFLPSDPYDRAIARFWASYVDDKFYSAWIPVFRGRTAEXMAEAARQAVAALETLEQAFRECSKGKAFFGGDTVGLVDVVL

SEQ ID NO: 3358 - DNA, 407 bp, Zea mays
  misc_feature: Ceres CLONE 285626-F
  misc_feature: Translation starting site: 94
  misc_feature (164)..(164): n is a, c, t, g, unknown, or other
atcacacactcgactctcctctctcgcatccgcagcctttcgagctctactccaccccctcgatctcgaagcgcmagcagcagtcaggcggccatggacgcgagckcmcggagccggcktgwwggcgaagaagggcgcggycgggcgcaaggccggcgggcganggaagaagtcggtgacgaggtccgtcaaggccgggctgcagtttcccgtcggccgcatcgggcggtacctgaagaagggccggtacgcgcascgtcggcacgggcgcccccgtctacctgggccgccgtcctcgagtacctggccgccgaggtgctggagctggccggcaackcttccaaggacaacaagaagacccgcatcatcccgcgccacgtgctccttgccatccgcaacgacgagga

SEQ ID NO: 3359 - DNA, 507 bp, Zea mays
  misc_feature: Ceres CLONE 285659-F
  misc_feature: Encodes the peptide sequence at SEQ ID NO. 3360
  misc_feature (27)..(27): n is a, c, t, g, unknown, or other
acacagctcaacaaaggagcgcggcgncccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccaccatcagagtaggcagctacaacggggaggagatatatgcg

SEQ ID NO: 3360 - protein, 123 aa, Zea mays
  misc_feature: Ceres CLONE 285659-F
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYA

SEQ ID NO: 3361 - DNA, 366 bp, Zea mays
  misc_feature: Ceres CLONE 285692-F
  misc_feature (133)..(133): n is a, c, t, g, unknown, or other
aaattttcgactctcaactcccaaggtcccttttttttctcgatctggaagcgccgcagtagcagccatggacgtgagcggacaggcgggaaggcgaagaagggcgcggccgggcgcaaggccggcgggcgancgaagaagtcggtgtcgcggtcctccagggccgggctgcagttccccgtcagccgcgtcgggcgtacctcaaaaagggccggtacgcgcabgtaggcacgggtgcccccgtctacctcgccgccgtcctggagtacctcgcggccgaggtgctcgagctcgccggcaacgcggcaagggacaacaagaagacgmgcatcatcccgcgccacgtgctcctcgccatccgcaacg

SEQ ID NO: 3362 - DNA, 436 bp, Zea mays
  misc_feature: Ceres CLONE 285698-F
  misc_feature: Encodes the peptide sequence at SEQ ID NO. 3363
  misc_feature (383)..(383): n is a, c, t, g, unknown, or other
  misc_feature (420)..(420): n is a, c, t, g, unknown, or other
atccaattcacaggctcaccacaccaaccaacaagcaaaaattccccaatcctctcgtctccgcggcgaagatgtcggggcgcggcaagggcggcaagggcctgggcaagggcggcgcgamstcaccggaaggtcttgcgcgacaacatccaggggatcacgaagccggcgatccggaggctggcgcggcggggcggcgtgaacsattctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagscagggccgcaccctctacggcttcggcggctaggcctnccgcgccgccttcgccgtcgctgcggttctggtgttnctgcagttcgcaagtt

SEQ ID NO: 3363 - protein, 121 aa, Zea mays
  misc_feature: Ceres CLONE 285698-F
  misc_feature (17)..(17): Xaa is any aa, unknown, or other
  misc_feature (45)..(45): Xaa is any aa, unknown, or other
  misc_feature (92)..(92): Xaa is any aa, unknown, or other
  misc_feature (117)..(117): Xaa is any aa, unknown, or other
MSGRGKGGKGLGKGGAXSPEGLARQHPGDHEAGDPEAGAAGRREXFSGLIYEETRGVLKIFLENVIRDAVTYTEHARRKTVTAMDVVYALKXGPHPLRLRRLGLPRRLRRRCGSGVXAVRK

SEQ ID NO: 3364 - DNA, 376 bp, Zea mays
  misc_feature: Ceres CLONE 285716-F
  misc_feature: Encodes the peptide sequence at SEQ ID NO. 3365
  misc_feature (76)..(76): n is a, c, t, g, unknown, or other
  misc_feature (157)..(157): n is a, c, t, g, unknown, or other
  misc_feature (256)..(256): n is a, c, t, g, unknown, or other
  misc_feature (349)..(349): n is a, c, t, g, unknown, or other
acacaaaaacccagcatcagtcaagctcgctcacacgaccatggccgcggcgatgaccggcagtactcgcgccagncggctccttcctcgtgcttctctttgtcgtgttggccggtgtcgtcgacgtcgcgtccgctgccaccactgcggcgagtgnkactgttgccactaacagcggtgacagcaacsgccggcgcttctgacgatgccggcgtcggcgtccacggggcagctgaatggcatcatccagtgcctnctgggctgcttcacgcaggtkttcagctgctcgttcgggtgtatgggaaaycagggcgccgacctgccgctctgcatcatcggctgckaccanaggagcgtcgtttgtatgatccgctgc

SEQ ID NO: 3365 - protein, 57 aa, Zea mays
  misc_feature: Ceres CLONE 285716-F
  misc_feature (47)..(47): Xaa is any aa, unknown, or other
  misc_feature (48)..(48): Xaa is any aa, unknown, or other
MPASASTGQLNGIIQCLLGCFTQVFSCSFGCMGNQGADLPLCIIGCXXRSVVCMIRC

SEQ ID NO: 3366 - DNA, 310 bp, Zea mays
  misc_feature: Ceres CLONE 285735-F
  misc_feature: Encodes the peptide sequence at SEQ ID NO. 3367
aaatcgaaaaaatggcgttgctgagcccgcgcgtgccggtgccgccctccaccttcacctccgttgccggtgcccggttgctttggccctgccgcgaggtgccaggcgacggcggcgggcggcgtggcggccgcggggcccccgtcgtcggagctggaggccatacggtggggcagcgcaagcygatgggcgctcgcgacgagatggaggatgaggtcttgctccgcccgggctccctcctcgatggcttctccttcgccgccgtcttggatggacacgccggcttctccgccgtccagttcctcaggga

SEQ ID NO: 3367 - protein, 99 aa, Zea mays
  misc_feature: Ceres CLONE 285735-F
  misc_feature: SWISSPROT Homolog: EC 3.1.3.16 Phosphoprotein phosphatase
  misc_feature (58)..(58): Xaa is any aa, unknown, or other
MALLSPRVPVPPSTFTSVAGARLLWPCREVPGDGGGRRGGRGAPVVGAGGHTVGQRKXMGARDEMEDEVLLRPGSLLDGFSFAAVLDGHAGFSAVQFLR

SEQ ID NO: 3368 - DNA, 133 bp, Zea mays
  misc_feature: Ceres CLONE 285741-F
attttctcctttcctcccgccggcgctgctctctccttcgacatccgcggcasaagactaggccacaaaatcgcggtasaagcagcagacaggtggggaagatgtcgtcgctgcggaatgcgatcccgcggcg

SEQ ID NO: 3369 - DNA, 287 bp, Zea mays
  misc_feature: Ceres CLONE 285764-F
  misc_feature: Encodes the peptide sequence at SEQ ID NO. 3370
  misc_feature (254)..(254): n is a, c, t, g, unknown, or other
atccccattcccatccatagagctgcgggcgcctgcgctgcatkcagccaacaagctcatcagctcaccgtacctaggaggacgaccgagcagctaaggtagtagtagctagctagccagtgatggcgggctacaaagcgcagggcggggcgctcgtcgtcgtcctggmtgtcgccgcgctcttcgcsgacgasgattggcagatggcggtggacgacgagcacatgtaccactggaagtdctttcaagtcgtncacggggaactgccgcaacgaggacgcctttga

SEQ ID NO: 3370 - protein, 54 aa, Zea mays
  misc_feature: Ceres CLONE 285764-F
  misc_feature (16)..(16): Xaa is any aa, unknown, or other
  misc_feature (24)..(24): Xaa is any aa, unknown, or other
  misc_feature (40)..(40): Xaa is any aa, unknown, or other
MAGYKAQGGALVVVLXVAALFADXDWQMAVDDEHMYHWKXFQVVHGELPQRGRL

SEQ ID NO: 3371 - DNA, 217 bp, Zea mays
  misc_feature: Ceres CLONE 285811-F
  misc_feature: Encodes the peptide sequence at SEQ ID NO. 3372
  misc_feature (97)..(97): n is a, c, t, g, unknown, or other
awattaccaaaccctaccccttcgccgcgaccgcgattcccccacatcgttggcgatgagctcctcctccaacagcgggaagaagccggcgcccgsngsccgcggggggcccaccatccgcacgctcgccgacataaaccgtggccctgccggtttcccakgtgccggasggcagcagcgatgacgacgagccccaggagtactacaccggcggcga

SEQ ID NO: 3372 - protein, 42 aa, Zea mays
  misc_feature: Ceres CLONE 285811-F
  misc_feature (14)..(14): Xaa is any aa, unknown, or other
  misc_feature (15)..(15): Xaa is any aa, unknown, or other
  misc_feature (36)..(36): Xaa is any aa, unknown, or other
  misc_feature (39)..(39): Xaa is any aa, unknown, or other
MSSSSNSGKKPAPXXRGGPTIRTLADINRGPAGFPXAGXQQR

SEQ ID NO: 3373 - DNA, 1573 bp, Zea mays
  misc_feature: Ceres CLONE 285841
  misc_feature: Encodes the peptide sequence at SEQ ID NO. 3374
aaacgccgcctactccgcgctcctccaaaccaaactgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggctactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacattaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtaggctgtagcatagatctgtgctccactcctaatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttccctgtgaaatttgttaaaccattatatgtaagttttgtttgacaagactgcatctcctgaaactaagatcttagtttcctgctaaaaaaaaaaaaaaaaaaaaaaaaaaaaaaaaaaaaaaaaaacaaaaaaaaaaaaaaaa

SEQ ID NO: 3374 - protein, 355 aa, Zea mays
  misc_feature: Ceres CLONE 285841
  misc_feature (24)..(328): Pfam Name: S-methyl_trans Pfam Description: Homocysteine S-methyltransferase
  misc_feature: SWISSPROT Homolog: EC 2.1.1.10 Homocysteine S-methyltransferase
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVGCSIDLCSTPNALLPAVP

SEQ ID NO: 3375 - DNA, 463 bp, Zea mays
  misc_feature: Ceres CLONE 285876-F
  misc_feature: Translation starting site: 91
  misc_feature (31)..(31): n is a, c, t, g, unknown, or other
  misc_feature (32)..(32): n is a, c, t, g, unknown, or other
  misc_feature (305)..(305): n is a, c, t, g, unknown, or other
  misc_feature (351)..(351): n is a, c, t, g, unknown, or other
  misc_feature (425)..(425): n is a, c, t, g, unknown, or other
atcagtcatcacccaccgcctccgccghcgnnaacagcgtagtgttagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcgggcaaccctccctacgctgagatgattgtagaggcgatcgctgccctcaaggagangaatgggtcgagctcggtggccatcagcaagtacgtcgaggggaancacggcgcaagctccccaccaacttccgcaagcagctcaccgtgcagctgaagaagctcgctgccgccggcaanctgacgagggtgaagaactccttcaagctgccgggcca

SEQ ID NO: 3376 - DNA, 476 bp, Zea mays
  misc_feature: Ceres CLONE 285956-F
  misc_feature: Translation starting site: 24
  misc_feature: Pfam Name: S1FA Pfam Description: DNA binding protein S1FA
  misc_feature (117)..(117): n is a, c, t, g, unknown, or other
  misc_feature (240)..(240): n is a, c, t, g, unknown, or other
  misc_feature (423)..(423): n is a, c, t, g, unknown, or other
aakcgcaaagatcaggcggccgcatggcgagtcagttcgcggattcggcgaacaacgtattcatcgaggaggtgaacaakggcctkaacccaggaatggtggttctgctcgtggttnccagcttctctgctgctcttcttcgccgggaactacgcgctgtatgtgtacgcgcagaagacgctcccgcccaagaagaagaagccggtctccaagaagaagctgaagagggaaaagctgaancagggggtctccgctccaggggagtkaacagacagggatgccgccgatcggcccgtcctgagcccgccccctatttacatgattgtcgaagaaaaaagatacacctgctggagccgcggtgttcgtagtaattttgttctgtagatgccttttgttgtcttcgatggtagtgcatttgtattngacaccttgtttcagcaactgatgaatctttagcctaaaccaagctactcttt

SEQ ID NO: 3377 - DNA, 197 bp, Zea mays
  misc_feature: Ceres CLONE 285961-F
gctcgggggcaattctgtctatccatccacaaatagaagtttgtctcagaaaacaaaaataagaaggatgggaattggattctgatttgttgttcttcttcctaaataataaattctagggtttgcctcttccctctcggctctcgctcccaccaccaccaccaggcagacgcagatcggcggcgggataggctagc

SEQ ID NO: 3378 - DNA, 461 bp, Zea mays
  misc_feature: Ceres CLONE 285972-F
  misc_feature (138)..(138): n is a, c, t, g, unknown, or other
actcatacatttcgactctcaactcccaaggtcccttttttttctcgatctggaagcgccgcagtagcagccatggacgtgagcggasaggcgggaaggcgaagaagggcgcggccgggcgcaaggccggcgggcgancgaagaagtcggtgtcgcggtcctccagggccgggctgcagttccccgtcagccgcgtcgggcggtacctcaaaaagggccggtacgcgcabttaaggcacgggtgccccgtctacctcgccgccgtcctggagtacctcgcggccgagtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcycgtcctccccaacatccacactgtgctcctccccaagaaggt

SEQ ID NO: 3379 - DNA, 467 bp, Zea mays
  misc_feature: Ceres CLONE 285994-F
  misc_feature (229)..(229): n is a, c, t, g, unknown, or other
  misc_feature (326)..(326): n is a, c, t, g, unknown, or other
accaattcactaccaacgacgtacaagccaccaccaaccagcaggagctcatcgggatgggcgacgcggctattgcgtcgtgcatgaggctgatgaggaggagcaggagcacatcttccggagccggttcccgcctgtggacctgccggacgacgtcactgtgccggagttcgtactggccggcgccgaggcctacgcggacaaggtggcgctcgtggaggccgcgcgngggggcggtcctacacctacggcgaggtggcccgggacgtggcgcggttcgccagggcgctgcggtccgtgggcgtccgcaagggccacgtagttgngtcgcgctcccgaacctcgcggtgtaccccgtggtgagccttgggatcatgtccgcagcgcgtcttctctggtgtgaaccgcgcgccatcgccgsgagatcaagaagcaggtggaasactcggatgccaagctcgtggtca

SEQ ID NO: 3380 - DNA, 416 bp, Zea mays
  misc_feature: Ceres CLONE 285997-F
  misc_feature: Encodes the peptide sequence at SEQ ID NO. 3381
  misc_feature (52)..(52): n is a, c, t, g, unknown, or other
  misc_feature (357)..(357): n is a, c, t, g, unknown, or other
aatcctctccgtgtaggccgcgggattccgtgtccctctccaatccggcgtnrtcgtcgccggatacaggatccggtccccgcgatggagccctcaccaacctcctcctcgccggctgtggcgcgccggttgtcgccggagtaaggagggtgccgaagcgggcgctggaggagttgttggagcaggtccagcgggctgttgagatgctgcgcgatgccgacgctgatctcgccatctctctctcggaggagaccgcagcagcctcgccggascgagaccgcaagacgatkttggtgtcgatggagatggcatggcgacgtcgtsgttgcgagtgactccgattacgagacgacgcanatkttgtgaccttcttaaatctaaggttgggatcactcgagttccttcaaaagctcaat

SEQ ID NO: 3381 - protein, 110 aa, Zea mays
  misc_feature: Ceres CLONE 285997-F
  misc_feature (17)..(17): Xaa is any aa, unknown, or other
  misc_feature (90)..(90): Xaa is any aa, unknown, or other
  misc_feature (96)..(96): Xaa is any aa, unknown, or other
  misc_feature (108)..(108): Xaa is any aa, unknown, or other
SSPCRPRDSVSLSNPAXSSPDTGSGPRDGALTNLLLAGCGAPVVAGVRRVPKRALEELLEQVQRAVEMLRDADADLAISLSEETAAASPXRDRKTXLVSMEMAWRRRXCE

SEQ ID NO: 3382 - DNA, 472 bp, Zea mays
  misc_feature: Ceres CLONE 286037-F
  misc_feature: Encodes the peptide sequence at SEQ ID NO. 3383
attagtccatttccattcccatcccgaccccgtcttgccaccggctacacgctctcggagtctcggacgccgcccaaatggaggccatccggaagcaggcctcaaagctccgggagcaggtagctcggcagcagcaggtgaacactacacgcctccccctttcgcaagatctccgccatccgttcctccgcgacccggccacggctcgcaccgcccggctcccgccctttctcttaacgcgggtccttcgagatctggtcatcatctctaggtttgttattgatcactgatgccgcgtccgtgctcgcggccgcccgtgtcctgtttcgcaggcggtgatgaagcagttcgggggcgggtacggcgcagasgccgtgttcgctgacgaggctgaggcgcaacagcactccaagctcgagaaactctacatctctacgcgcgcggccaagcacttccaaagggatatagttcg

SEQ ID NO: 3383 - protein, 44 aa, Zea mays
  misc_feature: Ceres CLONE 286037-F
  misc_feature (11)..(11): Xaa is any aa, unknown, or other
MKQFGGGYGAXAVFADEAEAQQHSKLEKLYISTRAAKHFQRDIV

SEQ ID NO: 3384 - DNA, 144 bp, Zea mays
  misc_feature: Ceres CLONE 286043-F
accaacctcagcacaccaaggagattacgtggaggagcagccatggcttcatcggtggccgccgcggcgagcacattcctgggcaccgcctggcgacccggcgccacagaacgggcgcatcgtggcccggttcgggttcgggtt

SEQ ID NO: 3385 - DNA, 295 bp, Zea mays
  misc_feature: Ceres CLONE 286079-F
  misc_feature: Translation starting site: 197
  misc_feature: SWISSPROT Homolog: EC 2.1.1.41 Sterol 24-C-methyltransferase
  misc_feature (105)..(105): n is a, c, t, g, unknown, or other
  misc_feature (225)..(225): n is a, c, t, g, unknown, or other
aattccactagattaccaccacctccacctcgtcgtctcccaccaccgccgagcgcgasyctagcccgatctagccggcgsaggcaccagatcccgccgcccgcnstcccgggaccgccccgccgaatccgccgctcctcgcactgcaacacgcccgggaccacggtgcatttgatccgtcccggccgcctacacgatgtccaagtcggggagcgctggatcttncttctggcctcggagggaagatcaacaaggtggaagtcaagtcggccgtcgatgrgtatgagaaatatca

SEQ ID NO: 3386 - DNA, 466 bp, Zea mays
  misc_feature: Ceres CLONE 286100-F
  misc_feature: Pfam Name: Dehydrin Pfam Description: Dehydrin
aggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagatgagccgtggtggtagtgccggtggtggtcaaagttctctgggttatctctttggaagcggtgagccccccaaaccagcagtggcaccagctgcaagtgctccacctgttgagaaaccatctctgcaaagactgatgcggccaagcaggttgctgctggggttaccagccaaaccaataactaccacagggctgatggtcagaacactggcaacttccttacggaccgtccttc

SEQ ID NO: 3387 - DNA, 487 bp, Zea mays
  misc_feature: Ceres CLONE 286101-F
  misc_feature: Translation starting site: 317
  misc_feature: SWISSPROT Homolog: EC 2.3.1.74 Naringenin-chalcone synthase
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccaatcacccacctcgtg

SEQ ID NO: 3388 - DNA, 471 bp, Zea mays
  misc_feature: Ceres CLONE 286105-F
  misc_feature: Pfam Name: Cyclin_N Pfam Description: Cyclin, N-terminal domain
agtactagcagtagcactgcgccgcacaatggtggtttccctcgccgaataaatctcaccggtcgcgcttcttggcgtgttcctccgctcgcctgggcttcgatctccagccctcgcgtgabcgggtgccgccgcggcgccgtggtcatggcgacggaggagtagggagctgcgggaggaggacgcctacgcctacgagttcgagttcgaccttgagaaccccttcaccagccccgccgacgagccgatcgccagtytcctcgacgccgagggccaccacgcgccctctatctccgccgcggcctcggccacccgccgcgccgccgccgccttcatctccaaggtgcgtttcggcggcgagctcgcgttgcacccgcgcgtcgcctacctcgcgctcaactacgtggatcgcttcctctccaagaggcaattggcgtgcgagcagcagccgtgggcggccgcgcctgcttg

SEQ ID NO: 3389 - DNA, 488 bp, Zea mays
  misc_feature: Ceres CLONE 286122-F
  misc_feature: Encodes the peptide sequence at SEQ ID NO. 3390
  misc_feature (139)..(139): n is a, c, t, g, unknown, or other
  misc_feature (237)..(237): n is a, c, t, g, unknown, or other
  misc_feature (332)..(332): n is a, c, t, g, unknown, or other
cacaaacaaaattgtagagtcggagmcaacgccacgccgacatcgacagcactgatccgacaagtcgccgtttctgccctaagcacggacgctgtcggtcacactcgcctcttgttttctcccgagccccatccttccntcccggtctctccttgcgagctagtaccctacttgctccacagtgccacaccgctcgckctggagtatgggttcgagcccgatgtggtggtcaggacnacacgtcgccgtggagccgcggtttagggaaatggtgggcgctggtagggccattcgtggtgaaggccgtcgggttcctgctgctcgcgggcctnttgttccgggtgctctggtcctttccgtcctctccggcgccggcgtttcagatcacaaaakgaaaattcagtcttttcaatggggaatggataccaaacccctcttgtccagcctatacaaattcaagctgtcgatttattgacgatcaccagaac

SEQ ID NO: 3390 - protein, 84 aa, Zea mays
  misc_feature: Ceres CLONE 286122-F
  misc_feature (6)..(6): Xaa is any aa, unknown, or other
  misc_feature (38)..(38): Xaa is any aa, unknown, or other
  misc_feature (58)..(58): Xaa is any aa, unknown, or other
MWWSGXHVAVEPRFREMVGAGRAIRGEGRRVPAARGPXVPGALVLSVLSGAGVSDHKXKIQSFQWGMDTKPLLSSLYKFKLSIY

SEQ ID NO: 3391 - DNA, 244 bp, Zea mays
  misc_feature: Ceres CLONE 286158-F
  misc_feature: Encodes the peptide sequence at SEQ ID NO. 3392
  misc_feature (201)..(201): n is a, c, t, g, unknown, or other
acgaataggaagakaagygtgggaggatttttttgccgcagcgtccccatggcggcgggaagagaaaccgacgaacagctgaccgagtacgagaagcagcggctgtcgcggatacsmttaacgakgcccgactcgaggccctgggctccgcagcctcgcagcgtcccctcttchccgcagctcgtcgccggggacgccaanggggaagcagaagaagaggtccgtcgacgaggacgaggagtac

SEQ ID NO: 3392 - protein, 65 aa, Zea mays
  misc_feature: Ceres CLONE 286158-F
  misc_feature (23)..(23): Xaa is any aa, unknown, or other
  misc_feature (26)..(26): Xaa is any aa, unknown, or other
  misc_feature (51)..(51): Xaa is any aa, unknown, or other
MAAGRETDEQLTEYEKQRLSRIXLTXPDSRPWAPQPRSVPSSPQLVAGDAXGEAEEEVRRRGRGV

SEQ ID NO: 3393 - DNA, 115 bp, Zea mays
  misc_feature: Ceres CLONE 286180-F
  misc_feature (2)..(2): n is a, c, t, g, unknown, or other
anattagcaggccgcctgctgctccttgcccctaagcctcgtttccggtgtacgactccaacgacgacgagawtggcgctccgtcggasttcccctccctcggccgcgcgcttct

SEQ ID NO: 3394 - DNA, 288 bp, Zea mays
  misc_feature: Ceres CLONE 286203-F
  misc_feature: Encodes the peptide sequence at SEQ ID NO. 3395
  misc_feature (140)..(140): n is a, c, t, g, unknown, or other
  misc_feature (141)..(141): n is a, c, t, g, unknown, or other
  misc_feature (245)..(245): n is a, c, t, g, unknown, or other
atcttgctctgaacgcattcctcccatctcccaagacctcctcagacccgagaagcgcmtgcgggccatggacgccaccggactggagctggagggaaggcgaagaagggagcggccggtcgcaaggccgcggggccganngaagaagtcggtgacgaggtccgtgaaggccgggctccagttccccgtcggccgcatcgggcgctacctcaagaagggccgctacgscagcgtcggcagckgtncccccgtctacctcgcggccgtcctgggagtacctcgccgctg

SEQ ID NO: 3395 - protein, 73 aa, Zea mays
  misc_feature: Ceres CLONE 286203-F
  misc_feature (25)..(25): Xaa is any aa, unknown, or other
  misc_feature (54)..(54): Xaa is any aa, unknown, or other
  misc_feature (59)..(59): Xaa is any aa, unknown, or other
  misc_feature (60)..(60): Xaa is any aa, unknown, or other
MDATGLELEGRRRRERPVARPRGRXKKSVTRSVKAGLQFPVGRIGRYLKKGRYXSVGSXXPVYLAAVLGVPRR

SEQ ID NO: 3396 - DNA, 192 bp, Zea mays
  misc_feature: Ceres CLONE 286219-F
  misc_feature: Encodes the peptide sequence at SEQ ID NO. 3397
attccccaatctagggttgctgagctccccaccactgccggccatgcccgacgcggatgttgacaccgtgattcgcgamsgccgcggccgscccagccgcgacgacgacagcgagggtgacaccgaggaggaggaggaggagggggacgaggtcgacgaggackaggacgacgacgaggagttacccgccga

SEQ ID NO: 3397 - protein, 49 aa, Zea mays
  misc_feature: Ceres CLONE 286219-F
  misc_feature (12)..(12): Xaa is any aa, unknown, or other
  misc_feature (13)..(13): Xaa is any aa, unknown, or other
  misc_feature (41)..(41): Xaa is any aa, unknown, or other
MPDADVDTVIRXXRGRPSRDDDSEGDTEEEEEEGDEVDEDXDDDEELPA

SEQ ID NO: 3398 - DNA, 369 bp, Zea mays
  misc_feature: Ceres CLONE 286269-F
  misc_feature: Encodes the peptide sequence at SEQ ID NO. 3399
  misc_feature (35)..(35): n is a, c, t, g, unknown, or other
agaaaagggcggataaactgcttgaactggaagcnaccctagtccaaaccaccgcaccgacaccgactccgagccccgccgcgccgcgctacctccgctcctctcttcgcccctgccggcgtcgaggccgaagcgaaggcgagcatgcatcacgaccccaaccccttcgacgagggcagcgcgaggacaaccccttctcaaatggaggagccggastcaagcagcagtacggcttccggccgactgagcccgtcggttcggcggcgctacagggggcgacgcgtcgttgacgtcccgctcgagaccatgggggactctcggagcaaggtgaaggagctctcgtcgtgggaatcagatctgaagcggcga

SEQ ID NO: 3399 - protein, 75 aa, Zea mays
  misc_feature: Ceres CLONE 286269-F
  misc_feature (24)..(24): Xaa is any aa, unknown, or other
MHHDPNPFDEGSARTTPSQMEEPXSSSSTASGRLSPSVRRRYRGRRVVDVPLETMGDSRSKVKELSSWESDLKRR

SEQ ID NO: 3400 - DNA, 260 bp, Zea mays
  misc_feature: Ceres CLONE 286336-F
  misc_feature (2)..(2): n is a, c, t, g, unknown, or other
antcgtcaccgagaagcagaagcagcagctgctscttgctggtcgttcgttcgcctcgttctctccgcctccccccaccccccgcctcgcttcctcctccgcgcttccttcgccgaggcgtcaskttcasrggggcgtataaagcgctccccctccgcgcgcgtccgcacaatcgccaccgcctctccgctcctcgacaagaccaatggcggctgctgcgtcctccgctctgcacgccgttggscctcgctccgccaagc

SEQ ID NO: 3401 - DNA, 471 bp, Zea mays
  misc_feature: Ceres CLONE 286346-F
  misc_feature: Translation starting site: 62
acaaacctctcctggcacgagatcacgcttctcgtcggatcgaacagctagggtttccaagatgttcgggcgcgcgcgaagaagagcgacaacacacggtactacgagatcctcggggtctccaaggacgcgtcccaggatgacctcaagaaggcctaccgcaagccgccatcaagaaccaccccgacaaggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatc

SEQ ID NO: 3402 - DNA, 123 bp, Zea mays
  misc_feature: Ceres CLONE 286350-F
  misc_feature (60)..(60): n is a, c, t, g, unknown, or other
gctttacaactccccaccccagccgatcccaacgcacactgcacccagtccggcggccgncaatggcgtgcacggcggcgactacctgcggcggttcgttgcggagacggagtggtacaacga

SEQ ID NO: 3403 - DNA, 238 bp, Zea mays
  misc_feature: Ceres CLONE 286366-F
aaaacaaaaccctagcattcaatcacgccgagctcgccggaacaagcccaacccgagcccaagcccgctcggscccagccgatccgsgctcctcaccagtacaatccggggtacccgcggatgctagcctgatcgggtccccacggtcgatgggttcgcccgggtccgccaatggcagacgcggcgactatgtgaggatcccggagaggcggaggtggcgtccaagggggagggagat

SEQ ID NO: 3404 - DNA, 1626 bp, Zea mays
  misc_feature: Ceres CLONE 286441
  misc_feature: Encodes the peptide sequence at SEQ ID NO. 3405
actcgcgcgactcgcacaaggaacagaacttcagaacccagcgaatccagcctggcccatgccatgtcgcagcccgacgccgacgccatcctcatccccatcgccgcggcgatggatccctccccagccccagccccagccccggctccggctccggtcccggcccctacggtggtcgagtggcccgagggcggcgcactgacgcgggactgggtggcggggctggcgtccacgctggactggtgctcgcggcacctccccgcggaccgcctcccggcggtgctcccgcccgcgctggtccagcgcctggtcctggccgccgccgccatcctgcaccgcgagcccaacctcgtccgcgtcgacccgcgccccggccaggccgtcgtcgtcgtcggggacgtccacgggcagctccacgacgtcatcttcctgctccgcgacgccgggttcccgtccgaggaccgcatcttcgtcttcaacggcgattacgtcgaccgcggcgcctggggcctcgagaccttcctcctgctcctcgcctggaaggtgctactcccaaactgtgtgttccttctccggggaaaccacgaatccaagtactgcacgtcagtatatggtttcgagaaggaggtaatgactaaatacaaagatcagggccctcaaatttaccggaagtttttaagatgttttgaggaccttcctctggcgacaataatagcaggatgtgtgtacactgcacacggcggtatcttccgtggaacaattgtagtgccatcaaagaaatcaaaaaagggaaagaagggtcacaaatacaaggcgaattttactgttgatctgacttccatgaaacttggatccttggatgagttattgaaagcaaggagaactgttctcgaccctccttgggaaggctcaaatttgatccctggggatgtgctgtggtctgacccttccttgcagatgggtctttctccgaataaagaacgaggcataggtttgctttggggtcctgatatcactcagcagtttctgaggacaaatcatttgaagctaatcatcaggtcacatgaaggtccagacgcgagagacaagcgacacgatctcttaggaatggataaaggatatacgattgatcatgaagtagaatgtgggaaactaattactctcttcagtgctccggactacccacagtttcaggcttcagaggagcgatacaacaatcgtggagcatatattgtccttagtccacctgattttgctacccctgttttccatagcttcggagctgtaaagcctcgacctgcggcccatccgttctatgattttgaacaagtgatcgactcagatgaagaattggatttaatcgccatggacagcggcacgtcgagcctgtcatgacgactcgccatgtttctggatggcctgagtcctgacatgcacacgccaaatctgatctgttggtttggttgaggttgatttgtatctaaaactaagtgagcgtgagatgtcatctaaaggctgaaggaagtcagcggttgcaagaatcttagttcatgattgtttatcatctagactatataatctagcttaaataagttaagaggcaaacaaacaaaaaaaaaaaaaaaa

SEQ ID NO: 3405 - protein, 443 aa, Zea mays
  misc_feature: Ceres CLONE 286441
  misc_feature (105)..(338): Pfam Name: Metallophos Pfam Description: Calcineurin-like phosphoesterase
  misc_feature: SWISSPROT Homolog: EC 3.1.3.16 Phosphoprotein phosphatase
MSQPDADAILIPIAAAMDPSPAPAPAPAPAPVPAPTVVEWPEGGALTRDWVAGLASTLDWCSRHLPADRLPAVLPPALVQRLVLAAAAILHREPNLVRVDPRPGQAVVVVGDVHGQLHDVIFLLRDAGFPSEDRIFVFNGDYVDRGAWGLETFLLLLAWKVLLPNCVFLLRGNHESKYCTSVYGFEKEVMTKYKDQGPQIYRKFLRCFEDLPLATIIAGCVYTAHGGIFRGTIVVPSKKSKKGKKGHKYKANFTVDLTSMKLGSLDELLKARRTVLDPPWEGSNLIPGDVLWSDPSLQMGLSPNKERGIGLLWGPDITQQFLRTNHLKLIIRSHEGPDARDKRHDLLGMDKGYTIDHEVECGKLITLFSAPDYPQFQASEERYNNRGAYIVLSPPDFATPVFHSFGAVKPRPAAHPFYDFEQVIDSDEELDLIAMDSGTSSLS

SEQ ID NO: 3406 - DNA, 448 bp, Zea mays
  misc_feature: Ceres CLONE 286457-F
  misc_feature: Encodes the peptide sequence at SEQ ID NO. 3407
  misc_feature (276)..(276): n is a, c, t, g, unknown, or other
  misc_feature (432)..(432): n is a, c, t, g, unknown, or other
agctaggcacccgtgccatcttcagtccacctagccatgcctacgacgatggcggcggcggcggcasgttctgctccaagctcgctccgstttcgsccaggggacgatcgggggaggccatgtcctctacagcaggtctcagagggctgccactgtctccgccagagcttccatgaacataacgtgctgcgcgaaccagacgcagacggcgcacgcaagtcgtattcggggacgacctctccgccgtcagttcagtgaaagagaaggtgaagcganggctcgacgacgggggcgtcggggttcccgccgttccggttcgggggakgcggaggaggaggaggcggcggcggcacagctcgtccggcgggttcatcctcttcgtggtcgtcctgctcctggattacctcaagggagttcgagaggaacctgcanaacgggccacggagga

SEQ ID NO: 3407 - protein, 69 aa, Zea mays
  misc_feature: Ceres CLONE 286457-F
  misc_feature (7)..(7): Xaa is any aa, unknown, or other
MAAAAAXSAPSSLRFRPGDDRGRPCPLQQVSEGCHCLRQSFHEHNVLREPDADGARKSYSGTTSPPSVQ

SEQ ID NO: 3408 - DNA, 458 bp, Zea mays
  misc_feature: Ceres CLONE 286476-F
  misc_feature: Encodes the peptide sequence at SEQ ID NO. 3409
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcycgcagcakntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagattggcgacggaggcgtccctgtcgtgcgtccgctcgtggggc

SEQ ID NO: 3409 - protein, 86 aa, Zea mays
  misc_feature: Ceres CLONE 286476-F
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRLATEASLSCVRSWG

SEQ ID NO: 3410 - DNA, 489 bp, Zea mays
  misc_feature: Ceres CLONE 286491-F
  misc_feature: Translation starting site: 141
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaaggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctgt

SEQ ID NO: 3411 - DNA, 492 bp, Zea mays
  misc_feature: Ceres CLONE 286505-F
  misc_feature (277)..(277): n is a, c, t, g, unknown, or other
  misc_feature (399)..(399): n is a, c, t, g, unknown, or other
  misc_feature (400)..(400): n is a, c, t, g, unknown, or other
attccacgctgcctcggccggcacctacctcccccacttcgccgccgsggtggagtcgggccggagcagccgctagctcgcctctgttaccccaaaaaagacaaaaaaaataaagagagagtaccaagcaagccgccggcagctcgggcagccatggggcacggcgtcastgcgctcgcacgggcgacgagcacaactacttccgcgcggcgcaggtcggggacctcgacgccctggacgcgctcctcgccgccgacccctccctcgcccgccgcgnhacgctctacgaccgtctctccgcgctgcacatcaccgccgccaatggccacctcgaggtgatgtccatgatcttgaatcacggggtacgccggacgccgtgaaccggcacaagcagacgcnnctgatgctcgcggcgatgcacggcaagatcgactgcgcgcggaactcctgcaggccggcgcaatatcctgatgttcgactccctgcacgggc

SEQ ID NO: 3412 - DNA, 95 bp, Zea mays
  misc_feature: Ceres CLONE 286541-F
agcgatctaggccgccgctctcctactgcatctccctcgctctcgtcgcctcgtttcgcttcgcctcctccccgccccgccccgagccgagcaga

SEQ ID NO: 3413 - DNA, 193 bp, Zea mays
  misc_feature: Ceres CLONE 286556-F
  misc_feature (20)..(20): n is a, c, t, g, unknown, or other
aaatccacacctcgcttgcntgtcctcgccctgatccggttcccccgttcctcgcctcctctgacccaaatttgagccaagcgamscgtgcccgtkatccggtccatgcgcggakggtagccggattctatcgccgtcgcctccccttcgccgccattttccagtcgccgggatcagccgagttggatctcga

SEQ ID NO: 3414 - DNA, 165 bp, Zea mays
  misc_feature: Ceres CLONE 286591-F
  misc_feature (92)..(92): n is a, c, t, g, unknown, or other
accctgaccagatttggccgcttcctcctctacctcccgcttadccctagtccagccccccgwagatctgctccgcgcgasagccatggcgnagacgctcgacatgaccctcgatgacatcatcaagaacaacaagaagagtaacccctcctccggcggggcccg

SEQ ID NO: 3415 - DNA, 395 bp, Zea mays
  misc_feature: Ceres CLONE 286620-F
  misc_feature (303)..(303): n is a, c, t, g, unknown, or other
  misc_feature (326)..(326): n is a, c, t, g, unknown, or other
  misc_feature (354)..(354): n is a, c, t, g, unknown, or other
attttccgtttctttaaaccgtcatcgtcctccctcgtgctagcctcgctcgttgcgcgttcaaatttcgaaccacctccgccttcgacgccccaaaccctagcccgacccctcctcctccacctgcgccaccgcccaccatgagctccgccgccgcgccagctgccgtcggscaaggagcttgccaacccgcccgccgacggaatcaccaacctccgcttctccaaccacagcaacaacctcctcgtctcctcatgggacaagacggtgcggctctacgacgccgacgccaacgtgctcaanggggagttcatgcaccccggggncgtcctcgactgctgcttccacgacgantcctcgggstttacgccggtgccgaccacaccgtgcggagg

SEQ ID NO: 3416 - DNA, 364 bp, Zea mays
  misc_feature: Ceres CLONE 286622-F
  misc_feature: SWISSPROT Homolog: EC 3.2.1.14 Chitinase
  misc_feature (312)..(312): n is a, c, t, g, unknown, or other
aaatcacctcacaacaagctgccccgcvaacgaacacgaaccttggcagaacgaagctgaagtagttcgttgtgaacccagtatggcaaacgcgccgaggatcctggccctcggctgctagcgctcctgtgcgctgccgccggcccggccgccgcgcagaactgcggctgccagcctaacttctgctgcagcaagttcggctactgcggcacgaccgacgcctactgcggcgacgggtgccagtcgggcccgtkccgctcgggcgcggcggcggcggcggcggcggcggaggcggcggaggcagtggcggtncgaacgtggctaatgtggtcaccgacgcgttcttcaacggcatcaagaacca

SEQ ID NO: 3417 - DNA, 135 bp, Zea mays
  misc_feature: Ceres CLONE 286636-F
gawccgcctcgagccgctctcggcttcgaatcccgacaacctccctccccaagctgcttagccgccggctgggcctcagacctgcgtcaasttccggcggcascatcgagcaccacaatggcgtccggcggasgg

SEQ ID NO: 3418 - DNA, 263 bp, Zea mays
  misc_feature: Ceres CLONE 286665-F
  misc_feature: Pfam Name: SurE Pfam Description: Survival protein SurE
  misc_feature: SWISSPROT Homolog: EC 3.1.3.5 5'-nucleotidase
  misc_feature (105)..(105): n is a, c, t, g, unknown, or other
aacgggaattcctcactcacatccctacgcacgaacggaaacgccccgtgctgcgctcgcartctcgcatggagtccaccactgctgctgctaccgcggcggcgncgcgcaccggtgctgctggtgacgaacgacgacggaatcgacgcgccggggctccgcttccttgtcgaccgtctcgtcgccgcaggcattaccgcgtactcgtctgcgcgcccgacacagacaaatcgggtgtragccactgcatcacatggcgccct

SEQ ID NO: 3419 - DNA, 463 bp, Zea mays
  misc_feature: Ceres CLONE 286667-F
  misc_feature: Encodes the peptide sequence at SEQ ID NO. 3420
ayattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtactcccaggctgactgtgctgtcctgatcattgactccaccactggtgt

SEQ ID NO: 3420 - protein, 113 aa, Zea mays
  misc_feature: Ceres CLONE 286667-F
  misc_feature (5)..(113): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTPRLTVLS

SEQ ID NO: 3421 - DNA, 694 bp, Zea mays
  misc_feature: Ceres CLONE 286688-R
  misc_feature: SWISSPROT Homolog: EC 1.15.1.1 Superoxide dismutase
ccaattggtgaccgggccccccctcgaggtcgacggtatcgataagctttttttttttttttcttaatttctcactatacctttacctataattttttttttttttttggcctccaaaccgacatgtaacacatactccgggcatccaacagcataatccagcactgtttagtccaaccgttgctaaaggggcataatgacaaatacgatgattaccgatccgcgaccctcttatttcacgaagtctcccaaagttccagctcctctgctggggaccgcaggagacagacctctcagggacccccaaatccggcaatccttttcagccctggagtccatgatcccacagcaaaccgccaccggcgtttcccgtgctcttgctgaactcgtgcccacccttttcaaatcatccagatcagcgtgaacacaacagctctggcaatgaatgaatttgggccaatcactgggaactggctgtccgtgacattgatattagaacaccatctgctcccagctgttacgttttccagatcaccagcatggcggttctcatcttctggtgccccatgctccctgcttcccaggaattgaaatgtgggccaaccccccccctagggggaaaaaaaaaagtggcccttagaaccaattgttgtttaccaagaacaaaaaaaagcctttaaaacatttgtttttg

SEQ ID NO: 3422 - DNA, 452 bp, Zea mays
  misc_feature: Ceres CLONE 286702-F
  misc_feature: SWISSPROT Homolog: EC 3.1.3.16 Phosphoprotein phosphatase
  misc_feature (321)..(321): n is a, c, t, g, unknown, or other
  misc_feature (419)..(419): n is a, c, t, g, unknown, or other
gttcccgtgtcgtcctcccgacaaagagggagccgctaggtttagcggcttccgcttctgggcgagggcttacccgcgagkacggcgcgacgcggcggcacttgagctagggtttccctccgatcccgttcctttcccggcgaggcgatggacgaggcggcgattgacgacttgatccggcggctcctcgaggcccgcggcgggcgcaccccgcgcaacgcaggttgactgacgccgagatccggcgcctctgcgcaccgccaaggacgttttcctctcccagcccaacctcctggagctcgaggcccccattaagatatncgggaatttccatggccagtattcagacctccttcgattatttgagtatggtggctatccaccagatgcaaattatctgttcctgggtaactatgttnatcgggggaaacakagcatagaaacaatatgcc

SEQ ID NO: 3423 - DNA, 458 bp, Zea mays
  misc_feature: Ceres CLONE 286728-F
  misc_feature: Encodes the peptide sequence at SEQ ID NO. 3424
  misc_feature (105)..(105): n is a, c, t, g, unknown, or other
  misc_feature (320)..(320): n is a, c, t, g, unknown, or other
  misc_feature (391)..(391): n is a, c, t, g, unknown, or other
akccgcaccgcgctcacttccgcaccctcttcccgccgcgccgccgccgccgccgcttcctccccgccgccgggcaagatgggtcgcgtgatccgcgcgcastanagggtgcgggatccgtgttcaagtcccacacccaccaccgcaaggccccgccgttccgctccctcgacttcggcgagcgcaacgggtacctcaagggcgtagtcaccgacgtgatccacgaccccggacgcggcgccccgctcgccaaggtcaccttccgccaccccttcaggtacaagcaccagaaggagctcttcgtcgccgccgagggcatntacaccggccagttcgtttactgcggccgccgcgccacgctctccatcggcaacgtcctgccgctccgsgnatccccgagggttgccgtcgtctgcaacgtcgagcaccacgttggtgaccgcggtgtcttcsccagg

SEQ ID NO: 3424 - protein, 152 aa, Zea mays
  misc_feature: Ceres CLONE 286728-F
  misc_feature (36)..(114): Pfam Name: Ribosomal_L2 Pfam Description: Ribosomal Proteins L2, RNA binding domain
  misc_feature (34)..(34): Xaa is any aa, unknown, or other
  misc_feature (35)..(35): Xaa is any aa, unknown, or other
  misc_feature (106)..(106): Xaa is any aa, unknown, or other
  misc_feature (130)..(130): Xaa is any aa, unknown, or other
  misc_feature (151)..(151): Xaa is any aa, unknown, or other
PHRAHFRTLFPPRRRRRRFLPAAGQDGSRDPRAXXGAGSVFKSHTHHRKAPPFRSLDFGERNGYLKGVVTDVIHDPGRGAPLAKVTFRHPFRYKHQKELFVAAEGXYTGQFVYCGRRATLSIGNVLPLRXSPRVAVVCNVEHHVGDRGVFXR

SEQ ID NO: 3425 - DNA, 481 bp, Zea mays
  misc_feature: Ceres CLONE 286739-F
  misc_feature: Encodes the peptide sequence at SEQ ID NO. 3426
gttccatcgccccccattgctcgccaagagttcttcttgtttaggcaaaggcaaaagcaggagcaaaaaggtttcgttggcgatggcgagctcgtggacgcttcctgaccacccgaagctccccaaggggaagcctgtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtsctggtcggattttcgcccaaggtgctaagcttgttgatcaagctcttgcctcaggaaagatttatgatggagatgggttcaactacatcaaagaatcttttgaaaatggtactcttcaccttattgggttgttgagtgat

SEQ ID NO: 3426 - protein, 133 aa, Zea mays
  misc_feature: Ceres CLONE 286739-F
  misc_feature (15)..(133): Pfam Name: iPGM_N Pfam Description: BPG-independent PGAM N-terminus (iPGM_N)
  misc_feature: SWISSPROT Homolog: EC 5.4.2.1 Phosphoglycerate mutase
  misc_feature (87)..(87): Xaa is any aa, unknown, or other
MASSWTLPDHPKLPKGKPVAVVVLDGWGEANPDQYNCIHVAQTPVMDSLKNGAPEKWRLVKAHGTAVGLPSDDDMGNSEVGHNALGXGRIFAQGAKLVDQALASGKIYDGDGFNYIKESFENGTLHLIGLLSD

SEQ ID NO: 3427 - DNA, 246 bp, Zea mays
  misc_feature: Ceres CLONE 286754-F
  misc_feature (108)..(108): n is a, c, t, g, unknown, or other
  misc_feature (112)..(112): n is a, c, t, g, unknown, or other
  misc_feature (120)..(120): n is a, c, t, g, unknown, or other
accatttggacaccgatccatccatccatccagccccgtacgtgtctcgctggccgtccgtatatatagagagaggcatcggagattggccgccacgttgccatcgcncgcngcsccgyngccaaggccaaccatgctggcgagggctcctccgccgcggccgtgctccagcggcgtttgcatcgcccgcgcacatccaagagccgccgccgtcgcgscaaggccggggacgacgaggacgacgac

SEQ ID NO: 3428 - DNA, 491 bp, Zea mays
  misc_feature: Ceres CLONE 286781-F
  misc_feature: Translation starting site: 74
  misc_feature (22)..(22): n is a, c, t, g, unknown, or other
  misc_feature (281)..(281): n is a, c, t, g, unknown, or other
  misc_feature (452)..(452): n is a, c, t, g, unknown, or other
akagtcaccgcggcgagttcanatcccacaatcttcttgtagcacaccactgtcttcgtccaactcggcggcgatgtctgggcgcmsaagggcggcaaggggctgggcaagggccggcgcgaaacgcaccgtaagttctccgcgacaacatccagggtatcacgaagccggcaatccggagctggcgaggaggggcggcgtgaagcgtatctccgggcttatctacgaggaaacccgcggcgtgctcaagatcttcctcgagaatgtcatccgcgacgstncacctacaccgagcacgctcgccgcaagaccgtcaccgccatggatgttgtgtacgccctcaagcgccagggccgcactctktacgggttcggtggttgagcgcatctcttccctcgtctgcagcggctkccggtggcgtttcctcagttccctctgccttgcttggcttnatgttagagagttatcagattaaaatatctctgatgtgc

SEQ ID NO: 3429 - DNA, 165 bp, Zea mays
  misc_feature: Ceres CLONE 286801-F
  misc_feature (9)..(9): n is a, c, t, g, unknown, or other
  misc_feature (37)..(37): n is a, c, t, g, unknown, or other
  misc_feature (108)..(108): n is a, c, t, g, unknown, or other
atgaaagtntgaaaatagctagtggattgagcggwsngcctctgcggtccgatagcgggttcgcatccggccatccgatactctgccagtkcggccgcgcggcgsggnatgcaaccacgcgcgcagaccgccgtcgccacctcctccctccctccgctccccggc

SEQ ID NO: 3430 - DNA, 439 bp, Zea mays
  misc_feature: Ceres CLONE 286807-F
  misc_feature: Encodes the peptide sequence at SEQ ID NO. 3431
actgcatcagagcacgaccacactacccacccacctccactactgaccgattcccagaaagctcgatctagcgcgcgcggctgcagagtgcagacgacgacgtacaccatggcgcggcggtccctggccctgctgctcgcgtcgtcgctcgccctcatgtcggccgccgtcgcatcggsactcgtggctctacgacaagttcaacacggacggcaccgtsscaacccagtacgacgcgtcggggcaggaggtggcgatgctcagcctggaccgcagctccggcgccggcttcaactccaaggagcagtacctgtacggcgagttcagcgtccagatgaagctcatccccggcaactccgccggcaccgtctcgtgcttctacctctcgtcgggcgacggcgacgggcacgacgagatcgacatggagttcatgggcaac

SEQ ID NO: 3431 - protein, 61 aa, Zea mays
  misc_feature: Ceres CLONE 286807-F
  misc_feature: SWISSPROT Homolog: EC 2.4.1.207 Xyloglucan:xyloglucosyl transferase
MLSLDRSSGAGFNSKEQYLYGEFSVQMKLIPGNSAGTVSCFYLSSGDGDGHDEIDMEFMGN

SEQ ID NO: 3432 - DNA, 492 bp, Zea mays
  misc_feature: Ceres CLONE 286847-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcggcaaggactacggtgaagaatctkagggccttaacatagtgcaggagt

SEQ ID NO: 3433 - DNA, 105 bp, Zea mays
  misc_feature: Ceres CLONE 286860-F
acacgcacaccgcgacccagtccagagccagtacgtgcgamrgccacgcacgctgctggtccgcgtacsagacgacggtcaggtcggccggtgcttttcagtttg

SEQ ID NO: 3434 - DNA, 416 bp, Zea mays
  misc_feature: Ceres CLONE 286861-F
  misc_feature: Encodes the peptide sequence at SEQ ID NO. 3435
  misc_feature (93)..(93): n is a, c, t, g, unknown, or other
  misc_feature (116)..(116): n is a, c, t, g, unknown, or other
  misc_feature (312)..(312): n is a, c, t, g, unknown, or other
  misc_feature (335)..(335): n is a, c, t, g, unknown, or other
akagaagacccgcctctcccgtgagccgtgacgcgacgccggatcgtcctcgtctcctagctcgtggaatgaagggaggtggcgtcatcaggnccgccggcggaggtgccgsgtgncgggtctgttgcgaacsgactgcggcttcccgtggtgctcctctcctgctccctcttcttcctcgccggcttcttcggctcgctcctcttcacccaggatccggagaggcggatatgccgttaccgagagagcggctgtttggaaggcggcgttgggcggagatgccttacggcgagtccggcgaggctgcgcgtnccttgatcccataccagattttnakctggcagcctcgtgctttgtactttccacaattttgcgacatcagaacagttgtgaaaatatagtaaaaacggcaaagg

SEQ ID NO: 3435 - protein, 110 aa, Zea mays
  misc_feature: Ceres CLONE 286861-F
  misc_feature (9)..(9): Xaa is any aa, unknown, or other
  misc_feature (15)..(15): Xaa is any aa, unknown, or other
  misc_feature (16)..(16): Xaa is any aa, unknown, or other
  misc_feature (22)..(22): Xaa is any aa, unknown, or other
  misc_feature (82)..(82): Xaa is any aa, unknown, or other
  misc_feature (89)..(89): Xaa is any aa, unknown, or other
  misc_feature (90)..(90): Xaa is any aa, unknown, or other
MKGGGVIRXAGGGAXXRVCCEXTAASRGAPLLLPLLPRRLLRLAPLHPGSGEADMPLPRERLFGRRRWAEMPYGESGEAARXLIPYQIXXWQPRALYFPQFCDIRTVVKI

SEQ ID NO: 3436 - DNA, 376 bp, Zea mays
  misc_feature: Ceres CLONE 286863-F
  misc_feature: Translation starting site: 137
  misc_feature (230)..(230): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggcgatggaagaagtcggtgacgaggtccgtgaaggccgggctccagttccccgtcggccgcatcgggcgctacctcaagaagggccgctacgcgcancgtcggcagcggttgcccccgtctacctcgcggccgtcctggagtacctcgccgctgaggtcctggagctcgccggcaacgctgccaaggacaacaagaagacgcgcatcgtcccgcgccacgtrctgctggcgatccgcaacgac

SEQ ID NO: 3437 - DNA, 597 bp, Zea mays
  misc_feature: Ceres CLONE 286866
  misc_feature: Encodes the peptide sequence at SEQ ID NO. 3438
cattcaatccggccgggccgcgcgcacgcgcaccaccggcacgcacatcaaatctcagccttcacccctctcacactgtcttcactcggttcgagcaaggggggcagcgagcgaagcggtaggtagcagcagtgtacgtgctgccgccaagctagtgccaatggcgagggcggtggcgatgctcgtggccctggcgctggtcgtggtggtggcggtggcgagcgcgggcggggcggcggcgcagcagtgcagcgcggcgcagctggcggcgtgcgccccggcgatcatcagcgggtcgccgcccacggcgtcgtgctgctccaacctgcgcgcgcaggagccgtgcttctgccagtacgcgcgcaacccggcgtacagcagctacatcaacagccccaacgcccgccgcacgctcgcctcctgcggcatcgccgtcccgagctgctaggcgctatagctccgcgtggtgtgggtgaataaaagatgcatgcatgtcgatctgtgcctactgttatcgtgtttgtgcctcgtgtgtaatatgaacaatatatatattatttaccaagagcggttgtgtcatgaaaaaaaaaaaaaaaa

SEQ ID NO: 3438 - protein, 95 aa, Zea mays
  misc_feature: Ceres CLONE 286866
  misc_feature (30)..(95): Pfam Name: Tryp_alpha_amyl Pfam Description: Protease inhibitor/seed storage/LTP family
MARAVAMLVALALVVVVAVASAGGAAAQQCSAAQLAACAPAIISGSPPTASCCSNLRAQEPCFCQYARNPAYSSYINSPNARRTLASCGIAVPSC

SEQ ID NO: 3439 - DNA, 493 bp, Zea mays
  misc_feature: Ceres CLONE 286875-F
  misc_feature: Encodes the peptide sequence at SEQ ID NO. 3440
attcgtcttgctccagccgccgtcggatcggatccgatcaaagcaagcagcagcagccggctccgctcccgcagcagccacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtccccctggcaatactgggcctggctgttgctgt

SEQ ID NO: 3440 - protein, 125 aa, Zea mays
  misc_feature: Ceres CLONE 286875-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPLAILGLAVA

SEQ ID NO: 3441 - DNA, 471 bp, Zea mays
  misc_feature: Ceres CLONE 286954-F
  misc_feature: Encodes the peptide sequence at SEQ ID NO. 3442
  misc_feature (21)..(21): n is a, c, t, g, unknown, or other
  misc_feature (78)..(78): n is a, c, t, g, unknown, or other
  misc_feature (94)..(94): n is a, c, t, g, unknown, or other
  misc_feature (245)..(245): n is a, c, t, g, unknown, or other
  misc_feature (436)..(436): n is a, c, t, g, unknown, or other
gagtaggagcaaccgcttgcntcagacgcacactgacggagagtgatcactgatttctggtcatggcaaccgtaactngraagttgctccggtngtcaccgtctccgaggagccggcgccggaagckgcaaggaggtggtggagaagccggagaggggaagaagcccgacgaggagggtgacgagaggaagaaggccgaccccgccgccgagaaggagaagawggckaggwagccgcggasaggnaagcccaagtycgccgggctgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaagtgctggcagtgcagctctcggtcttcscscanagggccgcctcgtcaaggtcaaggcttccttcaag

SEQ ID NO: 3442 - protein, 136 aa, Zea mays
  misc_feature: Ceres CLONE 286954-F
  misc_feature (6)..(6): Xaa is any aa, unknown, or other
  misc_feature (11)..(11): Xaa is any aa, unknown, or other
  misc_feature (22)..(22): Xaa is any aa, unknown, or other
  misc_feature (54)..(54): Xaa is any aa, unknown, or other
  misc_feature (57)..(57): Xaa is any aa, unknown, or other
  misc_feature (60)..(60): Xaa is any aa, unknown, or other
  misc_feature (65)..(65): Xaa is any aa, unknown, or other
  misc_feature (124)..(124): Xaa is any aa, unknown, or other
  misc_feature (125)..(125): Xaa is any aa, unknown, or other
MATVTXKLLRXSPSPRSRRRKXQGGGGEAGEGKKPDEEGDERKKADPAAEKEKXARXPRXGKPKXAGLHHPPYFEMIKEAILSQDGGKVGASPYAIAKHMGEKHRDVLPPNYRKCWQCSSRSSXXGPPRQGQGFLQ

SEQ ID NO: 3443 - DNA, 470 bp, Zea mays
  misc_feature: Ceres CLONE 286972-F
  misc_feature: Encodes the peptide sequence at SEQ ID NO. 3444
acagtcccactgcctctctctcgctctctcgtggctcgtggcttcctggcggcgactkggcgagcgccgccgcctcttcgtcgggcccgcccttcaccggcgacgtgcatccctctggagaagaatattgcgctcacataactgaataactgatattaggatgagtctctgtacaatagcacgacggctatgtctttcaaaaccatcctctggcagtcgtctttcagcaatttgggctcatctatacagcactgaggctgcaaaggacatgggtgctaagaagtacaagtaccccgatgtatacgacccctacggcctacgccgccgccttcggagaaagtcgtggaactagctgatcgcatcgctgctctccctcccgaggagatcaaacagattgctccagcccttctcctcagactgaaccaggagccgccacagsttattctggccagggtttcggtttcggtgcc

SEQ ID NO: 3444 - protein, 63 aa, Zea mays
  misc_feature: Ceres CLONE 286972-F
MSLCTIARRLCLSKPSSGSRLSAIWAHLYSTEAAKDMGAKKYKYPDVYDPYGLRRRLRRKSWN

SEQ ID NO: 3445 - DNA, 169 bp, Zea mays
  misc_feature: Ceres CLONE 286984-F
gatacagttcggattcagatcgcggccggtgcgaacccacgaaggcacgaacggtagaacccgaccgagcgcggcasmaaccctccgatccctgctgcgagcaaggatggccggcatgggcagtgctggcggcggtgctcgtcgcagcgcaggtggcttctgctgcgcc

SEQ ID NO: 3446 - DNA, 231 bp, Zea mays
  misc_feature: Ceres CLONE 286994-F
  misc_feature: Encodes the peptide sequence at SEQ ID NO. 3447
  misc_feature (168)..(168): n is a, c, t, g, unknown, or other
attttccccttccccgcaccgcaccgcaccgcacccaacccccgtcggagagagagatggcatcggtggcggagatgcagcccctcgcgccggcggggtaccgcggctcgggagatgaaggagaaggtggaggcgtcggtggtggacctggaggccgggaccgggganacgctgttacccggggatctcgcgcggggagagcgccctccgatggggyttcgtccgcaagtt

SEQ ID NO: 3447 - protein, 39 aa, Zea mays
  misc_feature: Ceres CLONE 286994-F
  misc_feature (18)..(18): Xaa is any aa, unknown, or other
  misc_feature (35)..(35): Xaa is any aa, unknown, or other
MKEKVEASVVDLEAGTGXTLLPGDLARGERPPMGXRPQV

SEQ ID NO: 3448 - DNA, 141 bp, Zea mays
  misc_feature: Ceres CLONE 287002-F
atcgcctccacgaacaaaccacacaccccacctaccccggccggaccgcagcagcacaacatggacctcgccctcctggagawggccctgctgggctktttcgccgcggctgtggtggccatcgccgtggccaagctgagc

SEQ ID NO: 3449 - DNA, 119 bp, Zea mays
  misc_feature: Ceres CLONE 287046-F
  misc_feature (69)..(69): n is a, c, t, g, unknown, or other
acacgcacaccgcgacccagtccagagccagtacgtgcgamggccacgcacgctgctggtccgcgtacnagacgacggtcaggtcggccggtgcattttcagtttggaataatgacggc

SEQ ID NO: 3450 - DNA, 471 bp, Zea mays
  misc_feature: Ceres CLONE 287072-F
  misc_feature: Encodes the peptide sequence at SEQ ID NO. 3451
ctcgccgcccccgtctcctctcctctcctctcctccgcatccacggccgcargcagccagccactcgacgatctagtcgtctctctctccccgctctgccgcctcgctgccgcggcttcccgtcggctggaggatgaaggtcacggtcgtgtcccggagcggccgggagggtcgtcaagggcggcatcgacctcaaggactcggccaaggtcgcggacctgcaggaggccatccatgccaagactaagaagtattatccttctaggcagcggctcaccctccccctttcaacctggaaaaggcgggaagcagtttktcctcagtccaaaggccagcctgctagaatactgcgagaagggttctggggtcactgacagtggtcttcaaagatttagggccacaggtctactacagcacactgttcttcttcgagtacctgggtcctcttcatcatctaccccatgttctact

SEQ ID NO: 3451 - protein, 79 aa, Zea mays
  misc_feature: Ceres CLONE 287072-F
  misc_feature (28)..(28): Xaa is any aa, unknown, or other
MPRLRSIILLGSGSPSPFQPGKGGKQFXLSPKASLLEYCEKGSGVTDSGLQRFRATGLLQHTVLLRVPGSSSSSTPCST

SEQ ID NO: 3452 - DNA, 117 bp, Zea mays
  misc_feature: Ceres CLONE 287103-F
acacgcacaccgcgacccagtccagagccagtacgtgcgamggcacgcacgctgctggtccgcgtacsagaygacggtcaggtcggccggtgcttttcagtttggaataatgacggc

SEQ ID NO: 3453 - DNA, 114 bp, Zea mays; identical to SEQ ID NO: 3239
  misc_feature: Ceres CLONE 287140-F

SEQ ID NO: 3454 - DNA, 393 bp, Zea mays
  misc_feature: Ceres CLONE 287157-F
  misc_feature (392)..(392): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggcgaggaagaagtcggtgacgaggtccgtgaaggccgggctccagttccccgtcggccacatcgggcgctacctcaagaagggccgctacgcgcascgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggacctcgggaatctnc

SEQ ID NO: 3455 - DNA, 454 bp, Zea mays
  misc_feature: Ceres CLONE 287190-F
  misc_feature: Translation starting site: 213
  misc_feature: SWISSPROT Homolog: EC 3.4.25.1 Proteasome endopeptidase complex
  misc_feature (147)..(147): n is a, c, t, g, unknown, or other
  misc_feature (337)..(337): n is a, c, t, g, unknown, or other
  misc_feature (386)..(386): n is a, c, t, g, unknown, or other
gaataatcactcttctccgttcacaccctgtgcgcgcgggctctcttcgtcgtgcggcaactgcgcgaccgccgacgcccgacggcaggtgcaccaggtcttcgtcgaccccttcgcaaggyctcggttccatccttcgccggascncgcccgtcaacaggacttgatctactactcactagcggtgtagaggtgaagataagaacttgaccatgagcagcataggcacaggttatgatttgtctgtcacgaccttctccccagatggtcgtgtcttccaggtcgattatcccaccaaggccktcgacaacagcgggactattgttgggatcaagtncaaakatggcattctcctgggtgtcgagaagctggtaacctcaaagatnatgctggaaggatcaaaccgaagatccattcggtgcaccgtcactctggcttggctgttgctggttta

SEQ ID NO: 3456 - DNA, 413 bp, Zea mays
  misc_feature: Ceres CLONE 287266-F
  misc_feature: Encodes the peptide sequence at SEQ ID NO. 3457
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (411)..(411): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcannntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctkgcgcaggaggggctgccgacgatgaatcagcgtctggacatctcgaacgcggcggtnac

SEQ ID NO: 3457 - protein, 109 aa, Zea mays
  misc_feature: Ceres CLONE 287266-F
  misc_feature (10)..(109): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLDISNAAV

SEQ ID NO: 3458 - DNA, 472 bp, Zea mays
  misc_feature: Ceres CLONE 287278-F
  misc_feature: Encodes the peptide sequence at SEQ ID NO. 3459
gttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttg

SEQ ID NO: 3459 - protein, 130 aa, Zea mays
  misc_feature: Ceres CLONE 287278-F
  misc_feature (15)..(130): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGL

SEQ ID NO: 3460 - DNA, 423 bp, Zea mays
  misc_feature: Ceres CLONE 287300-F
  misc_feature: Encodes the peptide sequence at SEQ ID NO. 3461
  misc_feature (290)..(290): n is a, c, t, g, unknown, or other
atccaattcacaggctcaccacaccaaccagcaagcaaaaattccccaatcctctcgtctccgcggcgaagatgtcggggcgcggcaagggcggcaagggcctgggcaagggcggcgcgamstcaccggaaggtctgcgcgacaacatccaggggatcacgaagccggcgatccggagctggcgcggcggggcggcgtgaassatctcggggctcatctacgaggagacccgcggcgtgctcaagatcttcctggagaacgtcatccgcgacgccgtcacctacaccgancacgcgcgccgtaagaccgtcaccgccatggacgtcgtctacgcccttaagcgccagggkccgcaccctctatggcttcggcggctaggtctgccgcggccgcgcctcgcctcgccgttggtgcggtttctgg

SEQ ID NO: 3461 - protein, 42 aa, Zea mays; identical to SEQ ID NO: 3268
  misc_feature: Ceres CLONE 287300-F
  misc_feature (17)..(17): Xaa is any aa, unknown, or other

SEQ ID NO: 3462 - DNA, 459 bp, Zea mays
  misc_feature: Ceres CLONE 287303-F
  misc_feature (164)..(164): n is a, c, t, g, unknown, or other
  misc_feature (170)..(170): n is a, c, t, g, unknown, or other
  misc_feature (444)..(444): n is a, c, t, g, unknown, or other
  misc_feature (453)..(453): n is a, c, t, g, unknown, or other
gtccattctgaagtccggcggcggcggcasggcgagggcgaggcctctgcgacttccagatctccccgacgaggaggaagtctctacagcggaggggagggagatgtcgtacatgcggggtgacctgctgacgaggatgcggaastggtgaagggcctcgccangccgangccccggtggctcaaggccttggaacgggctccgcagttkacatttcctcgcccagaggggaagatcaagaatctggtgcttcctgaggatgtgtatgtcaggaagttcaacagaatacatccagattcgctttacsatgatgcaatcaagataagtggatttgatccaccgccagctcgagtgtttgcttggcgtgtcctggagttgaaagagcaaggagtcgatgaagatgttgcgatggctgtagcagataacgagtaccggacagagaanaaggcaaanaagaaa

SEQ ID NO: 3463 - DNA, 210 bp, Zea mays
  misc_feature: Ceres CLONE 287320-F
  misc_feature (120)..(120): n is a, c, t, g, unknown, or other
  misc_feature (137)..(137): n is a, c, t, g, unknown, or other
  misc_feature (138)..(138): n is a, c, t, g, unknown, or other
ctgcaagartggatcgcgagacccaagtagagtagaccaaagacaaaggaaagcgaggccaccatcccccaaacccgtgagaaatcgaatcgagaagggaagagcacgcgccgtcgccancaccgcgttccgccaknnccgcctcctccccccgcgcgttgcaatcgctggggtccgcccgcctcccgcttcctccacgcgcggggcttc

SEQ ID NO: 3464 - DNA, 427 bp, Zea mays
  misc_feature: Ceres CLONE 287323-F
  misc_feature: Encodes the peptide sequence at SEQ ID NO. 3465
  misc_feature (56)..(56): n is a, c, t, g, unknown, or other
  misc_feature (96)..(96): n is a, c, t, g, unknown, or other
  misc_feature (97)..(97): n is a, c, t, g, unknown, or other
  misc_feature (168)..(168): n is a, c, t, g, unknown, or other
actcgaaaagaaaactagccgggcaagttacgcccaccaccataccgtcccacgyngcctcccaaactaaccgtatcccccggygacygggaaacnncaaccgatggaccgcctcgtcgtcttctcccggcgccgccgccgcttggatcctcctcgctgcggccggtncggcggcggcctcggcgcgtacaagatctaccaccaccctgccgtcgckkaacgtcgccgccgcctcgtgcgcctatccgccgccatcgcgscttcgctgatgccgccgcatcatccgccgacgccgtggccctggtgacatccgatctcgccgactttktccattccgacgcggacgaggtcccccgcagcgtcaacatctggccaatctcgccgcctcccctraggtatccgccaccgtctccaccctatccgaggc

SEQ ID NO: 3465 - protein, 67 aa, Zea mays
  misc_feature: Ceres CLONE 287323-F
  misc_feature (22)..(22): Xaa is any aa, unknown, or other
  misc_feature (39)..(39): Xaa is any aa, unknown, or other
  misc_feature (53)..(53): Xaa is any aa, unknown, or other
MDRLVVFSRRRRRLDPPRCGRXGGGLGAYKIYHHPAVAXRRRRLVRLSAAIAXSLMPPHHPPTPWPW

SEQ ID NO: 3466 - DNA, 433 bp, Zea mays
  misc_feature: Ceres CLONE 287338-F
  misc_feature: Translation starting site: 205
  misc_feature (154)..(154): n is a, c, t, g, unknown, or other
  misc_feature (161)..(161): n is a, c, t, g, unknown, or other
  misc_feature (227)..(227): n is a, c, t, g, unknown, or other
  misc_feature (285)..(285): n is a, c, t, g, unknown, or other
  misc_feature (295)..(295): n is a, c, t, g, unknown, or other
  misc_feature (305)..(305): n is a, c, t, g, unknown, or other
  misc_feature (378)..(378): n is a, c, t, g, unknown, or other
  misc_feature (406)..(406): n is a, c, t, g, unknown, or other
gttcccgtctctcttccccgtcctgcaggctccaggcgctgctgctctcgtcctccgctagcgagcgaatcgctgacgctggcccgacgccgcggsggaggtatctcgctttcgatcaggttcacggccgaattcgctgctgcgtggggctttngagattngagccgattccttaaagtggcggtggcagcgtctggtgggaacatgagcttcgtgttccgaggaancagggccgacatcgaggccggtggcttcacagggttcgcccccgatcgccgcaccatncgaattcatncagggaycangccggtgaatagcaattccttggttttksttctaactgttcttgttttgttcatggtactgaactcacaccanatgtctcccaatcttttgctttggatantcttgggagtcttcctaatggccacga

SEQ ID NO: 3467 - DNA, 371 bp, Zea mays
  misc_feature: Ceres CLONE 287341-F
  misc_feature: Translation starting site: 75
  misc_feature: SWISSPROT Homolog: EC 3.4.25.1 Proteasome endopeptidase complex
  misc_feature (221)..(221): n is a, c, t, g, unknown, or other
aaacacgcacaggcgcacagcacacgaacacacaccgcgcccagctccgaggtgatcttccggcggccggcgagatgagccgtggcacaggcgcgggctatgaccgccacatcaccatcttctcccccgagggacgcctgtaccaagtcgagtacgcgttcaaggcggtgaagtcggcgggtgtcacgtcgatcggcgtccgcggcgsmccgtctgcgttnttacgcraagaaagtcccggataagttgctggatcagacgagcgttacacaccttttcccgatcaccaattacgtcggattacttccactagccttacagctgatgctaggtcattggtttcccaatcaaggaataaagcagctgagttt

SEQ ID NO: 3468 - DNA, 437 bp, Zea mays
  misc_feature: Ceres CLONE 287348-F
  misc_feature: Translation starting site: 137
  misc_feature (64)..(64): n is a, c, t, g, unknown, or other
  misc_feature (66)..(66): n is a, c, t, g, unknown, or other
  misc_feature (124)..(124): n is a, c, t, g, unknown, or other
  misc_feature (196)..(196): n is a, c, t, g, unknown, or other
  misc_feature (266)..(266): n is a, c, t, g, unknown, or other
  misc_feature (304)..(304): n is a, c, t, g, unknown, or other
  misc_feature (346)..(346): n is a, c, t, g, unknown, or other
  misc_feature (355)..(355): n is a, c, t, g, unknown, or other
  misc_feature (369)..(369): n is a, c, t, g, unknown, or other
  misc_feature (420)..(420): n is a, c, t, g, unknown, or other
aattcactttccaagttgtccgaaaagaccagactaccctgttcccccgaagtcagaggggganangaggctagggatagagcagcgtcatcgcaccgctcgccggcgagccagatcatcagtnaggaaggcagcgatggcggtggtggagctgtgggagacgctgaagcaggcgatcgttgcgtacacgggcctntctccggcggccttcttcacggctgtggcggtggcggccgctctgtaccacgttgtgtcggggctcttcncggccccgcccccgccgccgccgcgcccacgggaggancccgakacagagccgctccctcctcccgtgcagattggggangtctccgangagacctccgccantacgacggctccgaccctaagaagccgctcctcattgccatcaagggccanatctacgacgtcaccca

SEQ ID NO: 3469 - DNA, 378 bp, Zea mays
  misc_feature: Ceres CLONE 287358-F
  misc_feature: Encodes the peptide sequence at SEQ ID NO. 3470
  misc_feature (134)..(134): n is a, c, t, g, unknown, or other
  misc_feature (269)..(269): n is a, c, t, g, unknown, or other
  misc_feature (295)..(295): n is a, c, t, g, unknown, or other
  misc_feature (337)..(337): n is a, c, t, g, unknown, or other
  misc_feature (345)..(345): n is a, c, t, g, unknown, or other
  misc_feature (364)..(364): n is a, c, t, g, unknown, or other
  misc_feature (373)..(373): n is a, c, t, g, unknown, or other
atcaacaacgatcgtstgctctgcttgtgctgcatatattatatatatggtgaaggagccgcgtcatatgatggtcatcaacaccagcaggctactactgaccctgctgctgctggaattcgccgcggtgggtnccggccatggccagcacggtggtggccggcatggtgttctgcgatcagtgcaaggacggcgccaagggactcttcgactacccgctctacggcgcccgcgtggccatccagtgcggcggcggcgacaccccgctnacggtgcgggagagcaacaccaactngttcggcggcttctccgtccgcatgagggctccccggacatnaaccgctncacggcgcgcgtcgtccangggacgggnccact

SEQ ID NO: 3470 - protein, 79 aa, Zea mays
  misc_feature: Ceres CLONE 287358-F
  misc_feature (52)..(52): Xaa is any aa, unknown, or other
  misc_feature (66)..(66): Xaa is any aa, unknown, or other
  misc_feature (69)..(69): Xaa is any aa, unknown, or other
  misc_feature (75)..(75): Xaa is any aa, unknown, or other
  misc_feature (78)..(78): Xaa is any aa, unknown, or other
MASTVVAGMVFCDQCKDGAKGLFDYPLYGARVAIQCGGGDTPLTVRESNTNXFGGFSVRMRAPRTXTAXRRASSXGRXH

SEQ ID NO: 3471 - DNA, 172 bp, Zea mays
  misc_feature: Ceres CLONE 287364-F
ctcttccccccactacccaaacccaacaggcggcgcmagcatcgccaccaccgtccaaagatggtgaagttcctcaagcccggcaaggcgttatcctcctccagggccggttcgccggcggaagytgtattcgtgcgcgttttcgaggagggcacccgtgatcgtccctacg

SEQ ID NO: 3472 - DNA, 376 bp, Zea mays
  misc_feature: Ceres CLONE 287366-F
aaccctagccgcactggctcatttctgcatccccctcccgccgcgccgcctcaccgccgccggagaagatgggtcgcgtgatccgcgcgcastaaagggtgcggggtccgtgttcaagtcccacacccaccaccgcaaggccccgccgcttccgctccctcgacttcggcgagcgcaacgggtacctcaagggcgtcgtcaccgagttcatccacgaccccgggccgtggcgcgccgctcgccaaggtcactttccgccacccattcaggtacaagcaccaaaaggagctctttgtcgcagccgaggggcattatacacggggccagttcgtctactgcggttcgccgcgccaccctctccatcgggcaacgtgct

SEQ ID NO: 3473 - DNA, 254 bp, Zea mays
  misc_feature: Ceres CLONE 287378-F
  misc_feature (165)..(165): n is a, c, t, g, unknown, or other
  misc_feature (219)..(219): n is a, c, t, g, unknown, or other
aaagataaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcgggsnaagcccaacgccaagaactcccaggacgggctcaccccggagcagcgccgcganagggacaagaaagctctggaggagaaggcggccaa

SEQ ID NO: 3474 - DNA, 268 bp, Zea mays
  misc_feature: Ceres CLONE 287411-F
  misc_feature (195)..(195): n is a, c, t, g, unknown, or other
tcctatcgcactcgcgtctctttcctattcgcgccgccgccgctgctgcaasgccactccgccgtcgtccgaatagtacactctaacgccgccatggggcgtatgcacagccgcgggaagggtatctcgtcgtcggcgctgcgtacaagaggacgcctcctacctggctgaagaccgccgcctccgacgtggagnagatgatcacaaaggcagcgaagaagggacagatgccgttcgcagatcggcgtccctgctccgtgaccagcac

SEQ ID NO: 3475 - DNA, 477 bp, Zea mays
  misc_feature: Ceres CLONE 287440-F
  misc_feature: Encodes the peptide sequence at SEQ ID NO. 3476
  misc_feature (18)..(18): n is a, c, t, g, unknown, or other
  misc_feature (19)..(19): n is a, c, t, g, unknown, or other
caccgcagccctagcgcnnctccaccttcaccttcccaggccgccgccgccgccgcctccattgctgctaaacccgcaaccatgggtcccgtgctgaagcgcccgaccccggcacgtgcagtgcttcgggcgcaagaagacggccgtggcgtgggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcgcggcggggaagacgtcgcagatctacgccatccgccaggccgtcgccaagggtctcgtggcctactaccagaagtacgtggacgaggcggcgaaaaaggagatcaaggacatcttcatgcgctacgagcgcaccctcctcgtcgccgacccccgccgctgskagcccaa

SEQ ID NO: 3476 - protein, 99 aa, Zea mays
  misc_feature: Ceres CLONE 287440-F
  misc_feature (1)..(96): Pfam Name: Ribosomal_S9 Pfam Description: Ribosomal protein S9/S16
  misc_feature (97)..(97): Xaa is any aa, unknown, or other
  misc_feature (98)..(98): Xaa is any aa, unknown, or other
MIKVNGVPIELLRPEMLRLKAMEPVLLAGRSRFKDIDMRIRVRAAGKTSQIYAIRQAVAKGLVAYYQKYVDEAAKKEIKDIFMRYERTLLVADPRRXXP

SEQ ID NO: 3477 - DNA, 813 bp, Zea mays
  misc_feature: Ceres CLONE 287441-R2
  misc_feature: Pfam Name: PsbY Pfam Description: Photosystem II protein Y (PsbY)
  misc_feature (695)..(695): n is a, c, t, g, unknown, or other
  misc_feature (813)..(813): n is a, c, t, g, unknown, or other
cgattgggtaccgggccccccctcgaggtcgacggtatcgataagcttttttttttttttttttgatcaaccaaccacgtgcttcacgtctactacgcacgccgcggatacggaaacggacagctagcttcagtcggaccgcatgcggttgagctggttcagcgccggctggaggatgttgaagagcacccagccgatggcgggcgcgacgacgatgagcaggaggaggccgcggctgtcctcggcgggcgcggcggcggcgattgctgccaggtcctgcaccacgggggtggaggcctcgggcggggccgccatcccggcaggtgccgcccccatgcccagcgtctgcgtcacagcctgggtgttcgcgcttgctgtttgtctcgttggccatcgggtccatgatgttgatggtgatccccccccctgccgccccccgccccgacaagggtcgtgctgggccccggcatggagccgcccaggggtccgtcgtcctcaccgtaccccgccttgccccctgtcaaggctaaccaccccaagtctcccctaagaagagacacccgccaggccccgcacgaatccggtaacccgggaaacccgtattcctttatggagttcccttggcccgagttcgggaaccccccatgcgacacccagcctcgccaccttttgccctgtgattattattttccccnccgcgctttgtccgcgccgtcttcaaacgcgttccccccctcgaccatgggtctcccccggacacacatctgtgcagtaagccttggactttacgattgccaagggcgacgacaagan

SEQ ID NO: 3478 - DNA, 401 bp, Zea mays
  misc_feature: Ceres CLONE 287441-R
  misc_feature: Encodes the peptide sequence at SEQ ID NO. 3479
  misc_feature (115)..(115): n is a, c, t, g, unknown, or other
ctcgtcgtggtggcgcccgchatcgggtgggtgctgtammaacatcctgmcasccggygytgaaccasytgaaccgcatgsgcagscagccaggccgtgccgytggcctgggccnthggcgccgccgccgccgggatggcggccccgcccgaggchtccgccgccgtggtgcaggacctcgcagcaatcgccgccgccgcgcccgccgacgacagccgcggcctcctcctgctcatcgtcgtcgcgcccgccatcggctgggtgctcttcaacatcctccagccggcgctgaaccagctcaaccgcatgcggtccgactgaagctagcgtccgtttccgtatccgcggcgtgcgttgtagacgtgaagcacgtggttggttgatcaaaaaaaaaaaaaaaa

SEQ ID NO: 3479 - protein, 61 aa, Zea mays
  misc_feature: Ceres CLONE 287441-R
  misc_feature (26)..(60): Pfam Name: PsbY Pfam Description: Photosystem II protein Y (PsbY)
MAAPPEASAAVVQDLAAIAAAAPADDSRGLLLLIVVAPAIGWVLFNILQPALNQLNRMRSD

SEQ ID NO: 3480 - DNA, 416 bp, Zea mays
  misc_feature: Ceres CLONE 287450-F
  misc_feature: Translation starting site: 48
  misc_feature (93)..(93): n is a, c, t, g, unknown, or other
gatctgagatcgacatcgatccaccgaggtttcttgtgcgtgccgccatggccatggcagtagctcaccttcttcctcagctctccgccgamnatggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccactcgccgccgctcgcgcgtcgggcttctacctggcgccgtccgccacgtccagcatggacccgccgtcgtcggggacatggtcggcacgttgtgggcgcgcacgggctgcgtggccgaccccgccaccgggcgctttctcctgcgccacggccgactgcggcacgggcgacgtcgcgtg

SEQ ID NO: 3481 - DNA, 478 bp, Zea mays
  misc_feature: Ceres CLONE 287461-F
  misc_feature: Encodes the peptide sequence at SEQ ID NO. 3482
  misc_feature (300)..(300): n is a, c, t, g, unknown, or other
  misc_feature (344)..(344): n is a, c, t, g, unknown, or other
  misc_feature (422)..(422): n is a, c, t, g, unknown, or other
aaaaacgcgsmgaccacaaacacacaccagcccagctccgagagatcatccggcggccggcgagatgagccgcggcacgggcgcgggttatgaccgccacatcaccattttctcccctgagggacgcctgtaccaagtcgagtacgcgttcaaggcggtgaagtcggcgggtgtcacgtcgatcggcgtccgcggcgsatccgtctgcgtcgtcacccagaagaaagtcccggacaagttgctggatcagacgagcgtgacacacttkttccccgatcaccaagtacgtcggattgcttnccactggcctcacaggctgatgcaaggtcattgggtttcccaancaaggaacgaagcagctgagtttcgtttcaaatgggggctatgagatgccagttgatgtgttagcaaaatgggattgnctgacaaagctcaagtttacacgcaacatgcatacatgagacccctttggagtagt

SEQ ID NO: 3482 - protein, 107 aa, Zea mays
  misc_feature: Ceres CLONE 287461-F
  misc_feature: SWISSPROT Homolog: EC 3.4.25.1 Proteasome endopeptidase complex
  misc_feature (45)..(45): Xaa is any aa, unknown, or other
  misc_feature (68)..(68): Xaa is any aa, unknown, or other
  misc_feature (79)..(79): Xaa is any aa, unknown, or other
  misc_feature (94)..(94): Xaa is any aa, unknown, or other
MSRGTGAGYDRHITIFSPEGRLYQVEYAFKAVKSAGVTSIGVRGXSVCVVTQKKVPDKLLDQTSVTHXFPDHQVRRIAXHWPHRLMQGHWVSQXRNEAAEFRFKWGL

SEQ ID NO: 3483 - DNA, 384 bp, Zea mays
  misc_feature: Ceres CLONE 287468-F
  misc_feature: Encodes the peptide sequence at SEQ ID NO. 3484
  misc_feature (300)..(300): n is a, c, t, g, unknown, or other
  misc_feature (301)..(301): n is a, c, t, g, unknown, or other
cccttttccttcctcttcgccccagcgacgcgccgcccggaktayykatcgaggcaggcaactaaccaccgagaggcagggacaggaacaggaagccggavaagatgtcgtcggtgttcagcggcgatgagacggcccccttcttcggcttcctcggcgccgccgccgccctcgtcttctcatgcatgggcgccgcgtacgggaccgcgaagagcgcgtcggcgtggcgtcgatgggtgtratgcgggccggagctcgtcatgaagtccatcgtgcccgtggtcatggctggtgwrctcnntatctacgggctcatcatcgccgtcatcattagcacggggatcaaccccaaggccaagccctactacctctttgatggctacg

SEQ ID NO: 3484 - protein, 45 aa, Zea mays
  misc_feature: Ceres CLONE 287468-F
  misc_feature: SWISSPROT Homolog: EC 3.6.3.14 H(+)-transporting two-sector ATPase
MSSVFSGDETAPFFGFLGAAAALVFSCMGAAYGTAKSASAWRRWV

SEQ ID NO: 3485 - DNA, 144 bp, Zea mays
  misc_feature: Ceres CLONE 287531-F
accaggcaccagcatagatctcgttctcgccactattattctgcacagcaacgcatcaagccttctagaaccatctcgccgccgccacaccacaacccgtcgaagcgacgaagcaatggccggagtcggatcgaaggcccttgc

SEQ ID NO: 3486 - DNA, 444 bp, Zea mays
  misc_feature: Ceres CLONE 287557-F
  misc_feature: Encodes the peptide sequence at SEQ ID NO. 3487
  misc_feature (50)..(50): n is a, c, t, g, unknown, or other
abtgcgactgtkagcttcgttcgttcagttcatccgtgttcttgtttgcnaggtcgagagagagaggatgtcgtgctgcggaggcaactgtgggtgcggctccggctgcaagtkcggcaacggctgcggagggtgcagcaagatgtacccggacatggctgagcaggtgaccaccaccacccaggctctcatcatgggtgtcgcaccatccaaggggcacgccgagggsggttcgaggcggccgccgatgctgagaacggcgggtgcaagtkcggcggcaactgccagtgcgacccctgcaactgcggcaagttgagctaggtgctccaccctgcaggccggccggagaagctagctaattattataagctaaataaagtatagcggcgtcgctgtgtgtgtttcgagtcagtcagttagttgcgtgccattgctggcatgctc

SEQ ID NO: 3487 - protein, 82 aa, Zea mays
  misc_feature: Ceres CLONE 287557-F
  misc_feature (1)..(68): Pfam Name: Metallothio_2 Pfam Description: Metallothionein
  misc_feature (16)..(16): Xaa is any aa, unknown, or other
  misc_feature (69)..(69): Xaa is any aa, unknown, or other
MSCCGGNCGCGSGCKXGNGCGGCSKMYPDMAEQVTTTTQALIMGVAPSKGHAEGGSRRPPMLRTAGASXAATASATPATAAS

SEQ ID NO: 3488 - DNA, 111 bp, Zea mays
  misc_feature: Ceres CLONE 287570-F
acacgcacaccgcgacccagtccagagccagtacgtgcgamgcacgcacgctgctggtccgcgtacgagacgacggtcaggtcggccggtgcttttcagtttggaataatg

SEQ ID NO: 3489 - DNA, 233 bp, Zea mays
  misc_feature: Ceres CLONE 287592-F
  misc_feature: Encodes the peptide sequence at SEQ ID NO. 3490
  misc_feature (177)..(177): n is a, c, t, g, unknown, or other
attccccaaaaccaaaataatcgccaccgctctccgcaccgaaccgaagcagcggcgatgtcggcggagaagccggctcccgtgcgcgtgctctactgcggcgtctgcggcctcccggcgaagtactgcgagttcggccccgacttcgagcgctgcaascctggctgcgcgcgcacncggcgtctaccccgacgaccttgtsgccgcctcctcctcacccggcggcggcgaca

SEQ ID NO: 3490 - protein, 58 aa, Zea mays
  misc_feature: Ceres CLONE 287592-F
  misc_feature (34)..(34): Xaa is any aa, unknown, or other
  misc_feature (49)..(49): Xaa is any aa, unknown, or other
MSAEKPAPVRVLYCGVCGLPAKYCEFGPDFERCXPGCARTRRLPRRPCXRLLLTRRRR

SEQ ID NO: 3491 - DNA, 427 bp, Zea mays
  misc_feature: Ceres CLONE 287595-F
  misc_feature: Encodes the peptide sequence at SEQ ID NO. 3492
  misc_feature (345)..(345): n is a, c, t, g, unknown, or other
  misc_feature (387)..(387): n is a, c, t, g, unknown, or other
cgtcacagcgagtaccgagtaggagcaaccgcttgsktcagacgcacactgacggagagtgatcactgatttctggtcatggcaaccgtaactgaggaagttgctccggtcgtcaccgtctccgaggagccggcgccggaagctggcaaggaggtggtggagaagccggagaggggaagawagcccgacgaggagggtgacgagaggaagaaggccgaccccgccgccgagaaggagaagaaggcgaggtaagccgcggasaggaagcccaaktccgccgggctgcaccacccgccctatttcgagatgatcaaggaggcgatcctgtcgcaggacggcgggaangtcggggcgagcccgtacgcgatcgccaagcacatggggganaagcaccgggacgtgctcccgcccaattaccgcaagtgct

SEQ ID NO: 3492 - protein, 57 aa, Zea mays
  misc_feature: Ceres CLONE 287595-F
  misc_feature (35)..(35): Xaa is any aa, unknown, or other
MATVTEEVAPVVTVSEEPAPEAGKEVVEKPERGRXPDEEGDERKKADPAAEKEKKAR

SEQ ID NO: 3493 - DNA, 486 bp, Zea mays
  misc_feature: Ceres CLONE 287615-F
  misc_feature: Translation starting site: 205
  misc_feature: Pfam Name: UPF0004 Pfam Description: Uncharacterized protein family UPF0004
ctgccgcatcagactagcgagccaagccaccgacggccgacgtcgagcctccgcggccgagcctccgcctagcaccaactccgtcgtcgatcgtcctatgcgaccacgccctcgtccgccttccgtctcctgcctccactgagtcgcgggcgcgaatcggggaacgccaaggctgagcttcgcccagacgcttaccgccctgttatgccccgaaccgccgtgctgaggtccgcccaggtcgggccaggagcttctcccggcagacccacccccgcccaacggagctccatgcctccgcctagggccattgtccgagctacccccacgctcctgtccagtgccctggccacttagatggttctgctcagtcatggtatttttagtgtctggttcaacaacttcaacttcaaccaagggacgcatctatcacaagacgtatggttgccaaatgaatataagtgacatggagattgtgctttctatcat

SEQ ID NO: 3494 - DNA, 500 bp, Zea mays
  misc_feature: Ceres CLONE 287651-F
  misc_feature: Translation starting site: 180
cctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtaaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgagggccttaacatagtgcaggagttatgtc

SEQ ID NO: 3495 - DNA, 124 bp, Zea mays
  misc_feature: Ceres CLONE 287702-F
  misc_feature (67)..(67): n is a, c, t, g, unknown, or other
atccatcacagctagctagcatacagacgaataatctcttcttcacctcacttaacaccagctakgnaactctttctctcctgcaataatggccgctcgctcctcctcctcccagccgcagctg

SEQ ID NO: 3496 - DNA, 474 bp, Zea mays
  misc_feature: Ceres CLONE 287730-F
  misc_feature: Encodes the peptide sequence at SEQ ID NO. 3497
  misc_feature (96)..(96): n is a, c, t, g, unknown, or other
  misc_feature (415)..(415): n is a, c, t, g, unknown, or other
  misc_feature (438)..(438): n is a, c, t, g, unknown, or other
gcatcgctccctctcagcttcctcattggccatccttcgtcttccatggagaggctccttgccggcctactactcggcttcctattattgatcgcntcagtaggaagccatgcaactygtgctccagatcagtactggaagtytgctcttcccgacactcccatgccgagctccctctcccaactcctcaacaccccagctggcaagggcggcgtcggtggaggcagcagcggcaagaagcccggcgcaccacggtgggagttgggaaagggggagtgggcgttaacgttaaccctaccaaacccggcggcgsgtgacaaccgttggcgttggcaaaggtggcgtcggcgtcggcgtcaatcccgggtacgcaagccgggtggcaccacggtgggcgttagcaatggcagggttngcgtccacgtgaacccgggcaanaagccgttccacgtccccgtcggccctttccagtac

SEQ ID NO: 3497 - protein, 143 aa, Zea mays
  misc_feature: Ceres CLONE 287730-F
  misc_feature (25)..(25): Xaa is any aa, unknown, or other
  misc_feature (33)..(33): Xaa is any aa, unknown, or other
  misc_feature (90)..(90): Xaa is any aa, unknown, or other
  misc_feature (124)..(124): Xaa is any aa, unknown, or other
  misc_feature (131)..(131): Xaa is any aa, unknown, or other
MERLLAGLLLGFLLLIASVGSHATXAPDQYWKXALPDTPMPSSLSQLLNTPAGKGGVGGGSSGKKPGAPRWELGKGEWALTLTLPNPAAXDNRWRWQRWRRRRRQSRVRKPGGTTVGVSNGRVXVHVNPGXKPFHVPVGPFQY

SEQ ID NO: 3498 - DNA, 482 bp, Zea mays
  misc_feature: Ceres CLONE 287766-F
  misc_feature: Encodes the peptide sequence at SEQ ID NO. 3499
ctcgactcccacaacacggtccgtacggtaaagagagagaaggtgggagtggaatcgacaggggaaaaccaaagcctgcgtttcagagacaactcaggcggcgcgatggcgatggcggcgctgcgacsgaggggaggcgcctcctcctctcccccaccgtccccaacccgtcttcggcggccgcttccgctgcggtgacsgatcctccgccatgtcgcaaccggagatggctccacttggtgcacgttctatttcaactcaagttgtgaggaaccggatgaagagtatcaaaaacatccagaagatcacaaaggctatgaagatggttgcagcatcaaagcttcgggctgttcagacgaggactgaaaattcacgcggcttgtggcagccgttcaccgcccttcttggggacgctcctagtgttgatgtcaagaagaatgtgattgtggccattacctctgataagggactctgtggtggta

SEQ ID NO: 3499 - protein, 90 aa, Zea mays
  misc_feature: Ceres CLONE 287766-F
  misc_feature: SWISSPROT Homolog: EC 3.6.3.14 H(+)-transporting two-sector ATPase
MSQPEMAPLGARSISTQVVRNRMKSIKNIQKITKAMKMVAASKLRAVQTRTENSRGLWQPFTALLGDAPSVDVKKNVIVAITSDKGLCGG

SEQ ID NO: 3500 - DNA, 148 bp, Zea mays
  misc_feature: Ceres CLONE 287771-F
  misc_feature: Encodes the peptide sequence at SEQ ID NO. 3501
atctagaagcaccactcaacaaaccctaggttgcctgatcggctgatcgctccatggcgatcatctccgacttcaaggacgacgaggcaccggagcagcagctggcggccggccacgttcgaggaggccctcgtggcggcgttggaga

SEQ ID NO: 3501 - protein, 31 aa, Zea mays
  misc_feature: Ceres CLONE 287771-F
MAIISDFKDDEAPEQQLAAGHVRGGPRGGVG

SEQ ID NO: 3502 - DNA, 223 bp, Zea mays
  misc_feature: Ceres CLONE 287784-F
  misc_feature: Encodes the peptide sequence at SEQ ID NO. 3503
  misc_feature (64)..(64): n is a, c, t, g, unknown, or other
gcaagccaaaaccctagcaagcaaaccaccggagcagcggcgctcgcsgggcggasattggcgnacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtg

SEQ ID NO: 3503 - protein, 74 aa, Zea mays
  misc_feature: Ceres CLONE 287784-F
  misc_feature (19)..(19): Xaa is any aa, unknown, or other
  misc_feature (22)..(22): Xaa is any aa, unknown, or other
ASQNPSKQTTGAAALAGRXLAXDDYNEIDMGYEDEPPEPEIEEGAEEELENNEDAPDDVIGGEGEDKEQEKTKR

SEQ ID NO: 3504 - DNA, 143 bp, Zea mays
  misc_feature: Ceres CLONE 287820-F
  misc_feature (119)..(119): n is a, c, t, g, unknown, or other
atccactcccaagtcccaacacccgtcggcgtcgagcagcggcasscggcggcgatgacgacgagcctgaagaagaaccggaagaagcgcgggcacgtgtcggcggggcacggccgcantcggcaagcaccggaagcacccgg

SEQ ID NO: 3505 - DNA, 290 bp, Zea mays
  misc_feature: Ceres CLONE 287839-F
  misc_feature: Encodes the peptide sequence at SEQ ID NO. 3506
  misc_feature (212)..(212): n is a, c, t, g, unknown, or other
atccgtacgaactcgcagatcagagagaccgaggcgcccgckkttytgctttccttccttgccccgttcacgagagaatttttctggagtcttcgactcgagcagggttccgatggcgctgcaatggatgatcctggcgtgcgtggtggcggtggaagctgcggtggctgcgctggtcacgctcccggtgccccgcgctgtgcggcccaagnattcgtcgcgctcacgtccttgttcctgcagcccctgtccagtgtgatacccttcgccgcctttccagatcctcgatc

SEQ ID NO: 3506 - protein, 48 aa, Zea mays
  misc_feature: Ceres CLONE 287839-F
  misc_feature (34)..(34): Xaa is any aa, unknown, or other
MALQWMILACVVAVEAAVAALVTLPVPRAVRPKXSSRSRPCSCSPCPV

SEQ ID NO: 3507 - DNA, 543 bp, Zea mays
  misc_feature: Ceres CLONE 287909-R
  misc_feature (479)..(479): n is a, c, t, g, unknown, or other
  misc_feature (481)..(481): n is a, c, t, g, unknown, or other
  misc_feature (482)..(482): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
tcgcgtaccctttctcgtcatgaattttaattcgcatacacatattcacacacatatatctacatgacaatgacaaatgtgcaagtaagtcgatcacatgaattcaacctgaacgagtcgagacttgccgcatggaatgtccacaaggctcggcgtttcgtcgaatgggcagggcgcgaagcgcgacgtcgaccgttagcacgagtttcgacgacgcgattgggggctgcgcaaaacagcgagcacacgacgggcgtcgacggcgtgctgctcactgctcaacaccccacttggatagatcgccgaacacgtggcacgcgcgcagcgctagcagcgaggaagccagggaaggtgtcggggctgcaggaacagcggcgtttcgtcgaggggctgcgcagtgaggggaggtggggcgagctcggctgctgcggtgcgaggatgaaggatcagaggcgctgcgccatggctggccgaggggnannaannnnaatattgcanngncgccatggatagggagctgctgctcacctgcaacaaggacct

SEQ ID NO: 3508 - DNA, 505 bp, Zea mays
  misc_feature: Ceres CLONE 288003-F
  misc_feature: Encodes the peptide sequence at SEQ ID NO. 3509
ttttgawttttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgcmstcgtcatcggccccgctgggagcggcaagtcaacttattgctccagtttatacgaccattgccagaccgtgggaaggacaattcatattgtcaatcttgatccagctgctgagcacttcgactatcctgtagatatggatattagagagctgatttcattggatgatgttatggaggagattgggttggggccaaatggcggtctcatctactgcatggagcaccttgaagacagcttggatgattg

SEQ ID NO: 3509 - protein, 37 aa, Zea mays
  misc_feature: Ceres CLONE 288003-F
MDIRELISLDDVMEEIGLGPNGGLIYCMEHLEDSLDD

SEQ ID NO: 3510 - DNA, 483 bp, Zea mays
  misc_feature: Ceres CLONE 288023-F
  misc_feature: Translation starting site: 100
  misc_feature (420)..(420): n is a, c, t, g, unknown, or other
  misc_feature (425)..(425): n is a, c, t, g, unknown, or other
  misc_feature (433)..(433): n is a, c, t, g, unknown, or other
ctctagccaaaaccctagcagccgcccggtgctccctctctgcaggtggcggcgcgctcccctcgcctcccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaangcaangaaggttntaggctgctcctgtgtcgtcgtcaaggactacggtgaagaatctgagggg

SEQ ID NO: 3511 - DNA, 413 bp, Zea mays
  misc_feature: Ceres CLONE 288026-F2
aytgacgagctcgccatggcctccctctcctctgccgccgtcaccgccccttccttcgccgywccagcgccasccgcgccgtggtcagaaggaggtccttcaccgtgcgcgcctctctccgcaagccaccggcaccgcsgccgtggcaatggctgccagcgccctgcttgccggcggtgccatggcccaggaggtgctgctgggcgcaggcgacggcgggctcgtcttcgascagccaagttcaccgtcaaggccggcgacaccatcacattcaagaacaacgccggcttcccgcacaacgtcgtcttcgasaagacgaggttccgagcggcgtcgacgccaccaagatctcgcaggaggagtacctcaacgcgccaggsagacctactccgtcaccctcaacgttccgggaa

SEQ ID NO: 3512 - DNA, 413 bp, Zea mays; identical to SEQ ID NO: 3511
  misc_feature: Ceres CLONE 288026-F
  misc_feature: Encodes the peptide sequence at SEQ ID NO. 3513

SEQ ID NO: 3513 - protein, 137 aa, Zea mays
  misc_feature: Ceres CLONE 288026-F
  misc_feature (21)..(21): Xaa is any aa, unknown, or other
  misc_feature (24)..(24): Xaa is any aa, unknown, or other
  misc_feature (77)..(77): Xaa is any aa, unknown, or other
  misc_feature (104)..(104): Xaa is any aa, unknown, or other
  misc_feature (127)..(127): Xaa is any aa, unknown, or other
LTSSPWPPSPLPPSPPLPSPXQRXPRRGQKEVLHRARLSPQATGTAAVAMAASALLAGGAMAQEVLLGAGDGGLVFXQPSSPSRPATPSHSRTTPASRTTSSSXRRGSERRRRHQDLAGGVPQRARXTYSVTLNVPG

SEQ ID NO: 3514 - DNA, 281 bp, Zea mays
  misc_feature: Ceres CLONE 288086-F
  misc_feature: Encodes the peptide sequence at SEQ ID NO. 3515
  misc_feature (263)..(263): n is a, c, t, g, unknown, or other
agagctgagagccgaggagggaaacgaagaagcggccatggcgatgaagcggccggcgcgcmsacccaacacctgccacccgaggaggcggcacgggtggaggccgaggttcggagctacttcgacagcgtscgccgaggcsccggccaagccgccgctcagcgacccgtcggtggacaccttcgcggaacccgccgccgtcgacgccggggaccacgacttgccggagctccgcaagctgcgcgacctcgaggcgaasccanaagctggtgttggacgga

SEQ ID NO: 3515 - protein, 81 aa, Zea mays
  misc_feature: Ceres CLONE 288086-F
  misc_feature (9)..(9): Xaa is any aa, unknown, or other
  misc_feature (32)..(32): Xaa is any aa, unknown, or other
  misc_feature (74)..(74): Xaa is any aa, unknown, or other
  misc_feature (76)..(76): Xaa is any aa, unknown, or other
MAMKRPARXPNTCHPRRRHGWRPRFGATSTAXAEAPAKPPLSDPSVDTFAEPAAVDAGDHDLPELRKLRDLEAXPXAGVGR

SEQ ID NO: 3516 - DNA, 388 bp, Zea mays
  misc_feature: Ceres CLONE 288104-F
  misc_feature: Translation starting site: 78
  misc_feature (209)..(209): n is a, c, t, g, unknown, or other
  misc_feature (238)..(238): n is a, c, t, g, unknown, or other
  misc_feature (247)..(247): n is a, c, t, g, unknown, or other
  misc_feature (332)..(332): n is a, c, t, g, unknown, or other
agaaaatcagtctccccttccaaaaccggatttgcgaaccacacctagcagccgaggttagcacgcgtcctgcggccatggaggacgaggagcacgaggtgtacggccaggagattcccgttgacggcgaggacgtcgacatggctgccggcgacgatgccaccaagctgcaggaacttgacgatatgaagcgccggctcaaggaaatngaggaggaggccgccgcgctccgsagatncaggccaangttkccaaagagatgcaaagtgtagatcccaatgcaaccacatctgaaaacaaagaggagatggattctcggtcagtattcattngaaatgttgactatgcgtgcactccagaagaagtgcagcagcactttcaaattctt

SEQ ID NO: 3517 - DNA, 413 bp, Zea mays
  misc_feature: Ceres CLONE 288107-F
  misc_feature: Encodes the peptide sequence at SEQ ID NO. 3518
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcycgcagcannntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgac

SEQ ID NO: 3518 - protein, 109 aa, Zea mays
  misc_feature: Ceres CLONE 288107-F
  misc_feature (10)..(109): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (35)..(35): Xaa is any aa, unknown, or other
  misc_feature (37)..(37): Xaa is any aa, unknown, or other
  misc_feature (38)..(38): Xaa is any aa, unknown, or other
MVSSSMDTTSDKRASSMLAPNPGKATILALGHAFXQXXVMQDYVVDGFMKNTNCDDPELKEKLTRLCKTTTVRTRYVVMSDEILKNYPELAQEGLPTMNQRLDISNAAV

SEQ ID NO: 3519 - DNA, 400 bp, Zea mays
  misc_feature: Ceres CLONE 288121-F
  misc_feature (235)..(235): n is a, c, t, g, unknown, or other
  misc_feature (359)..(359): n is a, c, t, g, unknown, or other
  misc_feature (386)..(386): n is a, c, t, g, unknown, or other
atcttgctctgaacgcattcctcccatctcccaagacctcctcagacccgagaagcgcmkgcgggccatggacgccaccggcactggagctggagggaaggcgaagaagggagcggccggtcgcaaggccgcggggcgaggaagaagtcggtgacgaggtccgtgaaggccgggctccagttctccgtcggccgcatcgggcgctacctcaagaagggccgctacgsgcascgtncggcagcggtgcccccgtctacctcgcggccgtcctgggagtacctcgccgctgaggtcctggagctcgccggcaacgcttgccaaggacaacaagaagacgcgcatcgtcccgcggccacgtnctgctggcgatccgcaacgacgagganctcgggaagctgct

SEQ ID NO: 3520 - DNA, 123 bp, Zea mays
  misc_feature: Ceres CLONE 288144-F
aactcccgaggccccgatccccctttcatttcaactcgcatctcccgcgccggccgccccagcccgggcaascccaaatggacctgccagtggtagatctcacgccgtatctcggggccgcag

SEQ ID NO: 3521 - DNA, 383 bp, Zea mays
  misc_feature: Ceres CLONE 288167-F
  misc_feature: Encodes the peptide sequence at SEQ ID NO. 3522
gtgcgttcatctgcagtgcacgaacaatcgagccagcaacataaacgatcgaggcgcggtggccgttagcaaccgcagcaagcatgaataactcgcgcgctctagtgttggtgctcctgctgctggccatcgccatggcgagctgcaggctctcgctcgccgcccacgagagcagcaccagccctcgcgacaccctcggccgcgacctgcgggctccatcgccagggccgccggcaacctcttcataccggacggtggctggcgcgccgcgaacgtcaccgccgacgcagaggcaaagaacctgagggccgtggcgtcccggagcggcggcccgcaccaggaagtcctccggcggcggcacgggctgcgtcagccgcggcgtg

SEQ ID NO: 3522 - protein, 73 aa, Zea mays
  misc_feature: Ceres CLONE 288167-F
MNNSRALVLVLLLLAIAMASCRLSLAAHESSTSPRDTLGRDLRAPSPGPPATSSYRTVAGAPRTSPPTQRQRT

SEQ ID NO: 3523 - DNA, 276 bp, Zea mays
  misc_feature: Ceres CLONE 288180-F
  misc_feature: Encodes the peptide sequence at SEQ ID NO. 3524
  misc_feature (134)..(134): n is a, c, t, g, unknown, or other
atcccatccccattcccatccatagagctgcgggcgcctgcgctgcatgcagccaacaagctcatcagctcaccgtacctaggaggacgaccgagcagctaaggtagtagtagctagctagccagtgatggcgngctacaaagcgcagggcggggcgctcgtcgtcgtcctggctgtygccgcgctcttcgcggccasgatggcgatggcggtggacgacgagcacatgtaccactggaagtccttcaagtcgtgcacggggaactgccgcaacga

SEQ ID NO: 3524 - protein, 49 aa, Zea mays
  misc_feature: Ceres CLONE 288180-F
  misc_feature (3)..(3): Xaa is any aa, unknown, or other
  misc_feature (24)..(24): Xaa is any aa, unknown, or other
MAXYKAQGGALVVVLAVAALFAAXMAMAVDDEHMYHWKSFKSCTGNCRN

SEQ ID NO: 3525 - DNA, 116 bp, Zea mays
  misc_feature: Ceres CLONE 288189-F
  misc_feature (67)..(67): n is a, c, t, g, unknown, or other
acacgcacaccgcgacccagtccagagccagtacgtgcgamrcacgcacgctgctggtccgcgtacnagacgacggtcaggtcggccggtgcttttcagtttggaataatgacggc

SEQ ID NO: 3526 - DNA, 442 bp, Zea mays
  misc_feature: Ceres CLONE 288193-F
  misc_feature: Encodes the peptide sequence at SEQ ID NO. 3527
gctctacgccggcacgtcctcgtttctgtccgaggtcatcgcctccgcaacttcgtggccggtgaggtcgcaccaccatggcgtcgctcctagcccggcaggcagcgcaggcgctccgcggaggcaaacggcgcacgtcgggccggccgcgtcgsgatgcaagggcacctccgtacctacatgaacgcggggattccccggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcacgctctcagacgtttatgaatctgggggaagagcg

SEQ ID NO: 3527 - protein, 89 aa, Zea mays
  misc_feature: Ceres CLONE 288193-F
  misc_feature: SWISSPROT Homolog: EC 1.6.5.3 NADH dehydrogenase (ubiquinone)
MQGHLRTYMNAGIPRFKEDEEKEQLAKDLAKDWNAVFERSINTLFLTEMVRGLMLTLKYFFDRNVTINYPFEKGPLSPRFRGEHALRRL

SEQ ID NO: 3528 - DNA, 322 bp, Zea mays
  misc_feature: Ceres CLONE 288215-F
  misc_feature: Encodes the peptide sequence at SEQ ID NO. 3529
  misc_feature (122)..(122): n is a, c, t, g, unknown, or other
aataccaaaaccatcctattcctcccaaggyaatawaccaagaccatggctggcacggcaatacccccgtcctcggcttcctccttgctcttgctcttgtggccacctcgacgccggctgcngccaccacgctgacgctccacaacctgtgtccgtaccccgtgtggccgctggtgagcccgaacaccgggttccccgccatctccgagaacacgggccgcctcgacggcgsgggggcgcgggctggtctccttccgcttcccggacagcttctgggcgggccgcgtggtggcgcgcacgggatgcagctccggggcattcc

SEQ ID NO: 3529 - protein, 106 aa, Zea mays
  misc_feature: Ceres CLONE 288215-F
  misc_feature (10)..(10): Xaa is any aa, unknown, or other
  misc_feature (12)..(12): Xaa is any aa, unknown, or other
  misc_feature (77)..(77): Xaa is any aa, unknown, or other
YQNHPIPPKXIXQDHGWHGNTPVLGFLLALALVATSTPAAATTLTLHNLCPYPVWPLVSPNTGFPAISENTGRLDGXGARAGLLPLPGQLLGGPRGGAHGMQLRGI

SEQ ID NO: 3530 - DNA, 249 bp, Zea mays
  misc_feature: Ceres CLONE 288250-F
agaaggatccggagttccggacgggcggacggccactgcaacgacctcgcctgttygcctckccccggcgccccgcgacaacgagacctcctcctccgctcagccgcagaagccacctcgccgccggcagcagcgttggcggccttgtggcgaggaggagagaggagcagggggcgtggaggcgcggcgattgttcgcgggatgagctacggcggcacagctccctcgcgcccggtgccaagaggccgt

SEQ ID NO: 3531 - DNA, 451 bp, Zea mays
  misc_feature: Ceres CLONE 288262-F
  misc_feature: Encodes the peptide sequence at SEQ ID NO. 3532
  misc_feature (279)..(279): n is a, c, t, g, unknown, or other
  misc_feature (400)..(400): n is a, c, t, g, unknown, or other
gcacccaggccgcggcgcatcctctccccatcggcagtcttcccccaagacgtctaaaccccaatccctaaatccccgacgcagaccacacgacgcgcacctccgttcacgaggcggaascatgagtygccacccgatcactaagtgggcacagaggtccgacaggtgttcttgacgatagatgctgcccgaygcccaggatgttgaagctgaacttkawgcctgaaggccatttbaacttctcagctaagggctcagatgacttgcgctatgagtttnamattgagctgtttgatgctgtgaatatggaggagagcaaagcagctattgccccaaggaccatatgctacctgataaagaaagctaagagcgggtggtggccaaggctgctgaagcaggnagggcaaaccacctgtgttcttgaaggttgactgggacaaatwgcacgacg

SEQ ID NO: 3532 - protein, 76 aa, Zea mays
  misc_feature: Ceres CLONE 288262-F
  misc_feature: SWISSPROT Homolog: EC 5.3.99.3 Prostaglandin-E synthase
  misc_feature (6)..(6): Xaa is any aa, unknown, or other
  misc_feature (7)..(7): Xaa is any aa, unknown, or other
  misc_feature (12)..(12): Xaa is any aa, unknown, or other
  misc_feature (27)..(27): Xaa is any aa, unknown, or other
  misc_feature (67)..(67): Xaa is any aa, unknown, or other
MLKLNXXPEGHXNFSAKGSDDLRYEFXIELFDAVNMEESKAAIAPRTICYLIKKAKSGWWPRLLKQXGQTTCVLEG

SEQ ID NO: 3533 - DNA, 363 bp, Zea mays
  misc_feature: Ceres CLONE 288278-F
  misc_feature: Encodes the peptide sequence at SEQ ID NO. 3534
  misc_feature (87)..(87): n is a, c, t, g, unknown, or other
  misc_feature (210)..(210): n is a, c, t, g, unknown, or other
  misc_feature (265)..(265): n is a, c, t, g, unknown, or other
  misc_feature (294)..(294): n is a, c, t, g, unknown, or other
gccgaattccaaaccctagcctcgcctgttgcggccgcggcggagatggcgaagtctctgcgatccaagcgcgagaagcggctgcgnacattgcgccgggagatagcggacccttctacgacaagaaggaggccgccaagctcaccgcgcaggccgccgcgcttgctgctcccccgctccaggtccgcgggcccccgccgtcccaggatnccggcagctcccgcgcgctastcagcctcggctatggatgtggagatgtccgatnaaggaaacaacaggtctaaaaccttcttnaagccacttggcatcattagcaagaagaaggtacagcttcatttgaagatcaagaaagacaagagaaaa

SEQ ID NO: 3534 - protein, 106 aa, Zea mays
  misc_feature: Ceres CLONE 288278-F
  misc_feature (55)..(55): Xaa is any aa, unknown, or other
  misc_feature (62)..(62): Xaa is any aa, unknown, or other
  misc_feature (74)..(74): Xaa is any aa, unknown, or other
  misc_feature (83)..(83): Xaa is any aa, unknown, or other
MAKSLRSKREKRLRTLRREIADPSTTRRRPPSSPRRPPRLLLPRSRSAGPRRPRXPAAPARXSASAMDVEMSDXGNNRSKTFXKPLGIISKKKVQLHLKIKKDKRK

SEQ ID NO: 3535 - DNA, 277 bp, Zea mays
  misc_feature: Ceres CLONE 288305-F
  misc_feature: Encodes the peptide sequence at SEQ ID NO. 3536
  misc_feature (173)..(173): n is a, c, t, g, unknown, or other
atccatccatccccgattccccaaccctaagcagccatggccgcgcgcykcccggctgcttcaagtgtggccgccccggcatgggtcccgcgactgcccctcctccgcctccaccaaccctcctgccgccgccgacgcgcccaccaaccctagccacctctccggcgccgcknccgcttcaacgccaagcccaggccccccgcggcggcgatggatggcgaggacggcaagggggaagaagaagaaggagagggccacgcgccccaagctcacgccg

SEQ ID NO: 3536 - protein, 92 aa, Zea mays
  misc_feature: Ceres CLONE 288305-F
  misc_feature (17)..(17): Xaa is any aa, unknown, or other
  misc_feature (58)..(58): Xaa is any aa, unknown, or other
SIHPRFPNPKQPWPRAXRLLQVWPPRHGSRDCPSSASTNPPAAADAPTNPSHLSGAAXASTPSPGPPRRRWMARTARGKKKKERATRPKLTP

SEQ ID NO: 3537 - DNA, 386 bp, Zea mays
  misc_feature: Ceres CLONE 288346-F
  misc_feature: Encodes the peptide sequence at SEQ ID NO. 3538
  misc_feature (287)..(287): n is a, c, t, g, unknown, or other
  misc_feature (331)..(331): n is a, c, t, g, unknown, or other
  misc_feature (339)..(339): n is a, c, t, g, unknown, or other
acgagcccggttcgttctcgacctttcgtctcgctctcgcccgcccgaccccgcggascctagcctagccttgcccccgaccgcggattccccctcggccgccgcgcgcccgcacccgcacccgcgatgatgaactgcgccggasaggaccccgtggaggacttcctgatctccggcgccgtcgacgacgaagatctagccatcttctgcgacggaggacttgggattgagggtgtcaatggagatgcttgtggatttgagcagtctaatttgggcaaaaggggtanawataaaccatgttcatctggtctaaaatctaaagcttgtcgtnaaaawatnaggagggacaatctgaatgacaggttcctggaattaagttcggttat

SEQ ID NO: 3538 - protein, 86 aa, Zea mays
  misc_feature: Ceres CLONE 288346-F
  misc_feature (7)..(7): Xaa is any aa, unknown, or other
  misc_feature (54)..(54): Xaa is any aa, unknown, or other
  misc_feature (55)..(55): Xaa is any aa, unknown, or other
  misc_feature (69)..(69): Xaa is any aa, unknown, or other
  misc_feature (70)..(70): Xaa is any aa, unknown, or other
  misc_feature (71)..(71): Xaa is any aa, unknown, or other
MMNCAGXDPVEDFLISGAVDDEDLAIFCDGGLGIEGVNGDACGFEQSNLGKRGXXKPCSSGLKSKACRXXXRRDNLNDRFLELSSV

SEQ ID NO: 3539 - DNA, 424 bp, Zea mays
  misc_feature: Ceres CLONE 288367-F
  misc_feature: Encodes the peptide sequence at SEQ ID NO. 3540
  misc_feature (90)..(90): n is a, c, t, g, unknown, or other
  misc_feature (99)..(99): n is a, c, t, g, unknown, or other
accattccaccactctccgcttcgctwcttgtcgctgcggccgcggccatggtctccctccgcttccctaccgctgcaatcccccgycknccgccatcncaggcccccaacggcgtcgcatcgccgccacggtcgcygctgcwgccgcggccgcagctgcagttagcggccagcttgaccctcacgggcaagtccaccggccggccagtccccaccctgcccctctctgggcctccctctccctggccgacgcggcggccccagctccgtcgaaccccggaccggcgcgacattccccaccgaggccgccgttgggsccgctactcggcataggcctccggaagaccagcgtcctcgggctcaagtccatcgacgtctacgcattcggcgtgtatgcggattacaacgatttkaagcagcagct

SEQ ID NO: 3540 - protein, 140 aa, Zea mays
  misc_feature: Ceres CLONE 288367-F
  misc_feature (9)..(9): Xaa is any aa, unknown, or other
  misc_feature (29)..(29): Xaa is any aa, unknown, or other
  misc_feature (30)..(30): Xaa is any aa, unknown, or other
  misc_feature (33)..(33): Xaa is any aa, unknown, or other
  misc_feature (137)..(137): Xaa is any aa, unknown, or other
HSTTLRFAXCRCGRGHGLPPLPYRCNPPXXAIXGPQRRRIAATVAAAAAAAAAVSGQLDPHGQVHRPASPHPAPLWASLSLADAAAPAPSNPGPARHSPPRPPLGPLLGIGLRKTSVLGLKSIDVYAFGVYADYNDXKQQ

SEQ ID NO: 3541 - DNA, 142 bp, Zea mays
  misc_feature: Ceres CLONE 288388-F
  misc_feature (73)..(73): n is a, c, t, g, unknown, or other
caatctcccactcattacwcagcttaggaaggtccagggcctccagctccgatccaccacgctacgctagcwntatgccggactcctcctcctccgccggcacagggcatggccccctcgagctcggcgcggcgtccattgc

SEQ ID NO: 3542 - DNA, 236 bp, Zea mays
  misc_feature: Ceres CLONE 288396-F
  misc_feature: Encodes the peptide sequence at SEQ ID NO. 3543
atcgcgactcaggcactcaccgaccgcggatatggccccgccgccatggcctctccttgcgacttccctcctcctcatcctattccaccactcgcctcgcgccgggtggstttccgcgtctctgggcgacggcctcctgggcgccgccgcgcgccggggtttcgcggcttggctgcgcggcttgcggcgccgcatccacgagcgccccgagctcgccttccaggaataccgcacga

SEQ ID NO: 3543 - protein, 68 aa, Zea mays
  misc_feature: Ceres CLONE 288396-F
  misc_feature (27)..(27): Xaa is any aa, unknown, or other
MAPPPWPLLATSLLLILFHHSPRAGWXSASLGDGLLGAAARRGFAAWLRGLRRRIHERPELAFQEYRT

SEQ ID NO: 3544 - DNA, 458 bp, Zea mays
  misc_feature: Ceres CLONE 288399-F
  misc_feature: Encodes the peptide sequence at SEQ ID NO. 3545
  misc_feature (119)..(119): n is a, c, t, g, unknown, or other
ggacgctgagccgtcgttgtcgctgggattgcagcagcgttggcgggccttgtggcgaggaggaggaagaacaagggggcktgaggcgcggcgattgttcgcgggatgagctacggcgncasagctccctcgcgcccggtgccaagaggccgttcgagtacgggagaacgcatgtggtgaggcccaagggcacgcacaaggccaccattgtctggctccacggccttggtgacaatggaaccagcgtctcaactgctggaaacgctcccccttcctaatataaaatggatatgcccaactgcaccttcaagacctgtgtcattgtttggcgggttcccctgcacagcatggtttgatgttgctgacctttctgaggatgctcccgatgacactgaggggatggatgcctcagcagcacatgttgcaaatttgttgtcaactgaacccgctgacatcaa

SEQ ID NO: 3545 - protein, 74 aa, Zea mays
  misc_feature: Ceres CLONE 288399-F
  misc_feature: SWISSPROT Homolog: EC 3.1.1.1 Carboxylesterase
MEPASQLLETLPLPNIKWICPTAPSRPVSLFGGFPCTAWFDVADLSEDAPDDTEGMDASAAHVANLLSTEPADI

SEQ ID NO: 3546 - DNA, 510 bp, Zea mays
  misc_feature: Ceres CLONE 288409-F
  misc_feature: Encodes the peptide sequence at SEQ ID NO. 3547
  misc_feature (178)..(178): n is a, c, t, g, unknown, or other
  misc_feature (179)..(179): n is a, c, t, g, unknown, or other
ctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcytcgcccttggccacgccttcccgcagcaknntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcgaggcgcggcttcccggggcggcga

SEQ ID NO: 3547 - protein, 148 aa, Zea mays
  misc_feature: Ceres CLONE 288409-F
  misc_feature (10)..(145): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (28)..(28): Xaa is any aa, unknown, or other
  misc_feature (37)..(37): Xaa is any aa, unknown, or other
  misc_feature (38)..(38): Xaa is any aa, unknown, or other
MVSSSMDTTSDKRASSMLAPNPGKATIXALGHAFPQXXVMQDYVVDGFMKNTNCDDPELKEKLTRLCKTTTVRTRYVVMSDEILKNYPELAQEGLPTMNQRLDISNAAVTRWRRRRPCRASARGAARSRPSPTSCTSRRARRGFPGRR

SEQ ID NO: 3548 - DNA, 195 bp, Zea mays
  misc_feature: Ceres CLONE 288423-F
  misc_feature: Encodes the peptide sequence at SEQ ID NO. 3549
gaggattcgattattctgttcgctctcgcccaagtycatcgtctggtcgtcgcccgcagaggscagacgcccaaaagcccggaagggcgccatggccgcgtcggatctggagagcaaggccaaggaggccttcgtcgacgacgacttcgagctggccaccgagctctacagccmrgccatcgacgccgggcccgc

SEQ ID NO: 3549 - protein, 34 aa, Zea mays
  misc_feature: Ceres CLONE 288423-F
  misc_feature (28)..(28): Xaa is any aa, unknown, or other
MAASDLESKAKEAFVDDDFELATELYSXAIDAGP

SEQ ID NO: 3550 - DNA, 477 bp, Zea mays
  misc_feature: Ceres CLONE 288465-F
  misc_feature: Encodes the peptide sequence at SEQ ID NO. 3551
  misc_feature (76)..(76): n is a, c, t, g, unknown, or other
  misc_feature (195)..(195): n is a, c, t, g, unknown, or other
aacctctagctgattgatctctggtttaccactctttccttccctccttcaattctaaataccacaaatcaaagtnctttgcgatggtgagcagcagcatggacacgacgagtgacaaacgtgcgtcatccatgctggctcctaaccctggcaaggccacgatcctcgcccttggccacgccttcccgcagcakntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagaatggcgacggaggcgtccctgtcgtgcgtccgctcgtggggcggcgcgctctcgtccatcac

SEQ ID NO: 3551 - protein, 92 aa, Zea mays
  misc_feature: Ceres CLONE 288465-F
  misc_feature (1)..(92): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRMATEASLSCVRSWGGALSSI

SEQ ID NO: 3552 - DNA, 138 bp, Zea mays
  misc_feature: Ceres CLONE 288521-F
  misc_feature (65)..(65): n is a, c, t, g, unknown, or other
actgttcagtcggctcgagtaacaacagcaatagaatgggtggcggcggcgggaccggcagcgancggcgggacagcagcagcgaggatgacggagacgccgcgtggaaggcagccattgactccatcgcgtccgttg

SEQ ID NO: 3553 - DNA, 492 bp, Zea mays
  misc_feature: Ceres CLONE 288542-F
awacgatcgcaacacaatcgaaagaacgacgtggatagcgagcgataaaagccagagcaagagcaagagcaagagaggagcgatcgatcgagaggagaagacgaaagagtcggattgccatggacgacggcaccgtgatcatcctcttcttcttcttggccttcttcatgttcaccttcgccgcgtccctcttcttgtggttcacgatatggtggccctggctctgcgcgttatcaccctgacgcggaacctgctgagtaacctctttaccctgtgccaagccagcatggaggccgacgagtagatccgcacgctctcctgccgccacgtcaagtgcgatgtcatcgacgaatggcttcgcactggacggatgacgtgctaccgtggaagcggttgccgcggacgtcgtcgacgcgggatttgaaggaggcgcggctagttgctttccggcgcacaacgacaaactacctgtagcgtcgtttcttttattgc

SEQ ID NO: 3554 - DNA, 325 bp, Zea mays
  misc_feature: Ceres CLONE 288558-F
  misc_feature: Encodes the peptide sequence at SEQ ID NO. 3555
  misc_feature (106)..(106): n is a, c, t, g, unknown, or other
aaccacaaacagagcgacatttcgaataacacagttcagcgcgacgatgggatccctcactaataacatcgtgccgtgggcgtcgtccttgcggcgctcgtygsgncgggtcgtgcgggcccccgaagtgccacccggmcccaacatcaccaccaactacaacggcaagtggctcaccgctaggccacctggtacggtcagcccaacggtgccggcgctcctgacaacggcggtgcgtgcgggatcaagaacgtgaacctgccaccctacagcggcattcacggcgtgcggcaacgtccccatcttcaaggacggcaagggctgc

SEQ ID NO: 3555 - protein, 69 aa, Zea mays
  misc_feature: Ceres CLONE 288558-F
  misc_feature (19)..(19): Xaa is any aa, unknown, or other
  misc_feature (20)..(20): Xaa is any aa, unknown, or other
MGSLTNNIVPWASSLRRSXXRVVRAPEVPPGPNITTNYNGKWLTARPPGTVSPTVPALLTTAVRAGSRT

SEQ ID NO: 3556 - DNA, 130 bp, Zea mays
  misc_feature: Ceres CLONE 288566-F
  misc_feature (64)..(64): n is a, c, t, g, unknown, or other
  misc_feature (65)..(65): n is a, c, t, g, unknown, or other
atccatcacagctagctagcatacagacgaataatctcttcttcacctcactaacaccagctannaactctttctctcctgcaataatggccgctcgctcctcctcctcccagccgcagctgttcgcggc

SEQ ID NO: 3557 - DNA, 342 bp, Zea mays
  misc_feature: Ceres CLONE 288604-F
  misc_feature: Translation starting site: 116
gatctgagatcgacatcgatccaccgaggtttcttgtgcgtgccgccatggccatggcagtagctcaccttcttcctcagctctccgccgaacrattggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccastcgccgccgctcgcgcgtcgggcttctacctggcgccgtccgcacgtccagcatggmctgccgtcgtcggggacatggtccggcacgttgtgggcgcgcacg

SEQ ID NO: 3558 - DNA, 467 bp, Zea mays
  misc_feature: Ceres CLONE 288635-F
  misc_feature: Encodes the peptide sequence at SEQ ID NO. 3559
aatccaacaagcaaacctgcagtcatctcctccaccaccaccaccaagctcaacaacagccagctcgcgaaaataatgaagagccgcagcatggcatcatcggccgcgctcttggtgctagccctcgcgctagtggcggccaccgcccacaggtagcggaggcaaagaagaagagagcggcggagagcggcgaggcggcggaggcgaagaagatccaggacgacttctgctcgacgctgtgsagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggaga

SEQ ID NO: 3559 - protein, 30 aa, Zea mays
  misc_feature: Ceres CLONE 288635-F
MKVCQEECDKAYVVKAAEVTKACSVTCAKE

SEQ ID NO: 3560 - DNA, 195 bp, Zea mays
  misc_feature: Ceres CLONE 288637-F
  misc_feature (9)..(9): n is a, c, t, g, unknown, or other
  misc_feature (68)..(68): n is a, c, t, g, unknown, or other
  misc_feature (77)..(77): n is a, c, t, g, unknown, or other
  misc_feature (128)..(128): n is a, c, t, g, unknown, or other
  misc_feature (129)..(129): n is a, c, t, g, unknown, or other
gtgcccgcngtgctactgacggttgctctagatccgttcatcctggtggttttgtgaggtcgaaagcngcgagcganattagaagatgctggacaagctgtgggacgacgtggtggccgggcctcgcnnagacggcctcgagaagctccgcaagccaccaccgcccgcccgctcgtcatcaacaaagacgcggac

SEQ ID NO: 3561 - DNA, 339 bp, Zea mays
  misc_feature: Ceres CLONE 288659-F
  misc_feature: Translation starting site: 91
actctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcac

SEQ ID NO: 3562 - DNA, 480 bp, Zea mays
  misc_feature: Ceres CLONE 288669-F
  misc_feature: Encodes the peptide sequence at SEQ ID NO. 3563
  misc_feature (390)..(390): n is a, c, t, g, unknown, or other
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgctgctaccccatacgagctgcagcgccgcctcgtcgccgctgcctccgcggccgactctgcctacggsgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaanakgagaaggaagagagcgacgacgacatgggattctccctgttcgactagagttgtgtgtgtcatctggatctcagaagtggtggtttgg

SEQ ID NO: 3563 - protein, 119 aa, Zea mays
  misc_feature: Ceres CLONE 288669-F
  misc_feature (25)..(118): Pfam Name: Ribosomal_60s Pfam Description: 60s Acidic ribosomal protein
  misc_feature (104)..(104): Xaa is any aa, unknown, or other
MGVYTFVCRNNGGEWTAKQHSGEIEASAATPYELQRRLVAAASAADSAYGVQSSFSMVTPSSAVFQVIVGAVGGGAMMVSGGGGGAAASGGAAAEAPKEEKKEXEKEESDDDMGFSLFD

SEQ ID NO: 3564 - DNA, 707 bp, Zea mays
  misc_feature: Ceres CLONE 288690-R
  misc_feature: Encodes the peptide sequence at SEQ ID NO. 3565
cgaattgggtaccgggccccccctcgaggtcgacggtatcgatattttttttttttttttttcttttttttttttttttttttttttttttttttacctcccaactatcctttttttttcatccttttaaacaagtcatcctgcgggggcggtcaaattcagcttaccaaggcgtcagactcttgccagactgacgagaccccgaaaatttaaatccgcggcaaatccaaaaccactcgaaatttcctctgaaacatgatctccaaaccacttggttctaacatgaaagcagataaaactagtgtttctgcatcactctgcttatgaaattgcctaagctaacaaccaagagaggatgtctgcctcaatcacttatgcgggtgcaacagaggtggatctaccgtcggcagatgatctgccctatctcgggtcaaacatcatcaaaggggatacccgggcacatcctcaagatctgaccctccttcctccagtcaaggactgggcctggtgacaccgacccccatttaaggtccggccccccgggaacaattcttttggccaatgcccgccacgggaaaccctgcccgggattacagcccaaaacttccggaaaatttccggaggaaaccccctggaaggggcccagttccccccttttggggtcaccccccccaaaaatttctttgtaaaaggcccacccccccccg

SEQ ID NO: 3565 - protein, 70 aa, Zea mays
  misc_feature: Ceres CLONE 288690-R
RIGYRAPPRGRRYRYFFFFFFFFFFFFFFFFLPPNYPFFFILLNKSSCGGGQIQLTKASDSCQTDETPKI

SEQ ID NO: 3566 - DNA, 399 bp, Zea mays
  misc_feature: Ceres CLONE 288702-F
  misc_feature: Encodes the peptide sequence at SEQ ID NO. 3567
  misc_feature (321)..(321): n is a, c, t, g, unknown, or other
gtggcgtggagtggagtggagctggccgccgaagagagaccccgagaggccgagagaaagagagagaggccgtgctaggtgtggtgagtggtgacccagatggaggtggccgccacgtcgccgtscggaggagccgctgctgcgccccatctccgcagcccaatctccgtgccgacgccgccagctccggcgacccggcttcccctcctccatcagcggtgaggccgagtcgcctcgcggcgctcatcgggcgckcggcggggcggcgcggttccctcgatgctggtgcgcgakacggcggcgctgcaactgcassttatngcgcgcggactgggcgcactcccgccccgtcctcgcgctcgacatcgcctggaacgtcgccttcgccgcggccgccgc

SEQ ID NO: 3567 - protein, 132 aa, Zea mays
  misc_feature: Ceres CLONE 288702-F
  misc_feature (85)..(85): Xaa is any aa, unknown, or other
  misc_feature (98)..(98): Xaa is any aa, unknown, or other
  misc_feature (105)..(105): Xaa is any aa, unknown, or other
  misc_feature (107)..(107): Xaa is any aa, unknown, or other
GVEWSGAGRRRETPRGREKEREAVLGVVSGDPDGGGRHVAVRRSRCCAPSPQPNLRADAASSGDPASPPPSAVRPSRLAALIGRXAGRRGSLDAGARXGGAATAXYXARTGRTPAPSSRSTSPGTSPSPRPP

SEQ ID NO: 3568 - DNA, 198 bp, Zea mays
  misc_feature: Ceres CLONE 288705-F
  misc_feature (77)..(77): n is a, c, t, g, unknown, or other
  misc_feature (95)..(95): n is a, c, t, g, unknown, or other
  misc_feature (125)..(125): n is a, c, t, g, unknown, or other
aaaaagatctccaattccccaccccaaagagctaccctgaccagatttggccgcttcctcctctgcctcccgctkanccctagtccagccccccnwgatctgctccgcgcgascagccatggcgnagacgctcgacatgaccctcgatgacatcatcaagaacaacaagaagagtaacccctcctccggcggggcccg

SEQ ID NO: 3569 - DNA, 283 bp, Zea mays
  misc_feature: Ceres CLONE 288711-F
  misc_feature: Encodes the peptide sequence at SEQ ID NO. 3570
gattagaaacggctaagcaataacgcaaagattcggctgacaatggggaaggggttcccgtcgtacttggcgatgaagacggggccggaggcggcgacggcgcggcggcggcggcsacakgcbtcatcgacgcggacctgcggaacctcggcgtcgscgcgawagctcgccaaccacgccttcgtcctcggcggcgggttggggttcggcacttccttcctcaagtggctggccttcctcgccgcagtgtatctcttgatattggaccgcacgaactggaaga

SEQ ID NO: 3570 - protein, 80 aa, Zea mays
  misc_feature: Ceres CLONE 288711-F
  misc_feature (25)..(25): Xaa is any aa, unknown, or other
  misc_feature (26)..(26): Xaa is any aa, unknown, or other
  misc_feature (39)..(39): Xaa is any aa, unknown, or other
  misc_feature (41)..(41): Xaa is any aa, unknown, or other
MGKGFPSYLAMKTGPEAATARRRRXXASSTRTCGTSASXRXLANHAFVLGGGLGFGTSFLKWLAFLAAVYLLILDRTNWK

SEQ ID NO: 3571 - DNA, 286 bp, Zea mays
  misc_feature: Ceres CLONE 288768-F
  misc_feature: Encodes the peptide sequence at SEQ ID NO. 3572
  misc_feature (168)..(168): n is a, c, t, g, unknown, or other
ccgtatcatcatcttggcctcgtcaatccaccaccaccgtcgtytrctgagctcctcctccggcttcgcttcgcttcgctgtcttgcctcctcctcggtcgaagaagaagaagaaaacatgtgtccgggatccgtggagtcgtcgtcggcggcggcggcgggcaagancgtgtgcgtgatggacgccgcggggccgctgggcacgcctcgtgaccgcctcctccggcgcgggtacacagtccacgccgccacgtacgcctcgckacggggaggagggcgcggctgc

SEQ ID NO: 3572 - protein, 56 aa, Zea mays
  misc_feature: Ceres CLONE 288768-F
  misc_feature (17)..(17): Xaa is any aa, unknown, or other
  misc_feature (49)..(49): Xaa is any aa, unknown, or other
MCPGSVESSSAAAAGKXVCVMDAAGPLGTPRDRLLRRGYTVHAATYASXRGGGRGC

SEQ ID NO: 3573 - DNA, 180 bp, Zea mays
  misc_feature: Ceres CLONE 288782-F
aaaaccccaaaccgcakatgtgtaagcaaaccgcacgccccgctccagaacggatcctcatctctcacgttktcaccacagtytkaatccagaatccaactagtagctccataaaagcggcaatgatccagctgctgttcgtcgtgctggtggcggaggcgtcccttacggcggcgctgc

SEQ ID NO: 3574 - DNA, 120 bp, Zea mays
  misc_feature: Ceres CLONE 288831-F
acgcacaccgcgacccagtccagagccagtacgtgcgamggcacgcacgctgctggtccgcgtacsagacgacggtcaggtcggccggtgcttttcagtttggaataatgacggcgacga

SEQ ID NO: 3575 - DNA, 423 bp, Zea mays
  misc_feature: Ceres CLONE 288856-F
  misc_feature: Translation starting site: 94
  misc_feature (113)..(113): n is a, c, t, g, unknown, or other
  misc_feature (166)..(166): n is a, c, t, g, unknown, or other
  misc_feature (262)..(262): n is a, c, t, g, unknown, or other
  misc_feature (326)..(326): n is a, c, t, g, unknown, or other
  misc_feature (342)..(342): n is a, c, t, g, unknown, or other
  misc_feature (356)..(356): n is a, c, t, g, unknown, or other
atcacacactcgactctcctctctcgcatccgcagcctttcgagctctactccaccccctcgatctcgaagcgcmagcagcagtcaggcggccatggacgcgagckcmscggnagccggcgggaaggcgaagaagggcgcggccgggcgcaaggccggcgggcganggaagaagtcggtgacgaggtccgtcaaggccgggctgcagtttcccgtcggccgcatcgggcggtacctgaagaagggccggtacgcgcagcgtncggcacgggcgcccccgtctacctggccgccgtcctcgagtacctggccgccgaggtgctgganctggccggcaacgctnccaaggacaacaanaagacccgcatcatcccgcgccacgtgctccttgccatccgcaacgacgaggagctcggcaagctgc

SEQ ID NO: 3576 - DNA, 489 bp, Zea mays
  misc_feature: Ceres CLONE 288865-F
  misc_feature (268)..(268): n is a, c, t, g, unknown, or other
aacagccctacaacttactgcttgctctagctagctagctgctcccggcccatatccactacacaagtaggctagcagcagcagcagcaatggcctcggtgacgrgttcccggccgtggcctcgtcctgctgctcgccgccagcgccttcctggccagcgaggtggcggcgtgcggcggctgccgaaaccaactcctcctcctccatcgccaccaccgccgtcgcccaccagcacgccgtscctccgccaccgtccagctccggcggncaagtgccccaagaacgcgctgaaactgggcgtgtgcgcaacgtgctgggcctcgtcaaggtgtccatcggcaaggtgcccaccgactcgtgctgcccgctgctggacggcctcgccgacctggaggccgccgtctgcctctgcaccgcgctcaaggccaacgtgctcggcatcaacctcgacgtccccgtcaagctcaccctgctccctcaactactgcg

SEQ ID NO: 3577 - DNA, 535 bp, Zea mays
  misc_feature: Ceres CLONE 288900-F
  misc_feature: Translation starting site: 113
  misc_feature: SWISSPROT Homolog: EC 3.2.1.39 Glucan endo-1,3-beta-D-glucosidase
  misc_feature (309)..(309): n is a, c, t, g, unknown, or other
  misc_feature (463)..(463): n is a, c, t, g, unknown, or other
  misc_feature (490)..(490): n is a, c, t, g, unknown, or other
  misc_feature (509)..(509): n is a, c, t, g, unknown, or other
atgttctttggcaaacacacacacacacacatcgtttgctgttgcaacaaagctctacacgggaagacaggctgcttctttcttgcagtctctggtccagaagcctgaagaaatggcgtcacccaacgtcacattcctcgccttcttcgtggccctcgcactattggcgcttcacaccaccgacgcagcagcggsgcgggcagaaaccttgcgccataggagcgacacatggtgcgtggccaagccgtcgacgcaggaggcggcgctgcggggcaacctggagttcgcctgctccgagagcgactgcgncgccatccagggcaccgtcggctgcgccagcccgacagcctgctgtcacgggcgtcggtggccatgaacgcctactaccaggcccgggggaggaactcgtggaactgcttcttcaacggcaccggcctaatcaccatcactgacccaagccttngcacctgcaaaaatatgcttgacaacngacgggctgctctgctgcntgctgtgctcaacggacgatgaataa

SEQ ID NO: 3578 - DNA, 458 bp, Zea mays
  misc_feature: Ceres CLONE 288903-F
  misc_feature (381)..(381): n is a, c, t, g, unknown, or other
  misc_feature (405)..(405): n is a, c, t, g, unknown, or other
  misc_feature (422)..(422): n is a, c, t, g, unknown, or other
atcttgctctgaacgcattcctcccatctcccaagacctcctcagacccgagaagcgcmkgcgggccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcgcascgtcggcagcggtgcccccgtctacctcgcggccgttctggagtacctcgccgctgaggtcctggagctcgccggcaacgctgccaaggacaacaagaagacgcgcatcgtcccgcgccacgtgctgctggcgatccgcaacgacgagganctcgggaagctgctgaccggcgtnaccatcgcccacggsgncgtttttgcccaacatcaacccggtcctgctgccca

SEQ ID NO: 3579 - DNA, 491 bp, Zea mays
  misc_feature: Ceres CLONE 288913-F
  misc_feature (8)..(8): n is a, c, t, g, unknown, or other
catttttnatatcctcactcgccgccgccgccgctcgtccctcgccccatcgcgatggcccggatcaaggtgcacgagctgcgggggaagagcaaggcggatctgcaagcgcvttaagggagtttaagtcggagctctccctgctacgcgtaccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctccccgctcgacctccgccccaagaagacccgcgccatccgcagsgcctcaccaagcaccagctctcccttgaagaccgagagggaaaabacagcgtgagaagtatttccccatgaggaagtacgctatcaaggcctagatcagtgaaagaacatttatcctgtcaagttttgctcagaagttacttgaattttgagacaaatc

SEQ ID NO: 3580 - DNA, 491 bp, Zea mays
  misc_feature: Ceres CLONE 288958-F
  misc_feature: Encodes the peptide sequence at SEQ ID NO. 3581
tttttctccacctccatcacccgcctccactcccccctcccaggtgctgcccaggtaagtcggcggcggcgatgacaacgcgcttcaagaagaaccgcaagawgcgcggccacgtgtccgccgggcacgccgcatcggcaagcacaggaagcacccgggaggtcgcggtaacscggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaggcggcggaggcgktcggcgacaaggccccgcagatcgacgtcacgcagttcggctacttcaaggtgctcgggaagggggtgctgccgccaaagcccattgtcgtcaaggcccaagctcatctccaaggtcgccgagaagaagatcaaggcagcaggcggcgcgt

SEQ ID NO: 3581 - protein, 103 aa, Zea mays
  misc_feature: Ceres CLONE 288958-F
  misc_feature (54)..(54): Xaa is any aa, unknown, or other
MHHHRILFDKYHPGYFGKVGMRYFHKLRNKFYCPAVNIERLWSMVPTDKAAEAXGDKAPQIDVTQFGYFKVLGKGVLPPKPIVVKAQAHLQGRREEDQGSRRR

SEQ ID NO: 3582 - DNA, 171 bp, Zea mays
  misc_feature: Ceres CLONE 288979-F
  misc_feature (83)..(83): n is a, c, t, g, unknown, or other
  misc_feature (95)..(95): n is a, c, t, g, unknown, or other
gtaaaaggtacgaggggccaaacaggaaaagtgagcccaaaccctagacccatggaagcgtggccgcctctagcccccgcggnggccgcagcsanccccggtcgctgcctccgacgatgcggcggtcactcccgccggttccggggcgtggggaccagcggcaacggcgca

SEQ ID NO: 3583 - DNA, 477 bp, Zea mays
  misc_feature: Ceres CLONE 288981-F
  misc_feature: Encodes the peptide sequence at SEQ ID NO. 3584
  misc_feature (258)..(258): n is a, c, t, g, unknown, or other
  misc_feature (325)..(325): n is a, c, t, g, unknown, or other
gatcaggagaaccaaaggggtagtgaaggtggctacagtgctggtggctatgggcaagctcctccacaagctcctccttcgtatggtggtcctgcgggtgattatgcagcacctccgagctcctatggaggcaacaatgcttatggttcagattctgcagtgccgcctcctaatagctacagtggtggcccaggctcatacccaccaagctatggtgccccgcctccacaccaatatggtggtgccccagggggmaangggggtctgcctcctacatatgatggtggatatggtggtcggtccatgcctgggggtggaggatctnggggtgcaccaccgccttatcatggtggcggcasgggtttatactdggtagtgctgaccctgaaccagctggaaaagttaagcagtgcgatggaaaattgtgacgagacatgtgacacgcaaggattttacatctcaaatttgccttcctga

SEQ ID NO: 3584 - protein, 158 aa, Zea mays
  misc_feature: Ceres CLONE 288981-F
  misc_feature (86)..(86): Xaa is any aa, unknown, or other
  misc_feature (109)..(109): Xaa is any aa, unknown, or other
  misc_feature (120)..(120): Xaa is any aa, unknown, or other
  misc_feature (124)..(124): Xaa is any aa, unknown, or other
DQENQRGSEGGYSAGGYGQAPPQAPPSYGGPAGDYAAPPSSYGGNNAYGSDSAVPPPNSYSGGPGSYPPSYGAPPPHQYGGAPGGXGGLPPTYDGGYGGRSMPGGGGSXGAPPPYHGGGXGLYXVVLTLNQLEKLSSAMENCDETCDTQGFYISNLPS

SEQ ID NO: 3585 - DNA, 322 bp, Zea mays
  misc_feature: Ceres CLONE 289023-F
  misc_feature (80)..(80): n is a, c, t, g, unknown, or other
  misc_feature (176)..(176): n is a, c, t, g, unknown, or other
  misc_feature (211)..(211): n is a, c, t, g, unknown, or other
  misc_feature (253)..(253): n is a, c, t, g, unknown, or other
aagaaatgcgtcaggggttgtgaagggaaggagtgccgatgscggtggcacccggcgccgctgcggccgtggtggttgcnatgaaaggccacccagggtctggcaagtccacgtcggcgcgcgccatcgsaccggctttgctgtccgctcctggacaaggacgatgtgagggactncatgttgcccctagaggcttgctgctgctgggctnctcaacgacctctcctacgccgtgctgtggcggatggccgancgccaggtaaggctcggactgtctgtcgtcatcgattcaccgctktcacgccggctctcacctcgacat

SEQ ID NO: 3586 - DNA, 255 bp, Zea mays
  misc_feature: Ceres CLONE 289047-F
  misc_feature: Encodes the peptide sequence at SEQ ID NO. 3587
gttcttccagcgacraagcagcctaaataaatcgtatcatctcacctgttcagtttccttctcctcttcccgcagcccggtttgccgaccaggttccaccgttccagagtagccaagcgaatcccgagtctggttcgcgcgatggcggaggagcagtccaacccccagccccagcaagcggaggagagggaggttatggtggagcagcagcagcagccgaggagggccccgaagctgaggtacctggacttcgtc

SEQ ID NO: 3587 - protein, 38 aa, Zea mays
  misc_feature: Ceres CLONE 289047-F
MAEEQSNPQPQQAEEREVMVEQQQQPRRAPKLRYLDFV

SEQ ID NO: 3588 - DNA, 106 bp, Zea mays
  misc_feature: Ceres CLONE 289065-F
acgcacaccgcgacccagtccagagccagtacgtgcgamggccacgcacgctgctggtccgcgtacsagacgacggtcaggtcggccggtgcttttcagtttggaa

SEQ ID NO: 3589 - DNA, 113 bp, Zea mays
  misc_feature: Ceres CLONE 289080-F
  misc_feature (18)..(18): n is a, c, t, g, unknown, or other
  misc_feature (19)..(19): n is a, c, t, g, unknown, or other
cacgcacaccgcgacccnntccagagccagtacgtgcgamggcacgcacgctgctggtccgcgtacsagacgacggtcaggtcggccggtgcttttcagtttggaataatgac

SEQ ID NO: 3590 - DNA, 435 bp, Zea mays
  misc_feature: Ceres CLONE 289089-F
  misc_feature (109)..(109): n is a, c, t, g, unknown, or other
  misc_feature (278)..(278): n is a, c, t, g, unknown, or other
atgttctgatctgcttctccagtctccacacaacacaacagagcagaaggcagcacgggcgctgatgtcgatgggggaggcgctgcgggctggcttgcgctgacgcgtnggtgacattcctgtgggtgctgtgcgtctccacgctgggggcctcgacgacggcggtgacgtcctacctgaggctgcagggcgtccacttcgcgctcctggtcaccgtctccctcctctccgtcctcctcttcgtcttcaatatcctttgckacgcactcggcggcgtnagcttcaaccccaccggcgtcgsccttctacgccgccggagtcaccagcccctctctcttctccatcgcgctccgattaccggcacaggctgccggcgctgtgggcggtgctcttgccatctcggagctgattccggcgcagtacaggcacatgctt

SEQ ID NO: 3591 - DNA, 378 bp, Zea mays
  misc_feature: Ceres CLONE 289134-F
  misc_feature: Translation starting site: 90
  misc_feature (114)..(114): n is a, c, t, g, unknown, or other
gtagccgccgccgsctccaactctaaccccgtcgcttccggctcccgcagcgtcgccgaccttcacagccggttccttcatccgccaccatggggaagacacgtggtatggganctgggcgcaastcaagacccaccgcagaaccagaggtggctgacaaagcatacaagaagagccacttgggcaatgagtggaaaaaaccttttgctggatcatctcacgccaaggggcatcgttctggagaagattggtattgaggccaagcagccaaattcggccatccgtaagtgtgcccgtgttcagctgggtgaagaatggaaagaagattgctgcctttgtgccggaatgatggttgcctaaacttacatcgaggagaat

SEQ ID NO: 3592 - DNA, 236 bp, Zea mays
  misc_feature: Ceres CLONE 289153-F
  misc_feature: Translation starting site: 105
  misc_feature (150)..(150): n is a, c, t, g, unknown, or other
gtctttcggtattcgcyttgacacgcagactaggcgccabytcctgcgaactgtctctacccttgacgaaggaagaggcagcyttctcaccgtcgcacccggcgatgcagcggcacgtcgccttcckgccggccgtcgggcacggackcnccgacttttcttaccgcatggtcgtcgaatcccggtaccagagggtcgccgagggcagatcccgcctcgygcgcytcatcctcgtg

SEQ ID NO: 3593 - DNA, 399 bp, Zea mays
  misc_feature: Ceres CLONE 289156-F
  misc_feature: Encodes the peptide sequence at SEQ ID NO. 3594
  misc_feature (168)..(168): n is a, c, t, g, unknown, or other
gaggtatcgagtctcgaccaacccatacgcacctaccctccgccaccgttccccccctctgcatctcgcccgccgttctcgtccttgtagatctcctcgcacctcgcccattcgcttcaccaagggtttaagaccggcggcgatggcggcgamstggcgcacgtgcsnacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgatttgtgtcaagcaggtatggaataacaggaaggacct

SEQ ID NO: 3594 - protein, 51 aa, Zea mays
  misc_feature: Ceres CLONE 289156-F
MEKNKQYVVQPPTVEKCQELSKQLFYTRLASLPGRYESFWKELDLCQAGME

SEQ ID NO: 3595 - DNA, 113 bp, Zea mays
  misc_feature: Ceres CLONE 289157-F
  misc_feature (58)..(58): n is a, c, t, g, unknown, or other
aytcatacatttcgactctcaactcccaaggtcccttttttttctcgatctggaagcnccgcagtagcagccatggacgtgagckgacgaggcgggaaggcgaagaagggcgc

SEQ ID NO: 3596 - DNA, 114 bp, Zea mays; identical to SEQ ID NO: 3239
  misc_feature: Ceres CLONE 289175-F

SEQ ID NO: 3597 - DNA, 238 bp, Zea mays
  misc_feature: Ceres CLONE 289183-F
  misc_feature (108)..(108): n is a, c, t, g, unknown, or other
actgattgggttggcagcgcgccgcggcagcagagggggagagagagaggcagagcgagcgagcgagagagcgctggtcatggcgtcactgtctgtygccgccgtggncaaccatagcgatgccaagcagcagcgtgggaagggcgccgtctcagggtcgcgtccatggccacccagaagggccatawgccgacgcccaagaccgtctccggcacgagaagatcgggcacgacgacgg

SEQ ID NO: 3598 - DNA, 127 bp, Zea mays
  misc_feature: Ceres CLONE 289258-F
acacgcacaccgcgacccagtccagagccagtacgtgcgamgcacgcacgctgctggtccgcgtacsagacgacggtcaggtcggccggtgcttttcagtttggaataatgacggcgacgacgacga

SEQ ID NO: 3599 - DNA, 247 bp, Zea mays
  misc_feature: Ceres CLONE 289277-F
  misc_feature (39)..(39): n is a, c, t, g, unknown, or other
  misc_feature (120)..(120): n is a, c, t, g, unknown, or other
  misc_feature (232)..(232): n is a, c, t, g, unknown, or other
ctaaatcctcggttcccaaatggcgacgcgccgactgcnctgctgttgctcctcgcggcggcasggcattccacggcgcgacggcgaagasatcgatcgagccgtgctctggcgcggacnstrcccggctcttctgggctacaagctctacgcggacatgawtgtgtccgaggtggcggcgctcttcggcgccacccggcagckktactkgctgccaacgcgctcgacttbncctctccaggcgccg

SEQ ID NO: 3600 - DNA, 410 bp, Zea mays
  misc_feature: Ceres CLONE 289290-F
  misc_feature: Encodes the peptide sequence at SEQ ID NO. 3601
agatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgavcagcaccatggtccgcgtcgacgacctcaccggcacgaccgcggctgccaacaacatgatggacatacactcactcatcatgtctttgaaacttcacccaaatttgagatcaagactgccaattttgtgaactcatggggcgatgggggtgctagtttatggtctctgggtctagtgcagaccaaggagtacagccaccaaaggaaattttatccagatgttctttcttgcccctcaaga

SEQ ID NO: 3601 - protein, 115 aa, Zea mays
  misc_feature: Ceres CLONE 289290-F
  misc_feature (35)..(35): Xaa is any aa, unknown, or other
MASAAAATQVGTYFLRNYYNLLQQTPDVVHQFYSXQHHGPRRRPHRHDRGCQQHDGHTLTHHVFETSPKFEIKTANFVNSWGDGGASLWSLGLVQTKEYSHQRKFYPDVLSCPSR

SEQ ID NO: 3602 - DNA, 465 bp, Zea mays
  misc_feature: Ceres CLONE 289312-F
  misc_feature: Encodes the peptide sequence at SEQ ID NO. 3603
agcacattcttccccgagtcgccgtcgtctgctccgggctgctgttctgcgcctccacaaggcttttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtactcccaggctgactgtgctgtcctgatcattgactccaccactggt

SEQ ID NO: 3603 - protein, 113 aa, Zea mays; identical to SEQ ID NO: 3420
  misc_feature: Ceres CLONE 289312-F
  misc_feature (5)..(113): Pfam Name: GTP_EFTU Pfam Description: Elongation factor Tu GTP binding domain
  misc_feature: SWISSPROT Homolog: EC 2.7.7.4 Sulfate adenylyltransferase

SEQ ID NO: 3604 - DNA, 197 bp, Zea mays
  misc_feature: Ceres CLONE 289342-F
gctcaacgccttccacgggcgcacctcgacgtgccttgagctagggtttcctctgccgctacctccgttttacgcggccggcgcgcacgcatggcgatggtgcaggcgggcatgggcctcacccgggtcgtggtcctcgttggcgccggcgtcgcgtcccgtcgttctccgcaacggtcgcctcgccgagatcctcg

SEQ ID NO: 3605 - DNA, 446 bp, Zea mays
  misc_feature: Ceres CLONE 289422-F
attattagaatccacctcgcaccccgcgagcktgacttccctagggtttagtcgcgccgccgccgccgccgaaacagcacatcgctctctcgatctcagccatggcgaggtggagcagccccaggacgcggtgaagctcttcaaccgctggaccttcgacgatgtccaggtgaacgatatctcgctgaactactacctggctgtgactgcggcgaacgacgcgacattcctgccgcactccgcggggcgctactccaagaagcggttccgcaaggcgcagtgcsaatcgtcgagcgcctcaccaactcgctcatgatgcacgggcgcaacaacggcaagaaggtcatggcccgtccgcatcatgaagcacaccctggaggatcatccacctgctcactgacgccaatcccatccaggtggtcgtggacgccattatcaacagtgga

SEQ ID NO: 3606 - DNA, 683 bp, Zea mays
  misc_feature: Ceres CLONE 289463
  misc_feature: Encodes the peptide sequence at SEQ ID NO. 3607
cttagcttccattccatccatcatatcgcgcccatggatcatcgtcagccgccgccgaataagacggcggagcttgaccccgtgctgcactccatcggcttccagatcgaggaggtgtcgccgtcgcaggtcaccggccggctccccgtcacacccaggtgctgccagccgttccaggtgctccacggcggcgtgtcggcgctggtggcggagggcctggccagcatgggcgcgcacatggcgtcgggcttccgccgggttgccggcgtcagchtcaccatcaaccacttccgcagcgccaaggtgggagacgtcgtcctcgtccgcgccgccccgctccacgtcggccgttcgacgcaggtgtgggacgtgaagctatggaaggaggatcagcaggggaagaaggggagtcagatatccgagtcaagggtgacgctgctatgcaacctgcccgtgccggacatcctcaagcacgctggcgatgcactcaagaagtatgccgacgcccccgccgcccaaaaacccaccgccaccagcagattgtagatatatagttaagttattagtagagtgatatgcagagatttatttattttaatacataacgatataaacactcattactcatacatgtatatctagtatacaattgtacacctacatgaacaaaaaaaaaaaaaaaa

SEQ ID NO: 3607 - protein, 170 aa, Zea mays
  misc_feature: Ceres CLONE 289463
  misc_feature (47)..(124): Pfam Name: 4HBT Pfam Description: Thioesterase superfamily
  misc_feature (81)..(81): Xaa is any aa, unknown, or other
MDHRQPPPNKTAELDPVLHSIGFQIEEVSPSQVTGRLPVTPRCCQPFQVLHGGVSALVAEGLASMGAHMASGFRRVAGVSXTINHFRSAKVGDVVLVRAAPLHVGRSTQVWDVKLWKEDQQGKKGSQISESRVTLLCNLPVPDILKHAGDALKKYADAPAAQKPTATSRL

SEQ ID NO: 3608 - DNA, 116 bp, Zea mays
  misc_feature: Ceres CLONE 289466-F
acacgcacaccgcgacccagtccagagccagtacgtgcgamrcacgcacgctgctggtccgcgtacbagacgacggtcaggtcggccggtgcttttcagtttggaataatgacggc

SEQ ID NO: 3609 - DNA, 457 bp, Zea mays
  misc_feature: Ceres CLONE 289491-F
  misc_feature (140)..(140): n is a, c, t, g, unknown, or other
  misc_feature (231)..(231): n is a, c, t, g, unknown, or other
atcttgctctgaacgcattcctcccatctcccaagacctcctcagacccgagaagcgcmkgcgggccatggacgccaccggcactggagctggagggaaggcgaagaagggagcggccggtcgcaaggycgcgggcgagngaagaagtcggtgacgaggtccgtgaaggccgggctccagttccccgtcggccgcatcgggcgctacctcaagaagggccgctacgcgcancgtcggcagcggtgcccccgtytacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggsgcgtgttgcccaacatcaacccggtcctgctgccca

SEQ ID NO: 3610 - DNA, 112 bp, Zea mays
  misc_feature: Ceres CLONE 289516-F
  misc_feature (19)..(19): n is a, c, t, g, unknown, or other
acacgcacaccgcgacccngtccagagccagtacgtgcgamgcacgcacgctgctggtcctcgtacgcgagacgacggtcaggtcggccggtgcttttcagtttggaataat

SEQ ID NO: 3611 - DNA, 114 bp, Zea mays
  misc_feature: Ceres CLONE 289543-F
acacgcacaccgcgacccagtccagagccagtacgtgcgamgkcacgcacgctgctggtccgcgtacsagacgacggtcaggtcggccggtgcttttctagtttggaataatga

SEQ ID NO: 3612 - DNA, 426 bp, Zea mays
  misc_feature: Ceres CLONE 289546-F
  misc_feature (115)..(115): n is a, c, t, g, unknown, or other
aaattcgcttcgatccccagaggcacagacgagacgacagagatgaaggacggaacgtygtcggggggaggggcgttcgctgcgggcagsatccaaggcagccgtcgacggcganacatacgcgccgccgaagctgtcgccccaggacctacccatcgactatgcaggcttcctcgccgtcgccttcgstcctcggcgtcatgctccgctacaaggtgtgctcgtggatcgcaatcatcttctgcgctcagtcgttggcaaacatgaagactttgagaacgatctgaagcagctttctatggccttcatgtttgctgttatgggtctggtgacgaactatttttggccccgctcgtcccaggcagtacaaagcgctaaactgcggaagaacatgtgctacattcttcataggactttttggtgctt

SEQ ID NO: 3613 - DNA, 130 bp, Zea mays
  misc_feature: Ceres CLONE 289589-F
acgcacaccgcgacccagtccagagccagtacgtgcgamggcacgcacgctgctggtccgcgtacsagacgacggtcaggtcggccggtgcttttcagtttggaataatgacggcgacgacgacgacagc

SEQ ID NO: 3614 - DNA, 202 bp, Zea mays
  misc_feature: Ceres CLONE 289619-F
  misc_feature: Encodes the peptide sequence at SEQ ID NO. 3615
agtgcccgckgtgctagtgacggttgctctagatccgttcatcctggtggttttgtgaggtcgaaagcggcgagcgaattagaagatgctggacaagctgtgggacgacgtggtggccgggcctcgccgaaggacggccttcgagaagctccgcaaggccaccaccgcccgcccgctcgtcatcaacaaagacgcggacggc

SEQ ID NO: 3615 - protein, 39 aa, Zea mays
  misc_feature: Ceres CLONE 289619-F
MLDKLWDDVVAGPRRRTAFEKLRKATTARPLVINKDADG

SEQ ID NO: 3616 - DNA, 328 bp, Zea mays
  misc_feature: Ceres CLONE 289641-F
  misc_feature: Encodes the peptide sequence at SEQ ID NO. 3617
atcaccaagttttggattccagcagcggcgcccccaggccaggccccacccgctcagcctcctcagctgcccaaccttctccccatctgctcagcctcagctgtcattcccgcgavcgtctcccagctctatcgatggaccgagtcgccgccctcgtcgtcgcgctcctcgccctcttcttcgccgccggggccacggscaggccccggcctcgtcgcccaagcgcactccagcgccasccacccaggacggccttcctcccgccgccgccggccagggcgcctatggcctccccgccctcgcctcccgcgatggcgccggtgcccgc

SEQ ID NO: 3617 - protein, 64 aa, Zea mays
  misc_feature: Ceres CLONE 289641-F
  misc_feature (22)..(22): Xaa is any aa, unknown, or other
  misc_feature (35)..(35): Xaa is any aa, unknown, or other
MDRVAALVVALLALFFAAGATXRPRPRRPSALQRXPPRTAFLPPPPARAPMASPPSPPAMAPVP

SEQ ID NO: 3618 - DNA, 487 bp, Zea mays
  misc_feature: Ceres CLONE 289670-F
  misc_feature: Translation starting site: 303
  misc_feature (419)..(419): n is a, c, t, g, unknown, or other
acaaacctctcctggcacgagatcacgcttctcgtcggatcgaacagctagggtttccaagatgttcgggcgcgcgcgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaatgcagcgaatgggagangatgtggttcatcctctgaaggtttctctggaggatttgtacaatggcacatcgaagaagctctctct

SEQ ID NO: 3619 - DNA, 117 bp, Zea mays
  misc_feature: Ceres CLONE 289703-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacggc

SEQ ID NO: 3620 - DNA, 458 bp, Zea mays
  misc_feature: Ceres CLONE 289737-F
  misc_feature: Translation starting site: 89
  misc_feature (68)..(68): n is a, c, t, g, unknown, or other
  misc_feature (145)..(145): n is a, c, t, g, unknown, or other
  misc_feature (333)..(333): n is a, c, t, g, unknown, or other
cacacccctcacaaaccacaaacacatctctaggcggcggcggcggcagagacaggcggcggcgcsangcggttgggcagcgtcatccatggtgcacgtgaacttctatcgcaactatggtaagactttcaagaagccaaggcgnccttatgagaaggagcgccttgatgctgagttgaaattagtgggtgaatatggcctgaggtgcaagcktgactgtggcgtgtgcagtatgccctcagccgcatccgaaatgctgcaagggagctgctcacccttgatgagaagaacccccgtcgtatctttgagggcgaggcactcctgcgccgcatnaaccgctatggtcttctcgggtgagggccagaacaagcttgactatgtgcttgcmtcaccgttgagaactttctgcagcgccgccttcagaccattgtcttcaagaatggcatggcgaagtccat

SEQ ID NO: 3621 - DNA, 478 bp, Zea mays
  misc_feature: Ceres CLONE 289760-F
  misc_feature: Encodes the peptide sequence at SEQ ID NO. 3622
atcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtgatgg

SEQ ID NO: 3622 - protein, 133 aa, Zea mays
  misc_feature: Ceres CLONE 289760-F
  misc_feature (15)..(133): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSD

SEQ ID NO: 3623 - DNA, 246 bp, Zea mays
  misc_feature: Ceres CLONE 289777-F
atctccctgtttaatcaatccttcaagcgcaaskgcctcctcctcgtcgtccggtcgtgagaagggatggcgggccgtggcaaggctatcggcgctggcgccgaaagaaggcaacgtcgaggagctccaaggccggactccagttccccgtcggcaggattgccaggttcctcaaggcgggcaagtacgcggagcgttcggcgccggcgccccgtgtacctcgccgccggtcctcgagtacctcgc

SEQ ID NO: 3624 - DNA, 438 bp, Zea mays
  misc_feature: Ceres CLONE 289803-F
  misc_feature (164)..(164): n is a, c, t, g, unknown, or other
gcggttttgcacttctcgccttctctaatctctttgcctctttggctccctccaccaccagtccaccaccactgctacccaacccttgcttccccaaaccctagccaagggacacggtggccgacgatggacggcgacggaggaggcgctggtgcstgcacacncacacgcgctcacccgaggacgtcttccgcgatttccgcgcgcgccgagccggcatcgtcaaggcgctcaccacggatgtgaggaagttctatcagcagtgcgatccagagaaagagaacttgtgcctttatggtttgccaaatgagacttgggaggtcactcttccagctgaggaagtacctcctgagcttccaaccagcactggggataaactttgcccgtgatggaatggtcgaaaaagactgggttgtctctagttgcagttcatagtga

SEQ ID NO: 3625 - DNA, 154 bp, Zea mays
  misc_feature: Ceres CLONE 289814-F
  misc_feature (43)..(43): n is a, c, t, g, unknown, or other
attcattcatcactcaccagtcaccaccactgccgcgaccgdnagagtcagagagagtaggcggcggcaatggctggcgctggggacgagtactactacggcgggccgggccagcgcggcgcgcccacggcctgctgctggcggtggtggtggg

SEQ ID NO: 3626 - DNA, 225 bp, Zea mays
  misc_feature: Ceres CLONE 289819-F
atcacacactcgactctcctctctcgcatccgcagcctttcgagctctactccaccccctcgatctcgaagcgcragcagcagtcaggcggccatggacgcgagcgcmcggagccggygtgwwggcgaagaagggcgcggccgggcgcaaggccggcgggcaggaagaagtcggtgacgaggtccgtcaaggccgggctgcagtttcccgtcggccgcatcgggc

SEQ ID NO: 3627 - DNA, 211 bp, Zea mays
  misc_feature: Ceres CLONE 289838-F
  misc_feature: Encodes the peptide sequence at SEQ ID NO. 3628
  misc_feature (87)..(87): n is a, c, t, g, unknown, or other
agatcgacatcgatccaccgaggtttcttgtgcgtgccgccatggccatggcagtagctcaccttcttcctcagctctccgccgamnattgggagctagcaggaacagaatggccattctcttgattcttcagctttttctcttgacggcgctaggcgtggatggagcggcgtcgttcatcttcaccaacgcctgcwagcacgcggtgtgg

SEQ ID NO: 3628 - protein, 70 aa, Zea mays
  misc_feature: Ceres CLONE 289838-F
  misc_feature (29)..(29): Xaa is any aa, unknown, or other
  misc_feature (66)..(66): Xaa is any aa, unknown, or other
DRHRSTEVSCACRHGHGSSSPSSSALRRXLGASRNRMAILLILQLFLLTALGVDGAASFIFTNACXHAVW

SEQ ID NO: 3629 - DNA, 181 bp, Zea mays
  misc_feature: Ceres CLONE 289877-F
  misc_feature (67)..(67): n is a, c, t, g, unknown, or other
atcaacgagcaggcgtgcacatggagcccacgccagcggccgcgcatccacctccagtccccgcaknctgccgtgccgacgcgggcggtcgagcctgggcggacgcgcgcatcaccgtggccgcgcccccgctcccaccggccgcgctgcagcgcgcactcgcgtggtgctctactaccgc

SEQ ID NO: 3630 - DNA, 381 bp, Zea mays
  misc_feature: Ceres CLONE 289885-F
  misc_feature: Encodes the peptide sequence at SEQ ID NO. 3631
  misc_feature (106)..(106): n is a, c, t, g, unknown, or other
  misc_feature (108)..(108): n is a, c, t, g, unknown, or other
  misc_feature (240)..(240): n is a, c, t, g, unknown, or other
atcaaaccctcacagcgaaggacacaaaaacacaggtagggttaggcgacgcggcggcgagagcgcgagagtaggaggaggcgtcggccatgacggggaaggcgansnagaagcacacggcgaaggagatcgccgcgaagatcgacgcggcgacgacgaaccggggcggcggcaaggtcgggcaggcggatcggctagggcaggacaagggcgggcacgckaastggcgtgccctccttnccgcaccccggcgcccgacatcaagtccatgcagatccaccacgaggcgcgccatcccaagctccctttcgagccggagaagctcgtcaacctgcactcctccacccccgccgccgccgaggccaccacctccaagcccaa

SEQ ID NO: 3631 - protein, 126 aa, Zea mays
  misc_feature: Ceres CLONE 289885-F
  misc_feature (35)..(35): Xaa is any aa, unknown, or other
  misc_feature (36)..(36): Xaa is any aa, unknown, or other
  misc_feature (74)..(74): Xaa is any aa, unknown, or other
  misc_feature (75)..(75): Xaa is any aa, unknown, or other
  misc_feature (80)..(80): Xaa is any aa, unknown, or other
SNPHSEGHKNTGRVRRRGGESARVGGGVGHDGEGXXEAHGEGDRREDRRGDDEPGRRQGRAGGSARAGQGRARXXACPPXRTPAPDIKSMQIHHEARHPKLPFEPEKLVNLHSSTPAAAEATTSKP

SEQ ID NO: 3632 - DNA, 492 bp, Zea mays
  misc_feature: Ceres CLONE 289897-F
  misc_feature: Encodes the peptide sequence at SEQ ID NO. 3633
  misc_feature (196)..(196): n is a, c, t, g, unknown, or other
  misc_feature (197)..(197): n is a, c, t, g, unknown, or other
aaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagaatggcgacggaggcgtccctgtcgtgcgtccgctcgtggggcggcgcgctctcgtccatcacccacctcgtgtac

SEQ ID NO: 3633 - protein, 97 aa, Zea mays
  misc_feature: Ceres CLONE 289897-F
  misc_feature (1)..(97): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MQDYVVDGFMKNTNCDDPELKEKLTRLCKTTTVRTRYVVMSDEILKNYPELAQEGLPTMNQRLDISNAAVTRMATEASLSCVRSWGGALSSITHLVY

SEQ ID NO: 3634 - DNA, 1322 bp, Zea mays
  misc_feature: Ceres CLONE 289900
  misc_feature: Encodes the peptide sequence at SEQ ID NO. 3635
acccattccataccccaccttgcgtacgcgagccgaacgctcgtgggtactgcagcctccgtccctacctagggttccggcgatggcgcacggcggctacccgcgccgcggcgctgccgtacgcaggcccaagtcctcggcctctgccgctgttgccgaccgcaagcggaagcggaccgccgccgccgccaagaccacctcccttaagaaccagatccgctccaccgagcgcttcctccgcaaggaccttccggatgagattagggttgctcaagagaagaaactggaagaactgaagaggcaacaagagcttcagaatcaacttgttgtccagcggacattacagtttagagatagaaagataaaattctttgagagacggaagattgagaggatgataaggcgactcgagaagcaacaacgttcaaatggtgacggtgtcaacaataatctgtcaaaattgcgagaagatcttgaatatgttagattcttccctaagaatgagaaatatgtctcgctgttcactggagggaacagtcaagatattgttcaagagaggaataaatggcgcaaacagatcaaggagaatctcatggctgctgcagcaaacggaaaagatttagaagagacagcaagcgacgacgataccttggatgtgagtgatgatgacttctttatgtctggaagttcaagtgatgaagaggctgatgatgagtggactgacaaaagtgctaaggaaccagcatccagtgcttcaggtagggcagcatctggcatgtcaagtgatgaaaagaaccagcgtcagagagatgctcgagttcttatgccgccaccacgctcattagccccaaatagaggcagacatgcagataaacgtgcgatatccagctcgagcagtacttcaaacagcacaagcggcgaatcatttaaaaatagaagagtaccaaatcgccccgcggataataacagtaatctgagctcaaattctgatgttcataaaccacggcgcaaaaggaggcataagaagaaaagaaagctggcatgatgaatattcccaaagcgcgtgaactgtgggggtccggtggaaattcagattcccagcgaagtttggactttgagcatggccaatttggagaagttgaaaaaaaaatagacacagcatgtgcgatgtgtctgagcaagttgattgattctgtatcctcactcctaaaacgactgtacatccatctgttcatggatatcacttgcggtaccgaatgcttgtccatcatttccgccgtgaaattatgtatgtttttttctctccaaaaaaaaaaaaaaaa

SEQ ID NO: 3635 - protein, 320 aa, Zea mays
  misc_feature: Ceres CLONE 289900
MAHGGYPRRGAAVRRPKSSASAAVADRKRKRTAAAAKTTSLKNQIRSTERFLRKDLPDEIRVAQEKKLEELKRQQELQNQLVVQRTLQFRDRKIKFFERRKIERMIRRLEKQQRSNGDGVNNNLSKLREDLEYVRFFPKNEKYVSLFTGGNSQDIVQERNKWRKQIKENLMAAAANGKDLEETASDDDTLDVSDDDFFMSGSSSDEEADDEWTDKSAKEPASSASGRAASGMSSDEKNQRQRDARVLMPPPRSLAPNRGRHADKRAISSSSSTSNSTSGESFKNRRVPNRPADNNSNLSSNSDVHKPRRKRRHKKKRKLA

SEQ ID NO: 3636 - DNA, 104 bp, Zea mays
  misc_feature: Ceres CLONE 290030-F
atcacacactcgactctcctctctcgcatccgcarcctctcgagctctactccactccctcgatctcgaatcgtagcagcagtcaggcggccatggacgcgagc

SEQ ID NO: 3637 - DNA, 494 bp, Zea mays
  misc_feature: Ceres CLONE 290054-F
  misc_feature: Encodes the peptide sequence at SEQ ID NO. 3638
gtctctatcttctccatccgtgacacgtccggcagctccatcgagttcgaggactagccgccgccgccgcacctgcacgcacgccaagggacgggagagcaagagggagatccgaggaggtcaaagatgatctaccgcaattgtcgctgctctcgtcgacggtcgtcatctggggcggcgtcgcaccgccggcctggccgtaatcttcctcttgggcggcaaggagaaattcagtcagtatctgtgccgcgaaggcgagaggcttaggcagcaggacagagccacgatcggcatgcaaaactagagaggaagcatatgtaagcctgttcgatatataaaggtcagaaaagcttgctctgtatgtyagcagtaataaaacttgtgctggctttcaatttccccagcaaaacttgctctgtatgtcagtagtaataagctgactctggtttgtcgtgggttcagtgcttgtttggcatcaacttgtgcgacatggt

SEQ ID NO: 3638 - protein, 46 aa, Zea mays
  misc_feature: Ceres CLONE 290054-F
MIYRNCRCSRRRSSSGAASHRRPGRNLPLGRQGEIQSVSVPRRREA

SEQ ID NO: 3639 - DNA, 493 bp, Zea mays
  misc_feature: Ceres CLONE 290061-F
  misc_feature: Translation starting site: 141
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaaggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctcttctgtccc

SEQ ID NO: 3640 - DNA, 500 bp, Zea mays
  misc_feature: Ceres CLONE 290074-F
  misc_feature: Encodes the peptide sequence at SEQ ID NO. 3641
  misc_feature (198)..(198): n is a, c, t, g, unknown, or other
aaacctctagctgattgatctctggtttaccactctttccttccctccttcaattctaaataccacaaatcaaagttgctttgcgatggtgagcagcagcatggacacgacgagtgacaaacgttcgtcatccatgctggctcctaaccctggcaaggccacgatcctcgcccttggccacgccttcccgcagcakhntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacgagatggcgacggaggcgtccctgtcgtgcgtccgctcgtggggcggcgcgctctcgtccatcacccacctcgtgtacgtctcgtcg

SEQ ID NO: 3641 - protein, 77 aa, Zea mays
  misc_feature: Ceres CLONE 290074-F
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRSSSMLAPNPGKATILALGHAFPQXXVMQDYVVDGFMKNTNCDDPELKEKLTRLCKTTTVRLGTW

SEQ ID NO: 3642 - DNA, 330 bp, Zea mays
  misc_feature: Ceres CLONE 290084-F
  misc_feature: Encodes the peptide sequence at SEQ ID NO. 3643
  misc_feature (195)..(195): n is a, c, t, g, unknown, or other
aaccaggggttttgctagggttctcatcctgccgccacagcgatggccgctgccgccgccgsaggtacgacgcggcgtgggagcgcgccatctccgccgccaccaagtccacctcggcgcccaagaccctcaccctcgacggcgccgtcaagtcctccacgggcggcctcccctccgccgcgctcctcgagcttncgccgcctccctcgaggagctctccgtcgcgggggcgcgcctctcctcgctcgcgggcctgccccgcctcccggcgctccggcgcttctccctccccgacaaccgcctctcgggggccgccgcctcgccgccgtc

SEQ ID NO: 3643 - protein, 109 aa, Zea mays
  misc_feature: Ceres CLONE 290084-F
  misc_feature (65)..(65): Xaa is any aa, unknown, or other
PGVLLGFSSCRHSDGRCRRRRYDAAWERAISAATKSTSAPKTLTLDGAVKSSTGGLPSAALLELXPPPSRSSPSRGRASPRSRACPASRRSGASPSPTTASRGPPPRRR

SEQ ID NO: 3644 - DNA, 241 bp, Zea mays
  misc_feature: Ceres CLONE 290196-F
  misc_feature: Translation starting site: 59
  misc_feature (197)..(197): n is a, c, t, g, unknown, or other
acagtcatccacactaacgaacgaactgaggtcgacgacgactgatcgagcagcgacgatggcggctgtgctgaacacaggaagacgccgcagtggttgccgtgctggtggcggcggcgctgctggcgtcgtccgcttcggcgcgatcacctgcgggcaggtgggggtcgtcgctggctccgtgcatcccgtacgcnacggggagggccagcgcgctccccgcgtcgtgctgcagcggcgt

SEQ ID NO: 3645 - DNA, 349 bp, Zea mays
  misc_feature: Ceres CLONE 290228-F
  misc_feature: Encodes the peptide sequence at SEQ ID NO. 3646
aggactcagcgggctccaaagccgacgaggataaagaggagcccggctcgcacgcggasagaggatcgccggcgcaggatgtggtgcgcatcgtgcttggcgtccgctgcgcggctgcacctgcaacctctgcacgtcggcggcatcggccgtgttcccgccgctccgcgcgcctcgcttactgcggcctcttcgccgcctcccttatcctctccttcttgctccgccagttcgccgcgccgctcctcaagcatatcccatggataaatgcgtttgatcaaacaccaccagaagaatggtttcaaatgaatgctgttcttcgtgtaagcctgggggaacttcttggttc

SEQ ID NO: 3646 - protein, 115 aa, Zea mays
  misc_feature: Ceres CLONE 290228-F
  misc_feature (19)..(19): Xaa is any aa, unknown, or other
DSAGSKADEDKEEPGSHAXRGSPAQDVVRIVLGVRCAAAPATSARRRHRPCSRRSARLAYCGLFAASLILSFLLRQFAAPLLKHIPWINAFDQTPPEEWFQMNAVLRVSLGELLG

SEQ ID NO: 3647 - DNA, 449 bp, Zea mays
  misc_feature: Ceres CLONE 290247-F
  misc_feature: Encodes the peptide sequence at SEQ ID NO. 3648
ctttttttcctcgagtttcctattttcctctcctcccccacagcagcccggcgaaaaccctagtaagcaaaccaccggagcagcggcgcttgcssagcggagccatggcgacgacgattacaacgaaattgacatggggtatgaggatgagcccccagaaccgggagattgaggaaggagctgaagaagagcctgagaacaatgaagatgcccctgatgacgtcataggtggtgaggggtgaagataaggaacaggaaaagaccaagcgtgaacgcaaaacaacaaaatacatgacgaatacgaacgtgcgcgcatcctgggtacacgagccttgcagataagcatgaatgctccagtcatggttgagcttgagggagaaactgaccctcttgagattgcaatgaagggagctgagagcgcgcaagatacccttcacgatcagacgtta

SEQ ID NO: 3648 - protein, 45 aa, Zea mays
  misc_feature: Ceres CLONE 290247-F
MATTITTKLTWGMRMSPQNREIEEGAEEEPENNEDAPDDVIGGEG

SEQ ID NO: 3649 - DNA, 424 bp, Zea mays
  misc_feature: Ceres CLONE 290255-F
  misc_feature: Encodes the peptide sequence at SEQ ID NO. 3650
  misc_feature (66)..(66): n is a, c, t, g, unknown, or other
ctcagcctcgtcctccgcctccgctcccgctctctcctctccttggcctccgcttccgctcccgcntggaggctgcatcaaaccctaccgctccggacctcccggctggccgcgagatgcgacgcctgtccggcccctaatccttctcgatactgcccctcgcccgcccgybcgccggcatgggccgctacgggcctttccctgccgccgccggtgatggcgrgggctgcctgcccttgccgattgtagcggctgaaggcgcgctggctgtcctggacggcgccattgcgaccgcggccttcgtgcagttagcaaggattcataggcacaaccagctacaaggatggactcggcaaaagatattccattttatgattgggtctatcaaacatagtattcctagtatatttcgtgtctaccatca

SEQ ID NO: 3650 - protein, 81 aa, Zea mays
  misc_feature: Ceres CLONE 290255-F
  misc_feature (15)..(15): Xaa is any aa, unknown, or other
MGRYGPFPAAAGDGXGCLPLPIVAAEGALAVLDGAIATAAFVQLARIHRHNQLQGWTRQKIFHFMIGSIKHSIPSIFRVYH

SEQ ID NO: 3651 - DNA, 187 bp, Zea mays
  misc_feature: Ceres CLONE 290259-F
  misc_feature (45)..(45): n is a, c, t, g, unknown, or other
  misc_feature (46)..(46): n is a, c, t, g, unknown, or other
  misc_feature (126)..(126): n is a, c, t, g, unknown, or other
aagaaaccccacatttgcatgggcaagcacctacctgccgccgcnncgccgccgccgccgccgsggttcgctcgtacgcccgcagccttcgcgtcccatccgataccgccgcatcctrcmgggadngcagataagacgccgtctgccccgctggatacgcccaggaaatccgctgccgccgctgccg

SEQ ID NO: 3652 - DNA, 380 bp, Zea mays
  misc_feature: Ceres CLONE 290265-F
  misc_feature: Encodes the peptide sequence at SEQ ID NO. 3653
  misc_feature (137)..(137): n is a, c, t, g, unknown, or other
gtagtcctaggcactttcatctgtggcctctgcgttcgagatcgatctgagctggcaccgtcccacttcgccatggcggaggaccgtagccccaagcccatccactgyaaagcggcggtgtgcagagccgccggcrngccactcaccatcgaggagatcgtcgtcgacccgccgaaagcgtacgagatccgcatccgggtcgtctgcacctcactctgccacaccgatatcaccttctggaaagctaaggtggcaccggtgtttccaagaatactagggcatgaggcgtacggggtagtggagagcgtgggggagcacgtggagggcttcgcggcgggggacaccgtggtgccgacgttcctggggcagtcgagcgctgc

SEQ ID NO: 3653 - protein, 102 aa, Zea mays
  misc_feature: Ceres CLONE 290265-F
  misc_feature (36)..(102): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (22)..(22): Xaa is any aa, unknown, or other
MAEDRSPKPIHCKAAVCRAAGXPLTIEEIVVDPPKAYEIRIRVVCTSLCHTDITFWKAKVAPVFPRILGHEAYGVVESVGEHVEGFAAGDTVVPTFLGQSSA

SEQ ID NO: 3654 - DNA, 130 bp, Zea mays
  misc_feature: Ceres CLONE 290272-F
attccgcagacgcgcggcgagggagtaggaggcgacggcgggtgccgaggcccgcagcacggggaagctaccggctagcgtmcgggcgggctcgcgctttgctgtcgctccatgtcggtcgccggcgaga

SEQ ID NO: 3655 - DNA, 122 bp, Zea mays
  misc_feature: Ceres CLONE 290297-F
tccccactgcttccaaccctcccgcctcttcctaatccgcctcctcccgctcagtcgccgccgtggaggaaggagcaactcgatcgccagtcatgacccggggagagaaccaggagtcgcag

SEQ ID NO: 3656 - DNA, 235 bp, Zea mays
  misc_feature: Ceres CLONE 290308-F
  misc_feature: Encodes the peptide sequence at SEQ ID NO. 3657
  misc_feature (56)..(56): n is a, c, t, g, unknown, or other
  misc_feature (115)..(115): n is a, c, t, g, unknown, or other
gccgtctccactccgcgttccctggctccctgcgttgcgtcttgggggagagaganaaktgggataccgcgagaggctgccgtgtagggactagggaccgtagagtaagcgacanaggagggagagggggatggccgggatcgggccgatcagacaggactgggagccggtggttgtgcggaagaaggcacccaccgccgctgccaagaaggatgagaaggccgtcaacgccgcg

SEQ ID NO: 3657 - protein, 35 aa, Zea mays
  misc_feature: Ceres CLONE 290308-F
MAGIGPIRQDWEPVVVRKKAPTAAAKKDEKAVNAA

SEQ ID NO: 3658 - DNA, 190 bp, Zea mays
  misc_feature: Ceres CLONE 290316-F
  misc_feature: Encodes the peptide sequence at SEQ ID NO. 3659
gacgaattcttcccccctctccgatctcgacgcgcaccgatgcgggcgatgtcgtcggcggttaatggtatgctgcgggcacggctgcgcggggcacgcgcgttckbgcggcggcggcgagggggccggcggtggacgaccccaggtcacgaggagcgccccaaggggtacctcttcaaccggccgccgc

SEQ ID NO: 3659 - protein, 50 aa, Zea mays
  misc_feature: Ceres CLONE 290316-F
  misc_feature (23)..(23): Xaa is any aa, unknown, or other
MRAMSSAVNGMLRARLRGARAFXRRRRGGRRWTTPGHEERPKGYLFNRPP

SEQ ID NO: 3660 - DNA, 382 bp, Zea mays
  misc_feature: Ceres CLONE 290354-F
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (107)..(107): n is a, c, t, g, unknown, or other
adaccctcacagcgaaggacacaaaaacacaggtagggttaggcgacgcggcggcgagagcgcgagaktaggaggaggcgtcggccatgacggggaaggcgannnangaagcacacggcgaaggagatcgccgcgaagatcgacgcggcgacgacgaaccggggcggcggcaaggtcgggcaggcggatcggctagggcaggacaaggkcgggcacstaastggcgtgcsctcctgccgcaccccggcgcccgacatcaagtccatgcagatccaccacgakgcgcgccatcccaagctccctttcgagccggagaagctcgttcaacctgcactcctccaccccckccgccgccgaggccaccacctccaakcccaatccc

SEQ ID NO: 3661 - DNA, 470 bp, Zea mays
  misc_feature: Ceres CLONE 290365-F
aacagccctacaacttactgcttgctctagctagctagctgctcccggcccatatccactacacaagtaggctagcagcagcagcagcaatggcctcggtgacgagttcccggccgtggcctcgtcctgctgctcgccgccagckccttcctggccagcgaggtggcggcgtgcggcggctgcccgaaaccaactcctcctcctccatcgccaccaccgccgtcgcccaccagcacgccgtscctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgcsgacctggaggccgccgtctgcctctgcaccgcgctcaaggccaacgtgctcggcatcaacctcgacgtccccgtcaagctcaccc

SEQ ID NO: 3662 - DNA, 494 bp, Zea mays
  misc_feature: Ceres CLONE 290392-F
  misc_feature: Translation starting site: 328
  misc_feature (39)..(39): n is a, c, t, g, unknown, or other
  misc_feature (281)..(281): n is a, c, t, g, unknown, or other
  misc_feature (349)..(349): n is a, c, t, g, unknown, or other
ctgccactccactcctaccccacacagaagcggcggcgncggasaaacgcaggcgaaggcgagggtgtgagggaaggagcaccagccatggygacgtcaacttctaccgcaactatggtaagacgttcaagaaaccaaggcgtccttatgagaaggagcgtcttgatgctgaactgaagctggtcggtgagtatggctgaggtgcaagcktgastttggagggtccagtatgcactgagcaggatccgtaatgctgcaaggcacttstcacccttgacganaagaacccccgtcgtatcttttgagggtgaggcgcttcttcgccgcatgaaccactatgggctgcttnctgagggtcagaacaagcttgattatgttcttgccctcaccgctgagaacttcctcgcaaggcggcttcaaacacttgtcttcaaggctggcatggccaagtccattcaccatgctcgtgtctttgatcaagcagcgtcacatca

SEQ ID NO: 3663 - DNA, 97 bp, Zea mays
  misc_feature: Ceres CLONE 290471-F
aataataagaaaaatactcccgtgttcttcgaccggcggcggtggtgcgamgaggcggtaagggagacgagatgagggggacgaagcggccgctcgg

SEQ ID NO: 3664 - DNA, 111 bp, Zea mays
  misc_feature: Ceres CLONE 290501-F
acgcacaccgcgacccagtccagagccagtacgtgcgamgcaacgcacgctgctggtccgcgtacsagaacgacggtcaggtcggccggtgcttttcagtttggaataatg

SEQ ID NO: 3665 - DNA, 211 bp, Zea mays
  misc_feature: Ceres CLONE 290551-F
  misc_feature (130)..(130): n is a, c, t, g, unknown, or other
  misc_feature (156)..(156): n is a, c, t, g, unknown, or other
acagctgaaasagccaaaacgcagaagctgcactgcatacatcgagctaactatctgcagcgatgtctcgctcctgctgcgtcgccgtgtcggtgcttctcgctgtcgccgcgacagcatcgccaccgcncggcatggctgcacgaggaggccatngcacgggccgctggtcgcaaagggttcmatggtggcsscctccgcgtccacctgg

SEQ ID NO: 3666 - DNA, 422 bp, Zea mays
  misc_feature: Ceres CLONE 290557-F
  misc_feature: Encodes the peptide sequence at SEQ ID NO. 3667
aggacaggcatgctgaactaggcgaggtggactgggcgagcgagcgagatggagtggacgacggtggagacgagggacggcgcgamgtgagcgtgcggctgttcaagcccccgcgtccggaacgggttggagccggagccgagggaggatgtggcggtggtgctggtgcatccctacaccatcctcggcggcgtgcagggcctgctgcgggggatggcggagggcgtcgcgcggcggggttacaccgcgtcaccttcgacatgcgcggcgcgggccggttccacggggcgggcgtcgctcacgggctccaccgaagtcggggacgtcgtcgccgtctgccgatgggtcgcagagaacatcaagccgcgcgcatcctcctcgtcggatcctcagctggggcacaatttcccggatctgcagtt

SEQ ID NO: 3667 - protein, 69 aa, Zea mays
  misc_feature: Ceres CLONE 290557-F
MAEGVARRGYTASPSTCAARAGSTGRASLTGSTEVGDVVAVCRWVAENIKPRASSSSDPQLGHNFPDLQ

SEQ ID NO: 3668 - DNA, 516 bp, Zea mays
  misc_feature: Ceres CLONE 290616-F
  misc_feature: Encodes the peptide sequence at SEQ ID NO. 3669
aaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctggctcctgtgtcgttgtcaaggactacggtgaagaatctgagggccttaacatagtgcagggagtatgtcaagtcgcactagatgtaacac

SEQ ID NO: 3669 - protein, 124 aa, Zea mays
  misc_feature: Ceres CLONE 290616-F
  misc_feature (25)..(117): Pfam Name: Ribosomal_L7Ae Pfam Description: Ribosomal protein L7Ae/L30e/S12e/Gadd45 family
MADQEAPVAVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIDSEGKARKVVGWLLCRCQGLR

SEQ ID NO: 3670 - DNA, 277 bp, Zea mays
  misc_feature: Ceres CLONE 290731-F
  misc_feature (150)..(150): n is a, c, t, g, unknown, or other
aatcatcctctccgtgtaggccgcgggattccgtgtccctctccaatccggcgtmrttcgttcgccggatacaggatccggtccccgcgatggagccctcaccaacctcctcctcgccggctgtggcgcgccggttgtcgccggagtaangagggtgccgaatcgggcgctggaggagttgttggagcagggtccagcgggctgttgagatgctgcgcgatgccgacgctgatctcgccatctctctctcggaggagaccgcagcagcctcgccgga

SEQ ID NO: 3671 - DNA, 483 bp, Zea mays
  misc_feature: Ceres CLONE 290780-F
  misc_feature: Encodes the peptide sequence at SEQ ID NO. 3672
attgggagctcactcgctggtcgttgcctgctgcggattgcccccaggcgggccccactcattccgctgctgatatttcgtttggttctcctttccgtcttgtccgtcgccgaggccttccgctcgctccccagctccagcaggcagatcagatccatccaaccacgaacaggaaggaaggtaggaggaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggacctcttctacggcgagcaggcccccgccgccgccgcccttaagacagattcggtgctca

SEQ ID NO: 3672 - protein, 92 aa, Zea mays
  misc_feature: Ceres CLONE 290780-F
MSAVAVSSSLNPNAPLFIPAALLQVEDFSPQWWDLITTTAWFRDHWSREHAHLDEIAEQLELVALLAYDEDEDLFYGEQAPAAAALKTDSVL

SEQ ID NO: 3673 - DNA, 486 bp, Zea mays
  misc_feature: Ceres CLONE 290785-F
  misc_feature: Encodes the peptide sequence at SEQ ID NO. 3674
gcattccgcctgctggacttcctcgtgctgtgtctctgtctgtcgctctcgctctcagacgactgggccgccgcgcttggtgctgaggctttcgttggtctcttcggcggcgacgagcacccaccagcagttctgtagaaatggctgatggtgaggacatccagcctcttgtctgcgacaatggcaccggaatggtcaaggctggttttgctggggacgatgcaccaagggcggttttccctagcattgttggccgtcctcgccacactgggtgtcatggtagggatgggacagaagggatgcatatgttggcgatgaaggcacagtccaagagaggtattctcacggctcaagtacccgatttgagcacggtattgtgagcaactgggatgacatggagaaaaatctggcatcatactttctacaacgagcttcgtgttgcaccagaggagcaccctgtgtttgctcactgaggctcctttgaac

SEQ ID NO: 3674 - protein, 79 aa, Zea mays
  misc_feature: Ceres CLONE 290785-F
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGCHGRDGTEGMHMLAMKAQSKRGILTAQVPDLSTVL

SEQ ID NO: 3675 - DNA, 326 bp, Zea mays
  misc_feature: Ceres CLONE 290809-F
  misc_feature: Translation starting site: 126
actctctccttctccccctacttccctacgtaccaggaggctaccactcccccagagtgaaggaagagagagctctccgcctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcgsccgagcgcccgcagcaccgggaaggtgatgccggacgagtacgacgagcggtcctactgcctatacgacactgacgcctcctcggtgtacggcgtctccgctttcttcg

SEQ ID NO: 3676 - DNA, 396 bp, Zea mays
  misc_feature: Ceres CLONE 290823-F
atgcgctacggtggtttgtagtttagtctactcaacccatggtgttgaaacttgactatasttgtbtcaatgagactttggagtgaaccaaatgagcttatgttcctatatgactattagctagaagttagagcctagatgatggctgcttctgttggcgtgaaagctcgagtgctcctaaatggtcgttgtattagctgatacgacatcgacccgatgcaatagataatattgtttacacgckcgagtycaaaattgttggctttgagtcggagcagttaacacgagaagtgtatttkatcacttctgagtgcaccttttttttrttatttttccgagcttctgcctcttgcatatgttgtagattctcgtcgagaagggagtagtagtattacc

SEQ ID NO: 3677 - DNA, 501 bp, Zea mays
  misc_feature: Ceres CLONE 290825-F
  misc_feature: Translation starting site: 317
  misc_feature: SWISSPROT Homolog: EC 2.3.1.74 Naringenin-chalcone synthase
  misc_feature (195)..(195): n is a, c, t, g, unknown, or other
  misc_feature (196)..(196): n is a, c, t, g, unknown, or other
aacctctagctgwttgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgycttccygyagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagaatggcgacggaggcgtcccttgtcgtgcgtccgctcgtggggcggcgcgctctcgtccatcacccacctccgtgtacgtctcgtcc

SEQ ID NO: 3678 - DNA, 438 bp, Zea mays
  misc_feature: Ceres CLONE 290826-F
agtcagtgagagaaatgtaggcaccacaaatcggtccakbaaatccctgctcgtgctctaccaaaaaatccagtcttttttccagcccaaaatcccgcctcttccgctgctgccataaagtccggactttacgaggctttcacgacgtgcgagatttctgttatcgatctccacgaacccgatagcctgccataaagtctgcacagacgcttcgcattgcttcaaccaaagatccatccaaactctgcaccccagaaagctagtacgatctcggggggacatgaagcgcctgcagtgcttcaagaagagcagcggcgcgcaatkgtggcgggccggggaagcgccttgagcgcggctgtcgctgggcgagtacaagaaggcagtgtcgtggtccaagtacctcgtagcgccgccgggggctagatccggagcggcggc

SEQ ID NO: 3679 - DNA, 419 bp, Zea mays
  misc_feature: Ceres CLONE 290870-F
  misc_feature: Translation starting site: 124
  misc_feature (70)..(70): n is a, c, t, g, unknown, or other
  misc_feature (291)..(291): n is a, c, t, g, unknown, or other
  misc_feature (378)..(378): n is a, c, t, g, unknown, or other
atccatccaaccaggcgagccaacaagcaagcaaaagtaaacggggcgaggagctggagakamgccggcnacgcgaaraccgcccgatcggagccgcggctgagcaggaggagggagccggagatggtgggtctcgtcggcggcacacggcgcgggcggasactcgtcgccaacgccggagggaggcagaktacgtgcvccgcatgcaccgccacgcgccgaccgakcaccagtkcacctccaccctcgtcaagcacatcaaggcgcccgtccacctcgtgtggcagctcntgcggaggttcgaccagccgcagcggttacaagccgttcgtcaggaactgcgtcgtgcgcggggaccagctcgaggtcggcagcctncgcgacgtcaacgtcaagaccggcctgccggcgtacgacca

SEQ ID NO: 3680 - DNA, 105 bp, Zea mays
  misc_feature: Ceres CLONE 290881-F
acacgcacaccgcgacccagtccagagccagtacgtgcgamgcacgcacgctgctggtccgcgtacsagacgacggtcaggtcggccggtgcttttcagtttgga

SEQ ID NO: 3681 - DNA, 178 bp, Zea mays
  misc_feature: Ceres CLONE 290912-F
  misc_feature: Encodes the peptide sequence at SEQ ID NO. 3682
  misc_feature (115)..(115): n is a, c, t, g, unknown, or other
  misc_feature (118)..(118): n is a, c, t, g, unknown, or other
agggtttcttcggaggctttatttatcgtttatccacggaacttccggtgccggcgggaccacttgtgcgatccatccctcaccatgtcgtcggagaaggaggcggcgctcgcgnggnccttcgatgacagcccaaccatatttgacaagatcatcaaaaaggaaataccttctactg

SEQ ID NO: 3682 - protein, 31 aa, Zea mays
  misc_feature: Ceres CLONE 290912-F
  misc_feature (11)..(11): Xaa is any aa, unknown, or other
  misc_feature (12)..(12): Xaa is any aa, unknown, or other
MSSEKEAALAXXFDDSPTIFDKIIKKEIPST

SEQ ID NO: 3683 - DNA, 460 bp, Zea mays
  misc_feature: Ceres CLONE 290916-F
  misc_feature (230)..(230): n is a, c, t, g, unknown, or other
  misc_feature (421)..(421): n is a, c, t, g, unknown, or other
atcttgctctgaacgcattcctcccatctcccaagacctcctcagacccgagaagcgcmkgctggccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcscancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacgggncgtgttgcccaacatcaacccggtcctgctgcccaagaa

SEQ ID NO: 3684 - DNA, 202 bp, Zea mays
  misc_feature: Ceres CLONE 290918-F
  misc_feature: Encodes the peptide sequence at SEQ ID NO. 3685
  misc_feature (132)..(132): n is a, c, t, g, unknown, or other
tccccccactacccaaacccaacaggcggcgcmsagcatcgccaccaccgtccaaagagcaaagatggtgaagttcctcaagcccggcaaggccgttatcctcctccagggccggttcgccgcggaagytgnattcgtgcgcgttttcgaggagggcaccgtgatcgtccctacggcactgcctcgtcgcgggcctcgctaa

SEQ ID NO: 3685 - protein, 45 aa, Zea mays
  misc_feature: Ceres CLONE 290918-F
  misc_feature (22)..(22): Xaa is any aa, unknown, or other
  misc_feature (23)..(23): Xaa is any aa, unknown, or other
MVKFLKPGKAVILLQGRFAAEXXFVRVFEEGTVIVPTALPRRGPR

SEQ ID NO: 3686 - DNA, 136 bp, Zea mays
  misc_feature: Ceres CLONE 290965-F
acacgcacaccgcgacccagtccagagccagtacgtgcgamggcacgcacgctgctggtccgcgtacsagacgacggtcaggtcggccggtgcttttcagtttggaataatgacggcgacgacgacgacagccgcc

SEQ ID NO: 3687 - DNA, 168 bp, Zea mays
  misc_feature: Ceres CLONE 290971-F
  misc_feature (26)..(26): n is a, c, t, g, unknown, or other
  misc_feature (117)..(117): n is a, c, t, g, unknown, or other
acgcaacctcccactgcattctcgdnttacgattcccaatccagcaaaccctaccagccttttgcaaactcagagagggacccgatggcacccaaggcggagaagaagccggcgsanagaagcccgcagaggaggagcccgcggccccggcggagaaggcccccgctg

SEQ ID NO: 3688 - DNA, 482 bp, Zea mays
  misc_feature: Ceres CLONE 291000-F
gaatgttcttttatgcttcactgagtattcctatagctatcgttcagctcctggtggtgctacgggggtgactgcgggggcgactgcggctggtggctgttgtcctcatcgaccatctcggcgacgtcctactcgagcgagatctcgctgcagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaaaagtggaagctgctaggaagcaggaagagttgcaatctgtttgatgccttttctagaacatatctgtggttagaactttgtcaga

SEQ ID NO: 3689 - DNA, 421 bp, Zea mays
  misc_feature: Ceres CLONE 291099-F
  misc_feature: Translation starting site: 71
  misc_feature (282)..(282): n is a, c, t, g, unknown, or other
  misc_feature (302)..(302): n is a, c, t, g, unknown, or other
aaccctagccgcactgcgctcatttctgcatccccctcccgccgcgccgcctcaccgccgccgggagaagatgggtcgcgtgatccgcgcgcastatagggtgcggggtccgtgttcaagtcccacacccaccaccgcaaggccccgccgcttccgctccctcgacttcggcgagcgcaacgggtactcaagggcgtcgtcaccgagtcatccacgaccccggccgtggcgcgccgctcgccaagggtcactttccgccacccattcaggtacaagcaccanaaggagctctttgttcgcanccgagggcattttacacgggccagttcgtctactgcggtcgccgcgccaccctctccatcggcaacgtgctgcccctccgcgggatccctgagggtgccgtcgtctgcaacgtcgagca

SEQ ID NO: 3690 - DNA, 378 bp, Zea mays
  misc_feature: Ceres CLONE 291143-F
  misc_feature: Encodes the peptide sequence at SEQ ID NO. 3691
  misc_feature (192)..(192): n is a, c, t, g, unknown, or other
  misc_feature (288)..(288): n is a, c, t, g, unknown, or other
  misc_feature (304)..(304): n is a, c, t, g, unknown, or other
gcgctcgcytcccttctcctcccccatcctctcccttgtggttctagatccactcctccccgtgctcactgctcatccgcgaacaggttgagcggggacgccgtggaggggcgagggggagccagattgagccatggcctcctcctgggttcttgccctggttcttgcgctgtcggcaggcgcaastagcgntggctcagagccgtggtggaacgagacacaggtgtacgccaccaccgccaactccggtggsgccaacggcgtcttcgtcggcctcacgctcatccngtcggcggcggccaanggagcggtgtgcttggatggragcttaccaggttaccacctccacagagggtttggatcaggggscaaacagtt

SEQ ID NO: 3691 - protein, 81 aa, Zea mays
  misc_feature: Ceres CLONE 291143-F
  misc_feature (18)..(18): Xaa is any aa, unknown, or other
  misc_feature (20)..(20): Xaa is any aa, unknown, or other
  misc_feature (52)..(52): Xaa is any aa, unknown, or other
  misc_feature (57)..(57): Xaa is any aa, unknown, or other
  misc_feature (79)..(79): Xaa is any aa, unknown, or other
MASSWVLALVLALSAGAXSXGSEPWWNETQVYATTANSGGANGVFVGLTLIXSAAAXGAVCLDGSLPGYHLHRGFGSGXKQ

SEQ ID NO: 3692 - DNA, 712 bp, Zea mays
  misc_feature: Ceres CLONE 291156-R
  misc_feature (1)..(1): n is a, c, t, g, unknown, or other
ncaattgggtaccgggccccccctcgaggtcgacggtatcgataagcttttttttttttttttttggtcggggaaccaaccccctctacctgagtaattgtgcagtccatcaacttttaccgttaaagacaagaagaaaaattgaaaaagataaacaaaacctagaaaatttgaagttggctactgtgtggctcctggcacccgggggaccaaaagcttatttttaagcaaacaccgtacgcgcacggtcccaaaactgctctattcttttacgtgcgagatgagcctgtgcttatgaggcccgcagctgcagccgcacgccgatgaggctctatgccgcgctcaagccgctcttgtctcatcccgacgacctcagctgctgcctgacaacaggctctaacccatacgtgagctcgagaccaacctcctcttcctcctgatccactaccagcacctggctctggctgctggctggaagatcagcctcggcttggatcccgtgtgaggccgcctccacaaccgatgtactcatccgaccacccctgcagctgcaagtggtggtcgtggctgccaactgactcctcgctcctgttctggctcgaccaccatcgggacccgctgcagctcctccgcctctcgattgttgcatcggatcgacggctggaccacgcgctattcgatgttaccggcacataccctccagatccaggag

SEQ ID NO: 3693 - DNA, 483 bp, Zea mays
  misc_feature: Ceres CLONE 291174-F
  misc_feature: Encodes the peptide sequence at SEQ ID NO. 3694
  misc_feature (47)..(47): n is a, c, t, g, unknown, or other
  misc_feature (245)..(245): n is a, c, t, g, unknown, or other
gcgactgtkagcttcgttcgttcagttcatccgtgttcttgtttgcnaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggsggtttcgaggcggccgcgnagctgagaacggcgggtgcaagtkcggcggcaactgccagtgcgacccctgcaactgcggcaagttagctaggtgctccaccctgcaggccggccgagaatctagctaattattataagctaaataaagtatagckggcgtcgctgtgtgtgtttcgagtcagtcagtcagttagttgcgtgccatggctggcatgctctgagtctgagatgatgatgatgcctgattgcggcgtcgt

SEQ ID NO: 3694 - protein, 82 aa, Zea mays
  misc_feature: Ceres CLONE 291174-F
  misc_feature (1)..(68): Pfam Name: Metallothio_2 Pfam Description: Metallothionein
  misc_feature (61)..(61): Xaa is any aa, unknown, or other
  misc_feature (69)..(69): Xaa is any aa, unknown, or other
MSCCGGNCGCGSGCKCGNGCGGCSKMYPDMAEQVTTTTQALIMGVAPSKGHAEGGFEAAAXLRTAGASXAATASATPATAAS

SEQ ID NO: 3695 - DNA, 114 bp, Zea mays
  misc_feature: Ceres CLONE 291182-F
acacgcacaccgcgacccagtccagagccagtacgtgcgamrcaacgcacgctgctggtccgcgtacgagacgacggtcaggtcggccggtgcttttcagtttggaataatgac

SEQ ID NO: 3696 - DNA, 489 bp, Zea mays
  misc_feature: Ceres CLONE 291196-F
  misc_feature: Encodes the peptide sequence at SEQ ID NO. 3697
  misc_feature (119)..(119): n is a, c, t, g, unknown, or other
  misc_feature (256)..(256): n is a, c, t, g, unknown, or other
aaatttaaaagtaggacagcctagcgttccaattccaaggtccaagcctccaaggctgctcccagcaactcgtttctttcttcgagagagggcaaaaaccggcaaggggagcgarvtangkagtctcgagagcaagggagcgcggtgacgtcatcgttttccaaggtttctcgatcggctgctatggcgaccagggcggcgtcgagattcctgcagcgcrctcctgtcttccggcggcaaggtcctcagcgaggangataaggccgcggagaaaktgtacatcaagaaaatggaacaagakaagctggagaagctcgcacgcaagggccccagctcaggagagcaagcttcgtcgactacagtctctgcagcaagtgatgtgaaggctggggctgggccaacggagtcagcgtctgcaaacgtgtcaaccgacaagaacaggaactacgctgtcctggcaggcacaattgctgctctgagtggcctggg

SEQ ID NO: 3697 - protein, 66 aa, Zea mays
  misc_feature: Ceres CLONE 291196-F
  misc_feature (4)..(4): Xaa is any aa, unknown, or other
MEQXKLEKLARKGPSSGEQASSTTVSAASDVKAGAGPTESASANVSTDKNRNYAVLAGTIAALSGL

SEQ ID NO: 3698 - DNA, 381 bp, Zea mays
  misc_feature: Ceres CLONE 291216-F
  misc_feature: Encodes the peptide sequence at SEQ ID NO. 3699
ctctctctctccactggctgacgccgcgaccgccccaacccaactgcccttttcggagatctcgccgcctccgccgtcgacttccgtccccccctatcccgcgtccgggcttacccgatggcacggctgcactggcttgaggccgtcctaccgctggggatcatcggcggcatgctctgcatcatgggcaacgcagtaatttcatccacaaggccgcgcgcgcagtgccgaagcacatcgggaacgatatgtgggacgtcgccatggagcgccgcrcaaagaagctcgttggaacaatccctccggcaactagggtattgatcaacctcaaacttttctggatgttgacgaacctccttcaaaagcacagaagtactgctc

SEQ ID NO: 3699 - protein, 44 aa, Zea mays
  misc_feature: Ceres CLONE 291216-F
  misc_feature (10)..(10): Xaa is any aa, unknown, or other
MWDVAMERRXKKLVGTIPPATRVLINLKLFWMLTNLLQKHRSTA

SEQ ID NO: 3700 - DNA, 438 bp, Zea mays
  misc_feature: Ceres CLONE 291225-F
  misc_feature: Translation starting site: 215
  misc_feature (102)..(102): n is a, c, t, g, unknown, or other
  misc_feature (178)..(178): n is a, c, t, g, unknown, or other
  misc_feature (284)..(284): n is a, c, t, g, unknown, or other
  misc_feature (295)..(295): n is a, c, t, g, unknown, or other
  misc_feature (344)..(344): n is a, c, t, g, unknown, or other
aatccagtcgcatctycctctccgaaatcaaggtagcgtacaccgctgcagtttctagagccctctctgccactcgtgatcccactagtcacaatgcctgcnctcgccaagcccgcctcccgcaccgccaagcccgccgcggctccgaagccgaagcctgccgccgccaagccgamsncccaccgctggtgcctcccacccgccttacttcgagatgatcaaggaggctatcacggcgctcaaggagaggaccggctccagctcgcaagckatcgccaagtatntgggggacaancacgggcgcgtctctgccggccaacttcaagaagatgctttccatccangctccgtgggtccgcagccaagggcaagctcgtgaaggtcaaggcttcgtacaagctctcggacgccgccaagaagggcatcccccaagaccaa

SEQ ID NO: 3701 - DNA, 138 bp, Zea mays
  misc_feature: Ceres CLONE 291227-F
  misc_feature (31)..(31): n is a, c, t, g, unknown, or other
  misc_feature (70)..(70): n is a, c, t, g, unknown, or other
aacaacagcgaacacatctgcttcgcatttnttcccatcccccttcgcaacccaaaccccaactcgctbncatcgatggcgcccaaggccgagaagaagcccgcggcgaagaagccggcggaggaggagcccgcggct

SEQ ID NO: 3702 - DNA, 101 bp, Zea mays
  misc_feature: Ceres CLONE 291262-F
acacgcacaccgcgacccagtccagagccagtacgtgcgamgcacgcacgctgctggtccgcgtacsagacgacggtcaggtcggccggtgcttttcagtt

SEQ ID NO: 3703 - DNA, 400 bp, Zea mays
  misc_feature: Ceres CLONE 291263-F
  misc_feature: Encodes the peptide sequence at SEQ ID NO. 3704
  misc_feature (391)..(391): n is a, c, t, g, unknown, or other
atcttgctctgaacgcattcctcccatctcccaagacctcctcagacccgagaagcgcmkgcgggccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcgcasgttcggcagcggtgcccccgtctacctcgcggccgtcctggagtacctcgccgctgaggtcctggagctcgccggcaacgctgccaaggacaacaagaagacgcgcatcgtcccgccgccacgtgctgctggcgatccgcaacgacgaggagctcgggaanctgctgacc

SEQ ID NO: 3704 - protein, 94 aa, Zea mays
  misc_feature: Ceres CLONE 291263-F
  misc_feature (20)..(20): Xaa is any aa, unknown, or other
  misc_feature (76)..(76): Xaa is any aa, unknown, or other
LALNAFLPSPKTSSDPRSAXGPWTPPALELEGRRRRERPVARPRARKKSVTRSVKAGLQFPVGRIGRYLKKGRYAXVRQRCPRLPRGRPGVPRR

SEQ ID NO: 3705 - DNA, 219 bp, Zea mays
  misc_feature: Ceres CLONE 291285-F
  misc_feature: Encodes the peptide sequence at SEQ ID NO. 3706
  misc_feature (40)..(40): n is a, c, t, g, unknown, or other
  misc_feature (79)..(79): n is a, c, t, g, unknown, or other
  misc_feature (159)..(159): n is a, c, t, g, unknown, or other
  misc_feature (208)..(208): n is a, c, t, g, unknown, or other
aagcacaagcacaaccaaaagcaaagaagagacgaabstncgatcgatctcagcaactaagcaggtaggtaggcatggnggccgagaaggagggcgcggtggtgaccaagggccacgacgaggggatgaaggcggcggcggcgctgctggaggagttcnggctcccgccgggctgctgcgctggaggacgtgacggaggtggggttcntgcgggccacc

SEQ ID NO: 3706 - protein, 48 aa, Zea mays
  misc_feature: Ceres CLONE 291285-F
  misc_feature (2)..(2): Xaa is any aa, unknown, or other
  misc_feature (29)..(29): Xaa is any aa, unknown, or other
  misc_feature (45)..(45): Xaa is any aa, unknown, or other
MXAEKEGAVVTKGHDEGMKAAAALLEEFXLPPGCCAGGRDGGGVXAGH

SEQ ID NO: 3707 - DNA, 218 bp, Zea mays
  misc_feature: Ceres CLONE 291311-F
  misc_feature: SWISSPROT Homolog: EC 5.5.1.6 Chalcone isomerase
  misc_feature: The sequence is a functional homolog of SEQ ID NO 2 in US patent 7202398
  misc_feature (61)..(61): n is a, c, t, g, unknown, or other
acaaccgtagcctgtagcttcatccgttgwcgctgctcccggttccatcgcgcggtgcggnaatttaacatggccgtgcggaggtggtggtcgacggcgtctcttcccgccggtggcccgcccgccgggttccgccggctcgcacttcctcggcggcgcaggcgtgcgaggcctcgagatcggaggcaacttcatcaagttcacggccatcggcgtgt

SEQ ID NO: 3708 - DNA, 530 bp, Zea mays
  misc_feature: Ceres CLONE 291330-R
  misc_feature (321)..(321): n is a, c, t, g, unknown, or other
  misc_feature (460)..(460): n is a, c, t, g, unknown, or other
caattgggtaccgggccccccctcgaggtcgacggtatcgataagcttttttttttttttttttagaaatatgcctttagtaggcgtgatatagttatacatgcactgaacaaatacaatggttcatacgtgctctcatctagccttaaagtttccaggaaaatcctaatgggcgggtccggccaaaaaagggggttctcaaagaaaaaattggtttttaagggggaacaccatttcttttttgggcgcccccgcccccccttttttttttttgggggggggcccccccccaaaagggcccccaaaaggggggggggggcncccccaacaacacccccctttatttaaaaaaggggggggggggggggggggtctttttttttctccccccccctttcttcccccccccctattttttttttttttttgaaaaaaaaaaaaaaaaccacccccccccccnctggcttttggtggtgtgggtgggaaaacaaacaaacacccccccccctccccttttcccgggcgggggg

SEQ ID NO: 3709 - DNA, 218 bp, Zea mays
  misc_feature: Ceres CLONE 291348-F
  misc_feature: Translation starting site: 82
  misc_feature: SWISSPROT Homolog: EC 2.5.1.18 Glutathione transferase
  misc_feature (72)..(72): n is a, c, t, g, unknown, or other
  misc_feature (73)..(73): n is a, c, t, g, unknown, or other
gcaacaaagcatcttgagtgttcgacagcgagccatggagaagacgtccgagaacgccatcccgycggcggnnccccgctgatgctgttcgggtcgtgggcgagctcgtacacgcaccgggcagctggcgctsggctcaagggcctggagtacgactacgtggaggaggaccttggggaacaagagcgacgagctgctkcgccacaaccccgtccaca

SEQ ID NO: 3710 - DNA, 337 bp, Zea mays
  misc_feature: Ceres CLONE 291358-F
  misc_feature (153)..(153): n is a, c, t, g, unknown, or other
  misc_feature (154)..(154): n is a, c, t, g, unknown, or other
adatcgtcctccctcgtgcctcgctcgttgcgcgttcaaatttcgaaccacctccgccttcgacgccccaaaccctagcccgacccctccttccttccaccttgcgccaccgcccaccatgagctccgccgccgcgccagctgccgtcggrgnncaaggagcttgccaacccgcccgccgacgggatcaccaacctccgcttctccaaccacagcaacaacctcctcgtctcctcatgggacaagacggtgcggctctacgacgccgacgccaacgtgctcaagggggagttcatgcaccccggggccgtcctcgactgctgcttccacgacgactc

SEQ ID NO: 3711 - DNA, 158 bp, Zea mays
  misc_feature: Ceres CLONE 291364-F
  misc_feature (93)..(93): n is a, c, t, g, unknown, or other
atcactgccaaatcccccagaaagtcaactcctccccaattccacgctgccaccaactcgccgtcctccgcgccaagcaccaaagctccgatnggcccgcacgaagcagacggcgcgcaagttcaacgggcggcaaggcgccccgcaagcagctggcg

SEQ ID NO: 3712 - DNA, 135 bp, Zea mays
  misc_feature: Ceres CLONE 291368-F
aacacgcacaccgcgacccagtccagagccagtacgtacgaagcagcacgcacgctgctggtccgcgtacsagacgacggtcaggtcggccggtgcttttyagtttggaataatgacggcgacgacgacgacagc

SEQ ID NO: 3713 - DNA, 492 bp, Zea mays
  misc_feature: Ceres CLONE 291369-F
  misc_feature: Translation starting site: 64
  misc_feature (441)..(441): n is a, c, t, g, unknown, or other
gatttgacccatctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcaggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaascgccaaggsgcgcctcgaggagaggttcaakaccggcaanaacaggtggttctttaccaagctccgcttctagatggtcggcgtcccgaat

SEQ ID NO: 3714 - DNA, 375 bp, Zea mays
  misc_feature: Ceres CLONE 291390-F
  misc_feature (211)..(211): n is a, c, t, g, unknown, or other
aagaaccaacgtgctcgatctccatctcgaccgtcgctcaccgggaagctacgctacgacgaagcatggcgtccgtcaccgcccgcgccccggtcgcgccctgcgcccgtcggcgtctctcaagtcgtcgtcgtcgtcggcggcggccttccttggccactctagccgcctcggccgcactgctaccgcgtcgccgacgaggccasctaanaggcggaggccaagggcgagtggctcccgggccttccctcccccgcctacctcgacggcagcctgccgggttgacaatggcttcgacccgttgggcctggcggaggacccggagaacctgaggtggtacgtgcaggcggactggttgaacgggcggtgggcgat

SEQ ID NO: 3715 - DNA, 229 bp, Zea mays
  misc_feature: Ceres CLONE 291454-F
  misc_feature (100)..(100): n is a, c, t, g, unknown, or other
aagagaaaaatgaaatagaatggcagaaaacctaaacgtgaggttggcgaaaagagaaaagaactagagcatcccgtggagagaaggcggcggcasgctntgggagatgtcaatcctgtgggagaagagcgcgggttggcgatggctggttcggcggacgcgtgactcgaagcccttcttttttcacgtttcgcggcgcttgtgcggcgtcgttcccccggcgtaaatc

SEQ ID NO: 3716 - DNA, 482 bp, Zea mays
  misc_feature: Ceres CLONE 291456-F
  misc_feature: Encodes the peptide sequence at SEQ ID NO. 3717
awaccctagtctcagagcagccgcatccacaacctgcctctctcgtcccctggcggcgtccgsggcaggatggcggaatctacggcgaggacggtgaaggatgtcaacccgcacgagttcgtcaaggcctactccgcccacctcaagcgctccggcaagatggagctccctgagtgggttgacattgtgaaagactgcgaggtttcaaggagctttcctccctttatgatcctgactggtactacattcagggctgcatccattgcaaggaagatctacctaaggcaaggcatcggtgtgggtggctttcagaagatctacggtggccgccagaggaatggcttcccgcccaccacacttctgcaagagcagtggtgctgttgcacgcaacatcctgcagcagctgcagattatgggcatcatcgatgtcgatcccaaggttgacgcctcatcaccaaccaaggaaagcgttatcttgacca

SEQ ID NO: 3717 - protein, 124 aa, Zea mays
  misc_feature: Ceres CLONE 291456-F
  misc_feature (7)..(120): Pfam Name: Ribosomal_S19e Pfam Description: Ribosomal protein S19e
MAESTARTVKDVNPHEFVKAYSAHLKRSGKMELPEWVDIVKDCEVSRSFPPFMILTGTTFRAASIARKIYLRQGIGVGGFQKIYGGRQRNGFPPTTLLQEQWCCCTQHPAAAADYGHHRCRSQG

SEQ ID NO: 3718 - DNA, 221 bp, Zea mays
  misc_feature: Ceres CLONE 291465-F
  misc_feature (55)..(55): n is a, c, t, g, unknown, or other
atcgaacaaacatcgagtacagtcggctaggtaatctggtggtacgacgactgangacgacatggcggccaccagcagcaagtygtcgtcgtcctcgagctcggcgcacgggcagcagctgccgccctgctcgtggcggtgtccgtcctggtggtgggcgcggcggcggttgtgcgacatgagcaacgagcagttcatgtcgtgccagcccgcggggccaa

SEQ ID NO: 3719 - DNA, 134 bp, Zea mays
  misc_feature: Ceres CLONE 291489-F
acacgcacaccgcgacccagtccagagccagtacgtgcgamggcacgcacgctgctggtccgcgtacsagacgacggtcaggtcggccggtgcttttcagtttggaataattgacggcgacgacgacgacagcc

SEQ ID NO: 3720 - DNA, 357 bp, Zea mays
  misc_feature: Ceres CLONE 291493-F
  misc_feature (146)..(146): n is a, c, t, g, unknown, or other
  misc_feature (278)..(278): n is a, c, t, g, unknown, or other
gtcggagcagggcaggggttgcgtctcagttcctggttgtgttgttgtaagctcacaggtttcttctcttcgcgtgastagctagagtgggatcgcgaggaagaaggatgtcgtgctgcggaggcaactgcgggtgcggcacggantgcaagtkcggcacggctgcggagggtgcaagatgtacccggacatggttgagcaggtgaccaccaccaccaccacccagactctcatcatgggtgttgcgccatccacgggcgggttcgaggcggccgcgnagctgagaacggcgggtgcaagtgcggcgccactgcamcttgcgacccctgcacctgcaagttaggatgaccgggtgca

SEQ ID NO: 3721 - DNA, 191 bp, Zea mays
  misc_feature: Ceres CLONE 291509-F
  misc_feature: Encodes the peptide sequence at SEQ ID NO. 3722
cgaacaccaatkgcaktcttgcattgaaggaaccttccctccacctccaccgcccgatakckagckkccggacggggttttagttaggcatggmttccccggcgatgctccaagtggtgatcctcgccgcggtcctcctkctcccgttcctcagcgtgcygggcgccgaggcacagaccamgaagttctgc

SEQ ID NO: 3722 - protein, 34 aa, Zea mays
  misc_feature: Ceres CLONE 291509-F
  misc_feature (2)..(2): Xaa is any aa, unknown, or other
  misc_feature (24)..(24): Xaa is any aa, unknown, or other
  misc_feature (31)..(31): Xaa is any aa, unknown, or other
MXSPAMLQVVILAAVLLLPFLSVXGAEAQTXKFC

SEQ ID NO: 3723 - DNA, 96 bp, Zea mays
  misc_feature: Ceres CLONE 291514-F
agccatcacacgcatactgcatacacaacgcagagcatcagaagcagctgcgattctgatcgacatggctgccgcaccatggctatcacctcccgc

SEQ ID NO: 3724 - DNA, 360 bp, Zea mays
  misc_feature: Ceres CLONE 291519-F
  misc_feature: Encodes the peptide sequence at SEQ ID NO. 3725
  misc_feature (201)..(201): n is a, c, t, g, unknown, or other
  misc_feature (252)..(252): n is a, c, t, g, unknown, or other
ctagaaccctcttcccccgcgatggccgcaggagcgcggcgctcgcggcgscgcgtcccgaacgtgctagtgacggggacgccggggacgggaagacgaccacgtgctcgctccttgccgacgccgcagstccgccacgtcaacatcggcgacctagtccgcgagaagagccttcacgacggctgggacgccgacctcgantgccatgtcatcaacgaggacctggtgtacgacgagcttaaggacatgatngaataaggtggtatactagtagattaccacgggatgtgatttctktccagaacgttggtttkgacctcgtagttgtgctccagactgacaactcaattctgcatgatc

SEQ ID NO: 3725 - protein, 78 aa, Zea mays
  misc_feature: Ceres CLONE 291519-F
  misc_feature: SWISSPROT Homolog: EC 2.7.4.3 Adenylate kinase
  misc_feature (37)..(37): Xaa is any aa, unknown, or other
  misc_feature (60)..(60): Xaa is any aa, unknown, or other
  misc_feature (77)..(77): Xaa is any aa, unknown, or other
MAAGARRSRRRVPNVLVTGTPGTGRRPRARSLPTPQXRHVNIGDLVREKSLHDGWDADLXCHVINEDLVYDELKDMXE

SEQ ID NO: 3726 - DNA, 328 bp, Zea mays
  misc_feature: Ceres CLONE 291534-F
  misc_feature: Encodes the peptide sequence at SEQ ID NO. 3727
atcaccaagttttggattccagcagcggcgcccccaggccaggccccacccgctcagcctcctcagctgcccaaccttctccccatctgctcagcctcagctgtcattcccgcgarccgtctcccgactctatcgatggaccgagtcgccgccctcgtcgtcgcgctcctcgccctcttcttcgccgccggggccacggcgcaggccccgcctcgtcgcccaagcgcactccagcgccasccacccaggacggccttcctcccgccgccgccgccagggcgcctatggcctccccgccctcgcctcccgcgatggcgccggtgcccgc

SEQ ID NO: 3727 - protein, 64 aa, Zea mays
  misc_feature: Ceres CLONE 291534-F
  misc_feature (35)..(35): Xaa is any aa, unknown, or other
MDRVAALVVALLALFFAAGATAQAPPRRPSALQRXPPRTAFLPPPPPGRLWPPRPRLPRWRRCP

SEQ ID NO: 3728 - DNA, 219 bp, Zea mays
  misc_feature: Ceres CLONE 291545-F
  misc_feature (87)..(87): n is a, c, t, g, unknown, or other
  misc_feature (149)..(149): n is a, c, t, g, unknown, or other
acgccagggccgattctctgcgtgacttggggcgtcgtcgcgagttttctccggccgakggcggcgcgaccggacaaccagcgtganccgaccggcgacatgactcgcggcaaccagcgtgaccgcgaccgtgagckcgcggcggcganagcccaacgccaagaactcccaggacgggctcaccccggagcagcgccgcgagagggacaagaaagctct

SEQ ID NO: 3729 - DNA, 273 bp, Zea mays
  misc_feature: Ceres CLONE 291572-F
  misc_feature: Encodes the peptide sequence at SEQ ID NO. 3730
acaacaccagaatccgcgaatcacagacgcgtctatctcagcttgctgcactgcactaccctgccctgccatcatatcgtacgtgagcccggccgagcgagavgggaggaggcatggctgctccgaagctcgcgacgctggcgctggccgtgctcctggcggcgaccgtggtggctcccccggccgcggtgcgcgcgsgaatgtcgtgctccaccgtgtacagcacgctgatgccgtgcctgccgttcgtccagatgggcggggccatgccgc

SEQ ID NO: 3730 - protein, 53 aa, Zea mays
  misc_feature: Ceres CLONE 291572-F
  misc_feature (29)..(29): Xaa is any aa, unknown, or other
MAAPKLATLALAVLLAATVVAPPAAVRAXMSCSTVYSTLMPCLPFVQMGGAMP

SEQ ID NO: 3731 - DNA, 270 bp, Zea mays
  misc_feature: Ceres CLONE 291575-F
  misc_feature: Encodes the peptide sequence at SEQ ID NO. 3732
agactatctcagcgatttccgaaccctccccacccccacacccacccgatccaaccgagtcccggcggcgatggcggcggcgacgaacgcgatgtggaggtggtcgacttcgactcgatgacgacgacctcatggacgaggacgccgggccagatccagcaccgccccccgcctcccgcctccgctccaccatcgcgggcgacgacgcgccgstaggaccaagggccgcggcttccgsaggaccctaactcctccgctacccgcgactcg

SEQ ID NO: 3732 - protein, 38 aa, Zea mays
  misc_feature: Ceres CLONE 291575-F
  misc_feature (28)..(28): Xaa is any aa, unknown, or other
  misc_feature (36)..(36): Xaa is any aa, unknown, or other
MDEDAGPDPAPPPASRLRSTIAGDDAPXGPRAAASXGP

SEQ ID NO: 3733 - DNA, 115 bp, Zea mays
  misc_feature: Ceres CLONE 291590-F
  misc_feature (41)..(41): n is a, c, t, g, unknown, or other
acacgcacaccgcgacccagtccagagccagtacgtgcganrcacgcacgctgctggtccgcgtacsagacgacggtcaggtcggccggtgcttttcagtttggaataatgacgg

SEQ ID NO: 3734 - DNA, 215 bp, Zea mays
  misc_feature: Ceres CLONE 291602-F
  misc_feature (128)..(128): n is a, c, t, g, unknown, or other
atcacaattcacagcgctcaagttctcgcgcccacagccaaatttttctccactcaatcgcggcataagctgcactgcagcatggacgccagcggascggtagcaaggcgaagaagggggckgcttgncgcaagghtggcggccccaggwagaagtcggtgttcgcggtccgtcaaggccgggctgcagttccccgttcggccggatcgggcgct

SEQ ID NO: 3735 - DNA, 214 bp, Zea mays
  misc_feature: Ceres CLONE 291612-F
  misc_feature (93)..(93): n is a, c, t, g, unknown, or other
  misc_feature (97)..(97): n is a, c, t, g, unknown, or other
  misc_feature (166)..(166): n is a, c, t, g, unknown, or other
gatctgagatcgacatcgatccaccgaggtttcttgtgcgtgccgccatggccatggcagtagctcaccttcttcctcagctctccgccgamnattnggagctagcaggaacagaatggccattctcttgattcttcagctttttctcttgacggcgctaggcgtnggatggagcggcgtcgttcatcttcaccarcgcctgcaagcacgcggt

SEQ ID NO: 3736 - DNA, 424 bp, Zea mays
  misc_feature: Ceres CLONE 291635-F
  misc_feature: Translation starting site: 178
ctagccaaaaccctagcagccgcccggtgctcccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgt

SEQ ID NO: 3737 - DNA, 385 bp, Zea mays
  misc_feature: Ceres CLONE 291657-F
  misc_feature: Encodes the peptide sequence at SEQ ID NO. 3738
atcaatcaaatactcacacaaccatggggcacagcaggcgcmsacggcaaggacgacaccgaggagctgcttgcasccaccggcagctgtggtgccatgccctgggctacgtcaagtccatggcgctcaagtgcgccctggacctgcgcatccccgacaccatcgaccgctgcggcgggagcgccaccctgggcgagctgctcgcgccagcgagatcccggcgtccaaccacgactacctccgacgggtcatgcgcacgctgacagccatgcgcatcttcgcggtcagccacgacgaccccgccaaggccgacgacgcggccgccatctcttaccagctcaccccggcgtcccggctgctcgtcagcagcagcaggcagcagcgt

SEQ ID NO: 3738 - protein, 79 aa, Zea mays
  misc_feature: Ceres CLONE 291657-F
  misc_feature: SWISSPROT Homolog: EC 2.1.1.146 (Iso)eugenol O-methyltransferase
  misc_feature (7)..(7): Xaa is any aa, unknown, or other
  misc_feature (18)..(18): Xaa is any aa, unknown, or other
MGHSRRXRQGRHRGAACXHRQLWCHALGYVKSMALKCALDLRIPDTIDRCGGSATLGELLAPARSRRPTTTTSDGSCAR

SEQ ID NO: 3739 - DNA, 297 bp, Zea mays
  misc_feature: Ceres CLONE 291677-F
  misc_feature (246)..(246): n is a, c, t, g, unknown, or other
agtcgcctccttcctgcgccgccgccgccgccgccgctaccaccgcctcgsgccgcctgcgtcccgcgtttccgcacggaagttggtgaaggtttcttgaggctgagaacatggtgctgaagacggaactttgccgcttcagscaggaagatttatcctgggaaaggcattagatttatccgtgctgattctcaggtcttcctttttgccaactcgaaatgcaagskctacttccacaaccgcctnaagcctgcaaagcttacctggacagcaatgtacaggaagcagcacaagaag

SEQ ID NO: 3740 - DNA, 207 bp, Zea mays
  misc_feature: Ceres CLONE 291683-F
  misc_feature (62)..(62): n is a, c, t, g, unknown, or other
ctcctcctctatcttcgcatctggcacgagcagccaagcaaataaaagtagagcggcgagcncgaccggcctgggcaccctttcggccgagcgtacgagcaggtcgtcgtcgtcgtcgcagcaccccgccggctagcatggccacgaggaggcagtggtggtggtggtgcctgctgctgctggcggcgtggtgctgcgccgcggccg

SEQ ID NO: 3741 - DNA, 354 bp, Zea mays
  misc_feature: Ceres CLONE 291707-F
  misc_feature: Encodes the peptide sequence at SEQ ID NO. 3742
  misc_feature (210)..(210): n is a, c, t, g, unknown, or other
  misc_feature (293)..(293): n is a, c, t, g, unknown, or other
aacgtgcgttcatctgcagtgcacgaacaatcgagccagcaacataaacgatcgaggcgcggtggccgtagcaaccgcagcaagcatgaataactcgcgcgctctagtgttggtgctcctgctgctggccatcgccatggcgagctgcaggctctcgctcgccgcccacgagagcagcaccagcctcgcgacaccctcggccgcgacctncgggctccatcgccagggccgccggcaacctcttcagaccggacggtggctggcgcgccgcgaacgtcaccgccgacgccgangcaaataaccttagggccgtggcgtcccggagcggcggcccgcaccaggaagtcctccggc

SEQ ID NO: 3742 - protein, 71 aa, Zea mays
  misc_feature: Ceres CLONE 291707-F
  misc_feature (42)..(42): Xaa is any aa, unknown, or other
  misc_feature (70)..(70): Xaa is any aa, unknown, or other
MNNSRALVLVLLLLAIAMASCRLSLAAHESSTSLATPSAATXGLHRQGRRQPLQTGRWLARRERHRRRRXK

SEQ ID NO: 3743 - DNA, 277 bp, Zea mays
  misc_feature: Ceres CLONE 291751-F
  misc_feature: Translation starting site: 59
aaatcgaacgaacccagccgaagcgcgactgaagcaaggcgaggcggcgggaccggcgatggagcggctgcagcggatctttggcgcctccggcatggggcagccgccgacggactcgccgctgctcgactcctccgagcaggtctacatctcctccctcgcgcttctcaagatgctcaagcacgggagggccggcgtgcccatggaggttcatgggtcttcatgctcggcgagttcgtcgatgactacaccgtcaggtccgtcgacgtctttcacc

SEQ ID NO: 3744 - DNA, 98 bp, Zea mays
  misc_feature: Ceres CLONE 291752-F
atcacacactcgactctcctctctcgcatccgcrcctttcgagctctactccaccccctcgatctcgaagcgcvagcagcagtcaggcggccatggac

SEQ ID NO: 3745 - DNA, 162 bp, Zea mays
  misc_feature: Ceres CLONE 291799-F
gatataagawaccctagcggacgcacttaacacagtcgcctccttcctgcgccgccgccgccgccgccgccgccgctaccaccgcctcgsgccgcctgcgstccgcgtttccgcacggaagttggtgaaggtttcttgaggctgagaacatggtgctgaaga

SEQ ID NO: 3746 - DNA, 684 bp, Zea mays
  misc_feature: Ceres CLONE 291820-R
  misc_feature: SWISSPROT Homolog: EC 6.3.2.19 Ubiquitin--protein ligase
  misc_feature (488)..(488): n is a, c, t, g, unknown, or other
  misc_feature (542)..(542): n is a, c, t, g, unknown, or other
  misc_feature (547)..(547): n is a, c, t, g, unknown, or other
  misc_feature (548)..(548): n is a, c, t, g, unknown, or other
  misc_feature (667)..(667): n is a, c, t, g, unknown, or other
ccaattgggtaccgggccccccctcgaggtcgacggtatcgataagcttttttttttttttttttacaacgacattttttcagtcaggcgattacttgctggatcatgtaaggactcgttggtccatgacataatctctttctatctctcactatataatttacaaggtgctcttctggaagccacacacacacacgcccaaggcaagttgctgtctcactatacatcatggaagccgttgtgattcaatgtcgtttcctaccctcctgtggctgtcgcggcgcccaaagccaatggctggaggagcggtcctcgggacgacgtcgatctcagctttgcagagtgggcacagcgcatttatcttgagccatttgtcgacacagtccttgtggaagaagtgcccgcaagggagcaaccggagatcatcgttatccacgtacctcgccaagcagatacagcaaacggcgtcttcagcagaaacagcgcgnctcctgtccggttcaggagcaaagactccaccgccactttcgtttgcctcccgntacgnnagctctttgacctgaacctgtatgtgccccaggccttgatcgcatccgaagtagcacctctgtttttcgtcagatctttccggaaacccatccaggaaattattgcaggttagcagcancctatcaccgcccaaaa

SEQ ID NO: 3747 - DNA, 459 bp, Zea mays
  misc_feature: Ceres CLONE 291836-F
  misc_feature: SWISSPROT Homolog: EC 6.3.2.19 Ubiquitin--protein ligase
aaaggaattagaacggccgaagcggcacacaattcgcgcmrgcgtagaaactagaaagtccagtccccaaactccccagcgggcgagcagaggaggaagagtagccgccgccatgtctgggggaatcgcccgcggccgcctcgccgaggagcgcaaggcctggcgcaagaaccacccgcacggtttcgtcgcgamscggaktcgctgcccgacgagacggtgaacctgatgatctggcagtgcaccatccccggcaagcaagggactgactgggaaggtggatacttccctctcacccttcattttaggtgaggattaccctagcaagcctcccaagtgcaagttccctcagggtttcttccacccaaatgtatccttctggaacagtctgcctttcgatccttaatgaggacagtggttggagacagctattactgttagcagattctcgtcgggatc

SEQ ID NO: 3748 - DNA, 431 bp, Zea mays
  misc_feature: Ceres CLONE 291867-F
  misc_feature (290)..(290): n is a, c, t, g, unknown, or other
  misc_feature (365)..(365): n is a, c, t, g, unknown, or other
ctcaatctctctcttctcctcgcctcgccttggtgttcacgccgtcgctagcgcctgcygcgggcgaacgtttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcgggcgtgctaccggtgacattgtccccctcggcccctccatccctgacgcagcggcgccactgcaggaanccagcccctattcgagacaaggtcgatctttgctgccttggcgagcttcagcctaatcaaggtcgagcatggcgncaggcagtaaatagagcaacacaaaacccttcaaattaatggagacctctgcagcaaccccgaccc

SEQ ID NO: 3749 - DNA, 234 bp, Zea mays
  misc_feature: Ceres CLONE 291874-F
  misc_feature: Encodes the peptide sequence at SEQ ID NO. 3750
  misc_feature (105)..(105): n is a, c, t, g, unknown, or other
  misc_feature (163)..(163): n is a, c, t, g, unknown, or other
attacacactcgactctcctctctcgcatccgcagcctttcgagctctactccaccccctcgatctcgaagcgcragcagcagtcaggcggccatggacsgagcncmcggagccggcgggaaggcgaagaagggcgcggccgggcgcaaggccggcgggcganggaagaagtcggtgacgaggtccgtcaaggccgggctgcagtttcccgtcggccgcatcgggcggtacctg

SEQ ID NO: 3750 - protein, 47 aa, Zea mays
  misc_feature: Ceres CLONE 291874-F
  misc_feature (3)..(3): Xaa is any aa, unknown, or other
  misc_feature (5)..(5): Xaa is any aa, unknown, or other
  misc_feature (24)..(24): Xaa is any aa, unknown, or other
MDXAXGAGGKAKKGAAGRKAGGRXKKSVTRSVKAGLQFPVGRIGRYL

SEQ ID NO: 3751 - DNA, 180 bp, Zea mays
  misc_feature: Ceres CLONE 291932-F
  misc_feature: Encodes the peptide sequence at SEQ ID NO. 3752
aatccaattcacaggctcaccacaccaaccaacaagcaaaaattccccaatcctctcgtctccgcggcgaagatgtcggggcgcggcaagggcggcaagggcctgggcaagggcggcgcgavstcaccggaaggtcttgcgcgacaacatccaggggatcacgaagccggcgatccggag

SEQ ID NO: 3752 - protein, 36 aa, Zea mays
  misc_feature: Ceres CLONE 291932-F
  misc_feature (17)..(17): Xaa is any aa, unknown, or other
MSGRGKGGKGLGKGGAXSPEGLARQHPGDHEAGDPE

SEQ ID NO: 3753 - DNA, 428 bp, Zea mays
  misc_feature: Ceres CLONE 291940-F
  misc_feature: Encodes the peptide sequence at SEQ ID NO. 3754
  misc_feature (376)..(376): n is a, c, t, g, unknown, or other
aacgtcgcctggcggccgtctgcagctccgcgcctctgctcggaagttggtgaaggtttcttgaagctgagaagatggtgctgaagacagaactctgccgcttcacgcaagaagatttatcctgggaaaggcatccgatttatccgtgctgattctcaggttttcctttttgccaactcaaaatgcaagckctacttccacaaccgcctgaagcctgcaaagcttacctggacagcaatgtacaggaagcagcacaagaaggatatccatgctgaggctgtcaakaagagtgcgcckcgccaccaagaagccatactcgaggtccattgtgggtgcttccctagaggtgatccagaataatagggctgagaagcrnggtccggcgatgctgctagagaagctgctcttcgtgagatcaaggagcgcat

SEQ ID NO: 3754 - protein, 40 aa, Zea mays
  misc_feature: Ceres CLONE 291940-F
  misc_feature (16)..(16): Xaa is any aa, unknown, or other
MYRKQHKKDIHAEAVXKSAPRHQEAILEVHCGCFPRGDPE

SEQ ID NO: 3755 - DNA, 226 bp, Zea mays
  misc_feature: Ceres CLONE 291971-F
akagggatcgtcatccgccccacccacaactgctccagatccaggcacggcacggcacggcagccgggcaacccaagcccgtcttctcttctctctcgtccgtccctcactcgcygcgacgtgacaagacaacgcgacgcgcgctgcasatacgtcgtcccaaggcacgcaggggccagccaaccaatcgcgtccgtccgggtctggtggtggccggaattgggcc

SEQ ID NO: 3756 - DNA, 120 bp, Zea mays
  misc_feature: Ceres CLONE 292012-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacggcgac

SEQ ID NO: 3757 - DNA, 192 bp, Zea mays
  misc_feature: Ceres CLONE 292030-F
  misc_feature (46)..(46): n is a, c, t, g, unknown, or other
aaaattggacaaccctgtcgccctctcggtctccctcgagcttttnttgtgcgcagcgcagccgctgcttttcgttcgttcttcatcctacgcgagggcgaaacccagaaaccctctccctcctgtactccggccgacacatccaggggcgatgacgctgggtagctccggcgccggattcgagcgtcgtcg

SEQ ID NO: 3758 - DNA, 96 bp, Zea mays
  misc_feature: Ceres CLONE 292036-F
  misc_feature: Encodes the peptide sequence at SEQ ID NO. 3759
  misc_feature (48)..(48): n is a, c, t, g, unknown, or other
aataagaaaaatactcccgtgttcttcgaccggcggcggtggtgcgangagggcggttaagggagacgagatgagggggacgaagcggccgctcgg

SEQ ID NO: 3759 - protein, 31 aa, Zea mays; identical to SEQ ID NO: 3218
  misc_feature: Ceres CLONE 292036-F
  misc_feature (16)..(16): Xaa is any aa, unknown, or other

SEQ ID NO: 3760 - DNA, 247 bp, Zea mays
  misc_feature: Ceres CLONE 292040-F
  misc_feature (158)..(158): n is a, c, t, g, unknown, or other
aaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcggcgnaagcccaacgccaagaactcccaggacgggctcaccccggagcagcgccgcgagagggacaagaaagctctggaggagaaggcggccaa

SEQ ID NO: 3761 - DNA, 470 bp, Zea mays
  misc_feature: Ceres CLONE 292049-F
  misc_feature: Encodes the peptide sequence at SEQ ID NO. 3762
  misc_feature (82)..(82): n is a, c, t, g, unknown, or other
  misc_feature (108)..(108): n is a, c, t, g, unknown, or other
  misc_feature (352)..(352): n is a, c, t, g, unknown, or other
atcatcgagtcatccatctaaacatccgatccgaccatggcggcagacgcacttcggggccttctccccggcgtttacgctngctgatggtaatcgccgtcgcaagcnctgcctccagcgacgtgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgtttgcacagctccacagcgctgcgnggaaccgttgcccccggtcaagaaccttccagaattgtgccacaatcgtcaaagggcaacttcgtcgtggtccctggaaakacagactacccatcgaaggaatgtgcgtccgcaaccc

SEQ ID NO: 3762 - protein, 128 aa, Zea mays
  misc_feature: Ceres CLONE 292049-F
  misc_feature (17)..(128): Pfam Name: DUF1210 Pfam Description: Protein of unknown function (DUF1210)
  misc_feature (8)..(8): Xaa is any aa, unknown, or other
  misc_feature (89)..(89): Xaa is any aa, unknown, or other
  misc_feature (116)..(116): Xaa is any aa, unknown, or other
MVIAVASXASSDVSSVVVGLAKCADCTRKNLKAEAAFKGLEVAIKCKNSKGEYESKAMGKLDGFGAFSIPLSTDLHGADCVCTAPQRCXEPLPPVKNLPELCHNRQRATSSWSLEXQTTHRRNVRPQP

SEQ ID NO: 3763 - DNA, 748 bp, Zea mays
  misc_feature: Ceres CLONE 292096-R
  misc_feature: Translation starting site: 292
  misc_feature: SWISSPROT Homolog: EC 1.11.1.7 Peroxidase
  misc_feature (691)..(691): n is a, c, t, g, unknown, or other
  misc_feature (694)..(694): n is a, c, t, g, unknown, or other
  misc_feature (734)..(734): n is a, c, t, g, unknown, or other
cgattgggtaccgggccccccctcgaggtcgacggtatcgataagcttttttttttttttttttgtagtatatcaatcgcattaaccattaattcaaccttgtgctcataccgtacctgacatgataataataacaacaacaaaaaaaactttactctagattgtgtatgaacacttgtgtgagatataataaaccaggtctccatcctttttcagttgaggaaggcgcagtcgcggcggacgtccccgagcgacgggtcggtcttgacgccgacgcggccgagcctggtgatggcgtcgacgaaggcctgctcgaaggcggtggcgttctgcgcccacgccaccacggtgggctgcgaccgcgcgtcggagaagagcacctggtcggaggcgaagagcccccggccgtccaccaggttggcgaagtactggttgtcgaaggcctgcggcgtcacggggtccagctgcagcgcgatgttggggtccacccccgccgggcacgccgcctgcaggtcctccgcgtacgtcgcgttcatcgtcgggtccaccgactgcggctggatcccgtccgcgaacgtgctgcagtgcgcgaaccccaccgtgtgcgccgcagataaagcaatcatgtcggcctgcgacaggttgttgagggcgaaaatgctcgtgagctggtccaggttgaaagacggcngcngcagcttgccgtcaacgtttgtggaacatgacaccagccngtcagcctccccag

SEQ ID NO: 3764 - DNA, 484 bp, Zea mays
  misc_feature: Ceres CLONE 292154-F
  misc_feature (125)..(125): n is a, c, t, g, unknown, or other
  misc_feature (149)..(149): n is a, c, t, g, unknown, or other
  misc_feature (176)..(176): n is a, c, t, g, unknown, or other
  misc_feature (377)..(377): n is a, c, t, g, unknown, or other
ctagtcaaattttacgtaacttgcgtggttctcttcctgcgacggaagcaaacactgcccgagacatagacagcgggacgtcgagatggccgacggggaggacgccgccgccgcgbchgccgggncgccatcacagactaccgcaagangctgctcaactgcagggagctagagtngcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagangttgacatctggtactcgtgttgtacttgacatgacgaccttgacaataatgcgcactcttccacgggaggtggatcctgtggtatataacatgctttcatgaagat

SEQ ID NO: 3765 - DNA, 671 bp, Zea mays
  misc_feature: Ceres CLONE 292163-R
  misc_feature (345)..(345): n is a, c, t, g, unknown, or other
  misc_feature (458)..(458): n is a, c, t, g, unknown, or other
cgaattgggtaccgggccccccctcgaggtcgacggtatcgataagcttttttttttttttttttaaaggtgacaacgacttagcaccattcacagaagtaacagagcaaggaccccaaacatctgagtgtatcatagtaaatggttcacaactgcgaagaccaatactgggatagatggatctagtatgcttgccaagctcacatgcatcacatacaagcctacttttgtccactcccttaaacatagcagggtgcagcacgtcttaaggtctcaaaagatatatgtcctaaccgacaatgaagtagcagaatttccttcacatccctttcagcaactgctctncatgctgatttctcatgaccgatgaaccacaaaccatcacgtctgactccagtcccaatccttcttcccagtccccttctcttcacccatgtggggcatagttggcaaagtanggcgggtttcatcttccctgatgtcacaatcctttctcaccgaaacttttccctagccccccaatttttaaaacccaaacctttggtattttagcctttttcaagaattaaaaaaacctttagaaaaccccctggttttcccctttcccaaaataaaaacttctccccttttaaaaaaaaacccccaaaccccccgtgtcccccccccaaaac

SEQ ID NO: 3766 - DNA, 285 bp, Zea mays
  misc_feature: Ceres CLONE 292175-F
  misc_feature: Encodes the peptide sequence at SEQ ID NO. 3767
  misc_feature (3)..(3): n is a, c, t, g, unknown, or other
  misc_feature (234)..(234): n is a, c, t, g, unknown, or other
ctngccgcccccgtctcctctcctctcctctcctccgcatccacggccgcarcagccagccactcgacgatctagtcgtctctctctccccgctctgccgcctcgctgccgsgcttcccgtcggctggaggatgaaggtcacggtcgtgtcccggagcggccgggaggtcgtcaagggcggcatcgacctcaaggactcggccaaggtcgcggaccttcaggaggccatccatnccagggactaagaagtattatccttctaggcagcggctcaccctccccctt

SEQ ID NO: 3767 - protein, 37 aa, Zea mays
  misc_feature: Ceres CLONE 292175-F
  misc_feature (35)..(35): Xaa is any aa, unknown, or other
MKVTVVSRSGREVVKGGIDLKDSAKVADLQEAIHXRD

SEQ ID NO: 3768 - DNA, 409 bp, Zea mays
  misc_feature: Ceres CLONE 292214-F
  misc_feature: Encodes the peptide sequence at SEQ ID NO. 3769
  misc_feature (401)..(401): n is a, c, t, g, unknown, or other
atcttgctctgaacgcattcctcccatctcccaagacctcctcagacccgagaagcgcmkgcgggccatggacgccaccggcactggagctggagggaaggcgaagaagggagcggccggtcgcaaggccgcggggccgaggaagaagtcggtgacgaggtccgtgaaggccgggctccagttccccgtcggccgcatcgggcgctacctcaagaagggccgctacgcgcagcgttcggcagcggtgcccccgtctacctcgcggccgtcctggagtacctcgccgctgaaggtcctggagctcgccggcaacgctgccaaggacaacaagaagacgcgcatcgtcccgcgccacgtgctgctggcgatccggcaacgacgaggagctcgggaagctgctnaccggcgt

SEQ ID NO: 3769 - protein, 114 aa, Zea mays
  misc_feature: Ceres CLONE 292214-F
  misc_feature (31)..(104): Pfam Name: Histone Pfam Description: Core histone H2A/H2B/H3/H4
  misc_feature (112)..(112): Xaa is any aa, unknown, or other
MDATGTGAGGKAKKGAAGRKAAGPRKKSVTRSVKAGLQFPVGRIGRYLKKGRYAQRSAAVPPSTSRPSWSTSPLKVLELAGNAAKDNKKTRIVPRHVLLAIRQRRGAREAAXRR

SEQ ID NO: 3770 - DNA, 325 bp, Zea mays
  misc_feature: Ceres CLONE 292266-F
  misc_feature: Encodes the peptide sequence at SEQ ID NO. 3771
  misc_feature (54)..(54): n is a, c, t, g, unknown, or other
  misc_feature (119)..(119): n is a, c, t, g, unknown, or other
acttccagttccagcacgaatcctcgtccaatccacgcctgctgctcgcgagcnatcgccacagtgctggcctggccatgcctggagccgttgcgcttgcbccacgttcgcggcasmgncagctccgccgccgckcctccacgctggctccgaacccgacaagccgaggcgacccgctaattattaggttgtgccgcaatgctcctgctagcgcaactccacttgttccacttgtagccacccgtcgctacgtgcgtggctgccgcggcgstcttagtgggccagtccccaccacgctccaaaccctcgcctccgattcgcgtct

SEQ ID NO: 3771 - protein, 82 aa, Zea mays
  misc_feature: Ceres CLONE 292266-F
  misc_feature (13)..(13): Xaa is any aa, unknown, or other
  misc_feature (14)..(14): Xaa is any aa, unknown, or other
  misc_feature (20)..(20): Xaa is any aa, unknown, or other
  misc_feature (65)..(65): Xaa is any aa, unknown, or other
MPGAVALAPRSRXXQLRRRXSTLAPNPTSRGDPLIIRLCRNAPASATPLVPLVATRRYVRGCRGXLSGPVPTTLQTLASDSR

SEQ ID NO: 3772 - DNA, 496 bp, Zea mays
  misc_feature: Ceres CLONE 292271-F
  misc_feature: Translation starting site: 65
ctcacaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggagaggatgtggttcatcctctgaaggtttctctggaggatttgtacaatggcacatcgaagaagctctctctgtcccgc

SEQ ID NO: 3773 - DNA, 490 bp, Zea mays; identical to SEQ ID NO: 1302
  misc_feature: Ceres CLONE 292276-F
  misc_feature: Encodes the peptide sequence at SEQ ID NO. 3774

SEQ ID NO: 3774 - protein, 142 aa, Zea mays; identical to SEQ ID NO: 1303
  misc_feature: Ceres CLONE 292276-F
  misc_feature (24)..(142): Pfam Name: Calreticulin Pfam Description: Calreticulin family

SEQ ID NO: 3775 - DNA, 437 bp, Zea mays
  misc_feature: Ceres CLONE 292294-F
  misc_feature: Encodes the peptide sequence at SEQ ID NO. 3776
agatccagcggcctcaccaagtcaccatcaccacccgcaccacacacgagcacacgcgacgactgacaaggcgaggggagcaatcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgtttggcatgttccaacaactaaagtttgagttaataaattctatcaccctgcatgggactcatgttgtttgcaactgg

SEQ ID NO: 3776 - protein, 80 aa, Zea mays
  misc_feature: Ceres CLONE 292294-F
MGGGGAHGGTTYKGYTIPHNKRWHTVAGKGLCAVMWFWVFYRAKQDGATLLGLRHPWEGHDDHSHGHGHGHEASSSSSSH

SEQ ID NO: 3777 - DNA, 438 bp, Zea mays
  misc_feature: Ceres CLONE 292314-F
  misc_feature: Encodes the peptide sequence at SEQ ID NO. 3778
atctactccagtctcccactcacctatctcgcagcgcccgagcaatcgccacgcccacgccccaatggaagacagcgccaccaatggccatggggttgtgacggctgtcccggcctcgtaacttcgagccaaacgagaccctcctgggtcttccggcgctctcggttcgcggcgtgctgaccagagtcatggccgggatgttgcccgacggtgggcgggcggtggtcggttgggcagcggcgaccccgacagcgttcccgtgcttccggacggtgccagaggccgtggacgccgtcgccagcgcgggtccagtccgggcagtacaactcctattccactagcgtcgggccttgagctcgcacggaggtccaattgctcagtacttatcctgtgattgccatataaactgtcacctgattgatgtctacctcacaagtg

SEQ ID NO: 3778 - protein, 50 aa, Zea mays
  misc_feature: Ceres CLONE 292314-F
MAGMLPDGGRAVVGWAAATPTAFPCFRTVPEAVDAVASAGPVRAVQLLFH

SEQ ID NO: 3779 - DNA, 111 bp, Zea mays
  misc_feature: Ceres CLONE 292377-F
acacgcacaccgcgacccagtccagagccagtacgtgcgamgcacgcacgctgctggtccgcgtacsagacgacggtcaggtcggccggtgcttttcagtttggaataatg

SEQ ID NO: 3780 - DNA, 466 bp, Zea mays
  misc_feature: Ceres CLONE 292386-F
  misc_feature: Encodes the peptide sequence at SEQ ID NO. 3781
  misc_feature (267)..(267): n is a, c, t, g, unknown, or other
  misc_feature (350)..(350): n is a, c, t, g, unknown, or other
gacagtgccggatagaatcggtccaccactccccgtaccccgaactacctgacctgagagagagaccgtgcctccctcgccgccgccgccgcagcatccctagtcggagaagatggctgagaagcggcaggtcccaccccgaggacgaggatccgaggcggtctcgcggcctcagctccctcctccaggagctgtcttccgtatctttcaccgcggccccgagcaagatcaagaaggttcctgaccctccaaaggccgtgasgattncaagagccacacctgccaagaagcggccacaagtggatcaagctcagaagcggagagaagaggtcgctgctctgcaggagcmnttagtggcctgcaaagtaagttgcatgaaaaagatgaagctctaagatccgcagagaacttgatcggccgagttactgcggcgaatkaagcagttgatgggttgaggagcagctct

SEQ ID NO: 3781 - protein, 130 aa, Zea mays
  misc_feature: Ceres CLONE 292386-F
  misc_feature (87)..(87): Xaa is any aa, unknown, or other
  misc_feature (89)..(89): Xaa is any aa, unknown, or other
  misc_feature (116)..(116): Xaa is any aa, unknown, or other
QCRIESVHHSPYPELPDLRERPCLPRRRRRSIPSRRRWLRSGRSHPEDEDPRRSRGLSSLLQELSSVSFTAAPSKIKKVPDPPKAVXIXRATPAKKRPQVDQAQKRREEVAALQEXLVACKVSCMKKMKL

SEQ ID NO: 3782 - DNA, 438 bp, Zea mays
  misc_feature: Ceres CLONE 292387-F
  misc_feature: Encodes the peptide sequence at SEQ ID NO. 3783
atccaattcacaggctcaccacaccaaccaacaagcaaaaattccccaatcctctcgtctccgcggcgaagatgtcggggcgcggcaagggcggcaagggcctgggcaagggcggcgcgavtcaccggaaggtctgcgcgacaacatccaggggatcacgaagccggcgatccggagctggcgcggcggggcggcgtgaagcsatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagccagggccgcaccctctacggcttcggcggctaggcctgccgcgccgcgcttcgccgtcgctgcggttctggtgttgctgcagttcgcaagttgttt

SEQ ID NO: 3783 - protein, 122 aa, Zea mays
  misc_feature: Ceres CLONE 292387-F
  misc_feature (17)..(17): Xaa is any aa, unknown, or other
MSGRGKGGKGLGKGGAXHRKVCATTSRGSRSRRSGAGAAGRREAISGLIYEETRGVLKIFLENVIRDAVTYTEHARRKTVTAMDVVYALKPGPHPLRLRRLGLPRRASPSLRFWCCCSSQVV

SEQ ID NO: 3784 - DNA, 112 bp, Zea mays
  misc_feature: Ceres CLONE 292397-F
acacgcacaccgcgacccagtccagagccagtacgtgcgamggcacgcacgctgctggtccgcgtacsagacgacggtcaggtcggccggtgcttttcagtttggaataatg

SEQ ID NO: 3785 - DNA, 392 bp, Zea mays
  misc_feature: Ceres CLONE 292408-F
  misc_feature: Pfam Name: Rab5ip Pfam Description: Rab5-interacting protein (Rab5ip)
  misc_feature (142)..(142): n is a, c, t, g, unknown, or other
gatttcgattctttctttttcccccacgtgcgccgccgcgaccttcctcgatcccatctcccaacgcccccgcctcgcctcgggatcccgccgccgctccatctgcctttgctcccccacccgcagcagcgagcgacavtcnggcgagggatggccaaggccaggtcgttggcgamgagaagcaggcgcasaatcaaacggcggcggcggccacscgctgtcctccaagctcgcccggtacctcgacccggagcctccttggacaaggaccaactgctggacgcggtgcactggatccgccagcgttggggctcatatgcgggcctgctctgggggagccgtccccctcgtcggcgccgtctggatcgcactatttattggccatctcgact

SEQ ID NO: 3786 - DNA, 517 bp, Zea mays
  misc_feature: Ceres CLONE 292409-F
  misc_feature: Translation starting site: 96
  misc_feature: Pfam Name: COX7a Pfam Description: Cytochrome c oxidase subunit VIIa
cttcgcttccgtcagtcgggtccgcagcctccccctctcgcagatccccacctgctcctccgccggccaccgcgttgctcccctcggcagccaggatgacagaagtaccatttctgccgcgtgagaggctcttcaagcagcaacattacttccagaacttgaccaagcacacctacctgaaaggcgctacgacgtgatcacctccgtcgccatcccccttgcactcgctgcctccagcatgttcatgattgggcgtggagtttacaacatgtctcatggggttgggaagaaagagtgatcttccactggttaactattgtttctgcttggcatggaagtcataccgtcgagactgcgaagtcctcttcgcttgcaaaataatacggccaaataacaattcgactacattttcgcatcaattttctgtttgtatttgtgggtgtgaagtggcagtaacttgaaaatcagcactgtcactgttttggttagttactccattcctttcgtcttttgtgtc

SEQ ID NO: 3787 - DNA, 437 bp, Zea mays
  misc_feature: Ceres CLONE 292419-F
  misc_feature: Encodes the peptide sequence at SEQ ID NO. 3788
gctttcatctgcagtgcacgaacaatcgagccagcaacataaacgatcgaggcgcggtggccgttagcaaccgcagcaagcatgaataactcgcgcgctctagtgttggtgctcctgctgctggccatcgccatggctagctgcaggctctcgctcgccgcccacgagagcagcaccagcctcgcggacaccctcggccgcgacctgcgggctccatcgccagggccgccggcaacctcttcataccggacggtggctggcgcgccgcgaacgtcaccgccgacgcagaggcaaagaacctgagggccgtggcgtcccggagcggcggcccgcaccaggaagtcctccggcggcggcgcgggctgcgtcacgccgggtcgtgccggaagaggcgggtcatctgcggcaagaggtgctacgacggcgcctcgtcgcgc

SEQ ID NO: 3788 - protein, 73 aa, Zea mays; identical to SEQ ID NO: 1293
  misc_feature: Ceres CLONE 292419-F

SEQ ID NO: 3789 - DNA, 103 bp, Zea mays
  misc_feature: Ceres CLONE 292426-F
acacgcacaccgcgacccagtccagagccagtacgtgcgamgcacgcacgctgctggtccgcgtacsagacgacggtcaggtcggccggtgcttttcagtttg

SEQ ID NO: 3790 - DNA, 347 bp, Zea mays
  misc_feature: Ceres CLONE 292428-F
  misc_feature: Translation starting site: 79
  misc_feature: SWISSPROT Homolog: EC 3.5.1.52 Peptide-N(4)-(N-acetyl-beta-glucosaminyl)asparagine amidase
  misc_feature (58)..(58): n is a, c, t, g, unknown, or other
  misc_feature (69)..(69): n is a, c, t, g, unknown, or other
gtccagtgtgtccgctactccgctccccctcagtcctcagttcctcacctagcggtankgccgcgcggngagacgtagatggcggcttcggaggcggcacggcggcgcaacaccggtgacgcsacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcag

SEQ ID NO: 3791 - DNA, 478 bp, Zea mays
  misc_feature: Ceres CLONE 292443-F
  misc_feature: Encodes the peptide sequence at SEQ ID NO. 3792
  misc_feature (205)..(205): n is a, c, t, g, unknown, or other
  misc_feature (379)..(379): n is a, c, t, g, unknown, or other
agcttctccccacctttggtcaggcaggctcaggcaaaggaggcggccaacagggacgagcgatggcgaccaaggtcatctgcttcctggtgctcgcatccctgctcctcgccgtcgcctttcccgtgtctgctctgcggcasrgtttgaagaagggcggcggcggcggaggaggaggcggaggcagtgttagcgaassaggcgncaacctgaatccctgggagtgctcgcccaagtgcgggtcgcggtgctccaagacgcagtacaggaaggcctgcctcaccttatgcaacaagtgctgtgccaagtgcctctgcgtgccaccggggttctacggcaacaagggcgcctgccctgctacaacaactggaaaaccaangaaggagggcccaagtgcccctagaagatccaccgcagctcccgtccgccattgtccccccttctccgaatctggaacgtgttgttcatcttcgaccac

SEQ ID NO: 3792 - protein, 138 aa, Zea mays
  misc_feature: Ceres CLONE 292443-F
  misc_feature (2)..(109): Pfam Name: GASA Pfam Description: Gibberellin regulated protein
  misc_feature (27)..(27): Xaa is any aa, unknown, or other
  misc_feature (28)..(28): Xaa is any aa, unknown, or other
  misc_feature (46)..(46): Xaa is any aa, unknown, or other
  misc_feature (48)..(48): Xaa is any aa, unknown, or other
  misc_feature (106)..(106): Xaa is any aa, unknown, or other
MATKVICFLVLASLLLAVAFPVSALRXXLKKGGGGGGGGGGSVSEXGXNLNPWECSPKCGSRCSKTQYRKACLTLCNKCCAKCLCVPPGFYGNKGACPATTTGKPXKEGPSAPRRSTAAPVRHCPPFSESGTCCSSST

SEQ ID NO: 3793 - DNA, 320 bp, Zea mays
  misc_feature: Ceres CLONE 292447-F
  misc_feature: Encodes the peptide sequence at SEQ ID NO. 3794
  misc_feature (53)..(53): n is a, c, t, g, unknown, or other
attcgcaccaccgccgcgccgcccaaaccctagccgccgccgccgccgccgynccatggtcgccgtcaaccgccccctcgtctccgtgaaggccctagagggcgacatggtaaccgacgcccccggcatcgyyttaccgcccgtcttcggggcgccgatccgccccgacgtggtcaggttcacccacaagctgctgtcctgcaacaagcgccascctacgcatctcccgccgcgccgccaccagacgtcggccgagtcctggggtacggccgcgcgtgtctcgtatcccccgcgtccccggcggcggcacccaccgcgcc

SEQ ID NO: 3794 - protein, 88 aa, Zea mays
  misc_feature: Ceres CLONE 292447-F
  misc_feature (26)..(26): Xaa is any aa, unknown, or other
  misc_feature (53)..(53): Xaa is any aa, unknown, or other
MVAVNRPLVSVKALEGDMVTDAPGIXLPPVFGAPIRPDVVRFTHKLLSCNKRXPTHLPPRRHQTSAESWGTAARVSYPPRPRRRHPPR

SEQ ID NO: 3795 - DNA, 402 bp, Zea mays
  misc_feature: Ceres CLONE 292455-F
  misc_feature: Encodes the peptide sequence at SEQ ID NO. 3796
aggttcttcccccgatcttccccgctcagcttcgcttaattgcattttaagcccctttggcactcattgccgtcccctcggctccatttcttggaggtgaccgcagctctccggcggaaggcggcgcagatggcttccgcggcgacacagtgcttcagctactcctcgttccggccacgtgggctctgcggcacggggcggcggtgccagcgtgctccggctctcktcccggcggaccttctcggtctccgcgghggccgggttcgacaaccagaaccgcgagtatgtgatcgtcggggggatgggaacgctgcgggttacgccgccaggacgttcgtcgagcatggcatggctgacggccgcctttgcatcgtctccaaggagccagttccaccatacgag

SEQ ID NO: 3796 - protein, 91 aa, Zea mays
  misc_feature: Ceres CLONE 292455-F
  misc_feature: SWISSPROT Homolog: EC 1.6.5.4 Monodehydroascorbate reductase (NADH)
  misc_feature (33)..(33): Xaa is any aa, unknown, or other
MASAATQCFSYSSFRPRGLCGTGRRCQRAPALXPADLLGLRGGRVRQPEPRVCDRRGDGNAAGYAARTFVEHGMADGRLCIVSKEPVPPYE

SEQ ID NO: 3797 - DNA, 182 bp, Zea mays
  misc_feature: Ceres CLONE 292459-F
atccaattcacaggctcaccacaccaaccaacaagcaaaaattccccaatcctctcgtctccgcggcgaagatgtcggggcgcggcaagggcggcaagggcctgggcaagggcggcgcgamstcaccggaatgtckttgcgcgacaacatccaggggatcacgaagccggcgatccggaggc

SEQ ID NO: 3798 - DNA, 166 bp, Zea mays
  misc_feature: Ceres CLONE 292470-F
  misc_feature (104)..(104): n is a, c, t, g, unknown, or other
caagaccaaattaccaaaccctaccccttcgccgcgaccgsatcccccacatcgttggcgatgagctcctcctccaacagcgggaagaagccggcgcccgccgngccgcggggggcccaccatccgcacgctcgccgacataaaccgtggccctgccggtttccca

SEQ ID NO: 3799 - DNA, 105 bp, Zea mays
  misc_feature: Ceres CLONE 292496-F
atccgatctgccacctcctcccgtctcgcacgttccttcccaactccgcagcgtvctctccgcggcgsattccagatccaggtttttcagcatgggcctggtgar

SEQ ID NO: 3800 - DNA, 95 bp, Zea mays
  misc_feature: Ceres CLONE 292501-F
  misc_feature: Encodes the peptide sequence at SEQ ID NO. 3801
  misc_feature (28)..(28): n is a, c, t, g, unknown, or other
aaccgtagcctgtagcttcatccgtttngctgctcccggttccatcgcgcggtgcgaatttaacatggccgtgcggaggtggtggtcgacggcgt

SEQ ID NO: 3801 - protein, 31 aa, Zea mays
  misc_feature: Ceres CLONE 292501-F
  misc_feature (9)..(9): Xaa is any aa, unknown, or other
TVACSFIRXAAPGSIARCEFNMAVRRWWSTA

SEQ ID NO: 3802 - DNA, 409 bp, Zea mays
  misc_feature: Ceres CLONE 292512-F
  misc_feature (220)..(220): n is a, c, t, g, unknown, or other
accaaaccaagtgcggccagagaaatttctcccaaatttcagatcaaatcctcgaaatctccgacacctagcccaccggagacttctccccaacagtgtcgcgatccgtctcgatccggcatggagcgcgtcttctccgtggaggagatccccaacccctactgggttccgccgcaccctcaatcggcggccgsgcgctgttgctgcaccagcgggggangcggcggggctgatgaaccggtgcccgtcggaatggtacttccagaagttcctggaggaggccgtgctcgacagcccggttcccgtagccggcgtcagtaggggcagcgttggagctggagttgaggctkcggagakgaatacaccggggaccgcggcggcgcggctgctcgagctcggttgttgaccc

SEQ ID NO: 3803 - DNA, 252 bp, Zea mays
  misc_feature: Ceres CLONE 292528-F
  misc_feature: Translation starting site: 18
  misc_feature (132)..(132): n is a, c, t, g, unknown, or other
aaaaatccacttcaacgatggaggaaagcctgtgcgccgtggagaagcgcgggcgggtgcacgtcatcaccctcaccggcgcgggggagcaccgcctcagcccggccctgctctccgccctccgctccgstncgcagccgcccgccgcgcctcccccggtgcgctcgtcctggccggcgagggcaagttcttcagcaacggctacgacctcgcgtgggcgccccggggccggccccggcgccgtagcaccgc

SEQ ID NO: 3804 - DNA, 497 bp, Zea mays
  misc_feature: Ceres CLONE 292534-F
  misc_feature: Translation starting site: 126
atccttccactcaaacgatcgcaacacgatccaaagaacgacgtgtgggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccaccctgaggcagaacctggactacacctgcaccctgtscaaaacagcatggaggccggcgagaaggtccgcacgctctcctgcgaccacgtgttccactgcggcggcascgtcaagtgcgagggaatcgaccactgccttcgcaccggaccgatggagcgctgcccgacctgtgaccgggttccccatcccgtgccctgga

SEQ ID NO: 3805 - DNA, 117 bp, Zea mays
  misc_feature: Ceres CLONE 292553-F
acacgcacaccgcgacccagtccagagccagtacgtgcgamgcacgcacgctgctggttccgcgtacsagacgacggtcaggtcggccggtgcttttcagtttggaataatgacggc

SEQ ID NO: 3806 - DNA, 475 bp, Zea mays
  misc_feature: Ceres CLONE 292569-F
  misc_feature: Encodes the peptide sequence at SEQ ID NO. 3807
  misc_feature (53)..(53): n is a, c, t, g, unknown, or other
  misc_feature (76)..(76): n is a, c, t, g, unknown, or other
  misc_feature (89)..(89): n is a, c, t, g, unknown, or other
  misc_feature (302)..(302): n is a, c, t, g, unknown, or other
ctcgacgcctcataggctcatagggttctccaaattctaaatcgttgcaagcnaaaccaccaaaactgtactcacncccctcgtctgcnctgcgccaccactcccccgtggcggcttgtagttgtagaagttcccggaaccagacaacccctgggcgctgagttttctgatagcggcttcggatatctcgtcgtaggcggccatggcgggcccgtgctgagtgcggggcgggacaggtcaaggtctccgagctcgagatctcgatgcagattcgggagggcccggcgcggcggcaggcgstnccgccgctggggcgctgcggtcgcccatgtccgccatgatgctcgctatgttcgctactatggcctccttctacgtcgccggtcgattgtggcaggatgctcagaaccgacttcatctcattaaggagctcgacagacgaacaggtcagggggcaatcagcaatatctgtgga

SEQ ID NO: 3807 - protein, 49 aa, Zea mays
  misc_feature: Ceres CLONE 292569-F
MSAMMLAMFATMASFYVAGRLWQDAQNRLHLIKELDRRTGQGAISNICG

SEQ ID NO: 3808 - DNA, 490 bp, Zea mays
  misc_feature: Ceres CLONE 292571-F
  misc_feature: Translation starting site: 317
  misc_feature: SWISSPROT Homolog: EC 2.3.1.74 Naringenin-chalcone synthase
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggagggcgtccctgtcgtgcgtccgctcgtggggcggcgcgctctcgtcccatcacccacctcgtgta

SEQ ID NO: 3809 - DNA, 744 bp, Zea mays
  misc_feature: Ceres CLONE 292572-R
  misc_feature: SWISSPROT Homolog: EC 2.3.1.74 Naringenin-chalcone synthase
  misc_feature (449)..(449): n is a, c, t, g, unknown, or other
caaattgggtaccgggccccccctcgaggtcgacggtatcgataagcttttttttttttttttttgatttttttttttttttttttttttttttttttttttttaaaaaaccagccaagcttgtcttacacatgtactatacaatacctcaccatccatgcggttttatgactccactcttgagctagctcgcccataataaaattaattaagggtttttaaaacggtacttaacagctactaggacacaacacagatagaaattaattaattacgcagataccttattcgtaagtcgggtcgttcatgtctggaacgatcgcgaggatagatggaccactcaggcggcggtgggcgctccggtggtgatggggacgctgtggagcacgacggtctccacggtgaggcccgggccgaaaccgaagaggacgccccagtcgagcccctcnccggtgggtgcctggccgtccctcggcggaacgcttgcgcatctcgtccaggatgaagaacacccaagcgcttgacatgttcccttactcgaaaggaaattgccgggtggggccgcattctgggccttgtccgagccgaaccctggccctccacctggtccagaaaaggcgggccccccccggggggcccccacccaaaaaaagggagttcccgcccggaaaaacccgaaggggtttaaaaaaggtcccccaaagggggcctttaaattttttggaaaaaaacacccgcggcccc

SEQ ID NO: 3810 - DNA, 214 bp, Zea mays
  misc_feature: Ceres CLONE 292683-F
  misc_feature (20)..(20): n is a, c, t, g, unknown, or other
  misc_feature (202)..(202): n is a, c, t, g, unknown, or other
cgaccctcgcgccttcgsantctctctttctctcgagtctcgacacaccacagcggaastctcgactcgctgagtgacaagacgcgacgsacgccaagccaagaccaaattaccaaaccctaccccttcgccgcgaccgcgatcccccacatcgttggcgatgagctcctcctccaacagcgggaagaagccggcgcccgcnstccgcgggggg

SEQ ID NO: 3811 - DNA, 457 bp, Zea mays
  misc_feature: Ceres CLONE 292690-F
  misc_feature: Translation starting site: 128
  misc_feature: Pfam Name: Zim Pfam Description: ZIM motif
  misc_feature: Pfam Name: Keratin_B2 Pfam Description: Keratin, high sulfur B2 protein
  misc_feature (259)..(259): n is a, c, t, g, unknown, or other
  misc_feature (263)..(263): n is a, c, t, g, unknown, or other
aaggaacaggagcgtaaggaggaggaggcggaggcggaggcggaggcgggggagaggaagacccaggagccgccgcagcaaggccagggcctcagcctctcactcgccaacgsagtgcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcasgncasncacttaccaaaagcagtgctgccgctactgttaagcctccaatggtgcctgcagccactgttgccccagcagctgtcgtttctcctgtgcttacacggtctccatcactgcagagcacttctgtagcaactgggcaacctcaggttgttgctgaacctagctcgatatgcaaacttcaggctgatctccccatt

SEQ ID NO: 3812 - DNA, 113 bp, Zea mays
  misc_feature: Ceres CLONE 292703-F
  misc_feature: Encodes the peptide sequence at SEQ ID NO. 3813
atgatcgatcgatcgaccccgcgcgccatgcagatgcaggccctcgccctgcccacgatggagtcggagctgagggctctcgcgtgggcgacgttgctcaccccagcgtgcgc

SEQ ID NO: 3813 - protein, 37 aa, Zea mays
  misc_feature: Ceres CLONE 292703-F
DRSIDPARHADAGPRPAHDGVGAEGSRVGDVAHPSVR

SEQ ID NO: 3814 - DNA, 723 bp, Zea mays
  misc_feature: Ceres CLONE 292737-R
  misc_feature: SWISSPROT Homolog: EC 3.1.3.16 Phosphoprotein phosphatase
ccgattgggtaccgggccccccctcgaggtcgacggtatcgatattttttttttttttttttggtttttttttttttttttttttttccttggtccgactggcttttaattcctcgtttgagagaagaaaagcgtctgattggtaactactattaatactaaatcaaaacagaactaaaagtatggaagaaaacgggggagaaattagcttggattccaagagggctaaaaaagaaggcaaatcatatcccccggcggagatccacgacgaccacgctaacattatcggcgctccgccgggccaacgccagcttcgccagcagcatggccgcgtcggagcacgccttgtcggaatcctccacgctcacgccctcggcgaccgcggatccgttctcggctgccgggagggccgcgccgttcgcccgagcggccggcgccggcggaccgttgctgtggaagcacgcgcggacgacctcgcacgccatctcgttggtcacgacgtcccacaggccgtcgctggccaggaccaggcactcgtcgtcgtcggtgcgctccgtcaccgttacctccggctccgacgaaccaaaacggtttcagggatccgtcccctatggctcgaaacatggcaaggaccccgaaaaacccgagcaccgtccccgtaaatggacccgcccgcccgccgcctcaatgcccgccagctcctcaagcccggtcaggtttttg

SEQ ID NO: 3815 - DNA, 148 bp, Zea mays
  misc_feature: Ceres CLONE 292739-F
  misc_feature (112)..(112): n is a, c, t, g, unknown, or other
ctttctgctccttccttcctcgggaagcctagggcttaggctttaagcgccgcgattgtacggcggcggcggcggcggcgggcactacgacggakgcagcggtggcgccggngaacgctaacgcgctcttcggcggcgggggcttcat

SEQ ID NO: 3816 - DNA, 438 bp, Zea mays
  misc_feature: Ceres CLONE 292823-F
  misc_feature (271)..(271): n is a, c, t, g, unknown, or other
cccacgacagkccggatagaatcggtccaccactccccgtaccccgaactacctgacctgagagagacaccgtgcctccctcgccgccgccgccgcagcatccctagtcggagaagatggccgagaagccggcaggtcccaccccgaggacgaggatccgaggcggtctcgcggcctcagctccctcctccaggagctgtcttccgtatctttcaccgcggccccgagcaagatcaagaaggttcctgaccctccaaaggccgtgasattncaagagccacacctgccaagaagcggccacaagtggatcaagctcagaagcggagagaagaggtcgctgctctgcaggagcagtttaaatggcctgcaaagtaagttgcatgaaaaatatgaagctctaagatccgcagagaacttgatcggacgagttactgcggc

SEQ ID NO: 3817 - DNA, 167 bp, Zea mays
  misc_feature: Ceres CLONE 292834-F
attcccgtcacgcccccaacacgcccacaacccgaagcagcgaaastcccctaaccctctccgcgcatccgatcgcaaggaagaagagggagatgagctactacgggcagcagcccccgtctggcgtcccgcgcagcaaggctacccgggcaaggacggctacccgc

SEQ ID NO: 3818 - DNA, 93 bp, Zea mays
  misc_feature: Ceres CLONE 292843-F
agccgcgccgggggcccgagcgccccccgcagccggcggacgggatagccgtccgcctcctgccgccgttgccccgtcggtggagcacctcgt

SEQ ID NO: 3819 - DNA, 182 bp, Zea mays
  misc_feature: Ceres CLONE 292850-F
accacactccactgctctcctccactccactgcctcccatccctgctgctccctctcccatcccggttccatcatgggcggcctctcggtgatcgcaccgcccgcgcggactcggcttccccgcagcaccggcgcgcgcgccgtttaccttcgtgtccaactacctcatcctgggctgcgct

SEQ ID NO: 3820 - DNA, 460 bp, Zea mays
  misc_feature: Ceres CLONE 292862-F
  misc_feature: Encodes the peptide sequence at SEQ ID NO. 3821
  misc_feature (405)..(405): n is a, c, t, g, unknown, or other
aagaaaaaggaaattcctctcaacatcaccagaccacgacctccctgccgagctccctccctctccgttggtgatggcatctcagagctccaagaccgcggacaccgccgcgcctccgccggagttgcagccaccggagaggcggctccgggcgcggcttcttcaacaccggcacaaaaccctaacgctgctgcaaccgcagtggccggggccmgtatctagagaagaagatgcgccgcgcggasttttggtatgccagtactgatgtcagaggaggaaaagcgcvagttcgcgccgagagatttgggactggctcttcaagtgtaaaggaggaagagaagaagaagtccaggggctgagaggtttggccttgcctcgccctcttcttcagatgaggaagctaanaaaaagggcccgtttggaacgatttggtcagagcgcaaatgtcgacaaggcggaa

SEQ ID NO: 3821 - protein, 73 aa, Zea mays
  misc_feature: Ceres CLONE 292862-F
  misc_feature (72)..(72): Xaa is any aa, unknown, or other
KKKEIPLNITRPRPPCRAPSLSVGDGISELQDRGHRRASAGVAATGEAAPGAASSTPAQNPNAAATAVAGAXI

SEQ ID NO: 3822 - DNA, 436 bp, Zea mays
  misc_feature: Ceres CLONE 292867-F
  misc_feature: Translation starting site: 111
  misc_feature (108)..(108): n is a, c, t, g, unknown, or other
  misc_feature (183)..(183): n is a, c, t, g, unknown, or other
  misc_feature (384)..(384): n is a, c, t, g, unknown, or other
accctagtccaaaccaccgcaccgacaccgactccgagccccgccgcgccgcgctacctccgctcctctcttcgcccctgccggcgtcgaggccgaagcgaaggcgangcatgcatcacgaccccaaccccttcgacgagggcagcgcgaggacaaccccttctcaaatggaggagccggasncaaagcagcagtacggcttccggccgactgagcccgtcgggttcggcggcgctacaggggcgacgcgtcgttgacgtcccgctcgagaccatgggggactctcggagcaaggtgaaggagctctcgtcgtgggaatcagatctgaagcggcgataggcggatatcaagaggagggaataggcgctgaagaatgctggcgtnccaatggaggataagaactggccaccattcttccccatcatccaccatgata

SEQ ID NO: 3823 - DNA, 360 bp, Zea mays
  misc_feature: Ceres CLONE 292871-F
  misc_feature: Encodes the peptide sequence at SEQ ID NO. 3824
  misc_feature (92)..(92): n is a, c, t, g, unknown, or other
acccgcttcccccagccgcacgaaaccctaacgccgccgccgcttcacaggtaagccgccgtcatggtctccggttccggcgtatgcgcgancgtggttggacgcgcgccaccacatgctgggccgcctgtcggtcgattatcggccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaatatcctgtggcgcaccatccgcgggatgattccgcacaagaccaacaggggg

SEQ ID NO: 3824 - protein, 99 aa, Zea mays
  misc_feature: Ceres CLONE 292871-F
  misc_feature (19)..(99): Pfam Name: Ribosomal_L13 Pfam Description: Ribosomal protein L13
  misc_feature (10)..(10): Xaa is any aa, unknown, or other
MVSGSGVCAXVVGRAPPHAGPPVGRLSAKELLNGQKVVVVRCEEICMSGGLVRQKMKYLRFLRKRMNTKPSHGPIHFRAPSNILWRTIRGMIPHKTNRG

SEQ ID NO: 3825 - DNA, 111 bp, Zea mays
  misc_feature: Ceres CLONE 292877-F
aacacgcacaccgcgacccagtccagagccagtacgtgcgamgcacgcacgctgctggtccgcgtacsagacgacggtcaggtcggccggtgcttttcagtttggaataat

SEQ ID NO: 3826 - DNA, 258 bp, Zea mays
  misc_feature: Ceres CLONE 292908-F
atttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgc

SEQ ID NO: 3827 - DNA, 151 bp, Zea mays
  misc_feature: Ceres CLONE 292921-F
  misc_feature (82)..(82): n is a, c, t, g, unknown, or other
ctccaccacaccataccacaccggccggctcacacgcgccgcaaagcagagcacggggggctgagaccagagcagagcgtantcaaccagccaatcctttgcctgcccaagcagcagcagcagctggcccgatggctctgtctctctccgt

SEQ ID NO: 3828 - DNA, 185 bp, Zea mays
  misc_feature: Ceres CLONE 292951-F
  misc_feature (128)..(128): n is a, c, t, g, unknown, or other
gtgcccgckgtgctagtgacggttgctctagatccgttcatcctggtggttttgtgaggtcgaaagckgcgagcgaattagaagatgctggacaagctgtgggacgacgtggtggccgggcctcgcsnagacggcctcgagaagctccgcaagccaccaccgcccgcccgctcgtcatcaacaaa

SEQ ID NO: 3829 - DNA, 114 bp, Zea mays
  misc_feature: Ceres CLONE 292961-F
acacgcacaccgcgacccagtccagagccagtacgtccgaagcagcacgcacgctgctggtccgcgtacsagacgacggtcaggtcggccggtgcttttcagtttggaataatg

SEQ ID NO: 3830 - DNA, 483 bp, Zea mays
  misc_feature: Ceres CLONE 292979-F
  misc_feature: Encodes the peptide sequence at SEQ ID NO. 3831
aacaacagccctacaacttactgcttgctctagctagctagctgctcccggcccatatccactacacaagtaggctagcagcagcagcagcaatggcctcggtgacgrgttcccggccgtggcctcgtcctgctgctcgccgccagcgccttcctggccagcgaggtggcggcgtgcggcggctgccgaaaccaactcctcctcctccatcgccaccaccgccgtcgcccaccagcacgccgtscctccgccaccgtccagctccggcgcaagtgccccaagaacgcgctgaaactgggcgtgtgcgcaacgtgctgggcctcgtcaaggtgtccatcggcaaggtgcccaccgactcgtgctgcccgctgctggacggcctcgccgacctggaggccgccgtctgcctctgcaccgcgctcaaggccaacgtgctcggcatcaacctcggacgtctccgtcaagctcaccctgctcctcaac

SEQ ID NO: 3831 - protein, 130 aa, Zea mays
  misc_feature: Ceres CLONE 292979-F
  misc_feature (6)..(6): Xaa is any aa, unknown, or other
  misc_feature (51)..(51): Xaa is any aa, unknown, or other
MASVTXSRPWPRPAARRQRLPGQRGGGVRRLPKPTPPPPSPPPPSPTSTPXLRHRPAPAQVPQERAETGRVRNVLGLVKVSIGKVPTDSCCPLLDGLADLEAAVCLCTALKANVLGINLGRLRQAHPAPQ

SEQ ID NO: 3832 - DNA, 417 bp, Zea mays
  misc_feature: Ceres CLONE 293004-F
  misc_feature: Encodes the peptide sequence at SEQ ID NO. 3833
  misc_feature (2)..(2): n is a, c, t, g, unknown, or other
  misc_feature (220)..(220): n is a, c, t, g, unknown, or other
antcgcattcgtcactcgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcsntttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgtttctcgccaagaagactgacaacctgctcagctgctacattccaatgccgcttgcac

SEQ ID NO: 3833 - protein, 111 aa, Zea mays
  misc_feature: Ceres CLONE 293004-F
  misc_feature (46)..(46): Xaa is any aa, unknown, or other
MASLVVRAAGAAAAAARLPSLRPRRNGSGVLSGLRVGTGHYGARLXLLRPQLLTKSSRSPALLSMTAVWARGMNMSLTPACQARMSSTISTVFLAKKTDNLLSCYIPMPLA

SEQ ID NO: 3834 - DNA, 499 bp, Zea mays
  misc_feature: Ceres CLONE 293018-F
  misc_feature: Encodes the peptide sequence at SEQ ID NO. 3835
  misc_feature (410)..(410): n is a, c, t, g, unknown, or other
  misc_feature (441)..(441): n is a, c, t, g, unknown, or other
gagggatagaagaagaggatacagcaagcgggggttgcgaggaggcggcgaacgctatgggcaacgcgggagtgcgccggaccagcccaagaactcggcggatggggccggcgctgccgacgcggagtctcgccgcgggccgccgtctacggtgcgtttcttccccgatggggagcgccacaaggcacggcagccgccgccaaataaagctcaggaggaggagggcgtcccgcgccgcccgccaccgaggaggagatggccccgcgcaacctctggcaggtgtatgcgcttggggcgttcattgtgttgagatgggcctgggctaagaggaaggagaaccaggacagaaaggactcacctgatgctggggattggaattcaccgggacagatcgacttaatctccggttnctgctcgtggactaggctacccgcgaatatnaatgccgtttcgcgataagccaacgatgatggatcattctagctaatgcatcatataa

SEQ ID NO: 3835 - protein, 67 aa, Zea mays
  misc_feature: Ceres CLONE 293018-F
  misc_feature (52)..(52): Xaa is any aa, unknown, or other
  misc_feature (62)..(62): Xaa is any aa, unknown, or other
MAPRNLWQVYALGAFIVLRWAWAKRKENQDRKDSPDAGDWNSPGQIDLISGXCSWTRLPANXNAVSR

SEQ ID NO: 3836 - DNA, 411 bp, Zea mays
  misc_feature: Ceres CLONE 293040-F
  misc_feature: Encodes the peptide sequence at SEQ ID NO. 3837
  misc_feature (146)..(146): n is a, c, t, g, unknown, or other
gtttatttcttcgagagagggcaaaccggcaaggggagcgagmraagagtctcgagagcaagggagcgcggtgacgtcagcgttttccagggtttctcgatcggctgctatggcgaccagggtagcgtcgagattcctgcagcgcnctcctgtcttccggcggcaaggtcctcagcgaggaggagaaggccgcggagaaagtgtacatcaagaaaatggaacaagagaagctggagaagctcgcacgcaagggccccagctcaggagagcaaccttcgtcgactacagtctctgcagcaagtgatgtgaagactggggctgggccaacagagtcagcgtctgcaaacgtgtctaccgacaagaacaggaactacgctgtcctggcaggcacaattgctgctctgagtggcc

SEQ ID NO: 3837 - protein, 65 aa, Zea mays
  misc_feature: Ceres CLONE 293040-F
MEQEKLEKLARKGPSSGEQPSSTTVSAASDVKTGAGPTESASANVSTDKNRNYAVLAGTIAALSG

SEQ ID NO: 3838 - DNA, 132 bp, Zea mays
  misc_feature: Ceres CLONE 293048-F
  misc_feature (68)..(68): n is a, c, t, g, unknown, or other
acacgcacaccgcgacccagtccagagccagtacgtgcgamrgcacgcacgctgctggtccgcgtacnagacgacggtcaggtcggccggtgcttttcagtttggaataatgacggcgacgacgacgacagc

SEQ ID NO: 3839 - DNA, 136 bp, Zea mays
  misc_feature: Ceres CLONE 293102-F
acgcacaccgcgacccagtccagagccagtacgtgcgacaggcacgcacgctgctggtccgcgtacsagacgacggtcaggtcggccggtgcttttcagtttggaataatgacggcgacgacgacgacagccgccg

SEQ ID NO: 3840 - DNA, 116 bp, Zea mays
  misc_feature: Ceres CLONE 293116-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacgg

SEQ ID NO: 3841 - DNA, 132 bp, Zea mays
  misc_feature: Ceres CLONE 293131-F
acacgcacaccgcgacccagtccagagccagtacgtgcgaaggcacgcacgctgctggtccgcgtacbagacgacggtcaggtcggccggtgcttttcagtttggaataatgacggcgacgacgacgacagc

SEQ ID NO: 3842 - DNA, 384 bp, Zea mays
  misc_feature: Ceres CLONE 293148-F
  misc_feature: Encodes the peptide sequence at SEQ ID NO. 3843
  misc_feature (234)..(234): n is a, c, t, g, unknown, or other
  misc_feature (329)..(329): n is a, c, t, g, unknown, or other
  misc_feature (361)..(361): n is a, c, t, g, unknown, or other
acagctgaaasagccaaaacgcagaagctgcactgcatacatcgagctaactatctgcagcgatgtctcgctcctgctgcgtcgccgtgtcggtgcttctcgctgtcgccgcgacacgcagcgccaccgcscggcatggctgcacgaggaggccatggccacgggccgctggtcgcagagggtgcaagggtggcgccctccgcgtccacctgggctgccgacaaggcgtcgcgncgaggccgagcggcggcatggcacgcagggcgacgaccagagctcgtcgggcggcagtggcagcagcggtgagcacggcaaggaggaggggcganaagcagggcaagagctgcctcaccaagaggantgccacaagaagaagatgatctg

SEQ ID NO: 3843 - protein, 127 aa, Zea mays
  misc_feature: Ceres CLONE 293148-F
  misc_feature (4)..(4): Xaa is any aa, unknown, or other
  misc_feature (44)..(44): Xaa is any aa, unknown, or other
  misc_feature (78)..(78): Xaa is any aa, unknown, or other
  misc_feature (110)..(110): Xaa is any aa, unknown, or other
  misc_feature (120)..(120): Xaa is any aa, unknown, or other
QLKXPKRRSCTAYIELTICSDVSLLLRRRVGASRCRRDTQRHRXAWLHEEAMATGRWSQRVQGWRPPRPPGLPTRRRXEAERRHGTQGDDQSSSGGSGSSGEHGKEEGRXAGQELPHQEXCHKKKMI

SEQ ID NO: 3844 - DNA, 435 bp, Zea mays
  misc_feature: Ceres CLONE 293154-F
  misc_feature: Encodes the peptide sequence at SEQ ID NO. 3845
  misc_feature (40)..(40): n is a, c, t, g, unknown, or other
  misc_feature (301)..(301): n is a, c, t, g, unknown, or other
gaaccctcttccccctcgatggccgtaggagcggcggcgnctcgcggcgscgcgtccgaacgtgctagtgacggggacgccggggacgggaagacgacaacgtgctcgctcctttgccgacgccgcasttcccgccacgtcaacatcggcgacctcgtccgcgagaagagcctccacgacggctgggacgccgacctcgagtgccatgtcatcaacgaggacctggtgtgcgacgagcttgaggacatgatggaagaaggtggcatactagtagattaccacggatgtratttctttccanaacgttggtttgacctcgtagttgtgctccagactgacaactcaattctgcataatcgcctgacgggtaaaggttacatgggttccaaactcgccaacaacatagagtgcgaaatcttccaagtgctcctcgag

SEQ ID NO: 3845 - protein, 139 aa, Zea mays
  misc_feature: Ceres CLONE 293154-F
  misc_feature: SWISSPROT Homolog: EC 2.7.4.3 Adenylate kinase
  misc_feature (8)..(8): Xaa is any aa, unknown, or other
  misc_feature (11)..(11): Xaa is any aa, unknown, or other
  misc_feature (37)..(37): Xaa is any aa, unknown, or other
  misc_feature (91)..(91): Xaa is any aa, unknown, or other
  misc_feature (95)..(95): Xaa is any aa, unknown, or other
MAVGAAAXRGXASERASDGDAGDGKTTTCSLLCRRRXSRHVNIGDLVREKSLHDGWDADLECHVINEDLVCDELEDMMEEGGILVDYHGCXFFPXRWFDLVVVLQTDNSILHNRLTGKGYMGSKLANNIECEIFQVLLE

SEQ ID NO: 3846 - DNA, 490 bp, Zea mays
  misc_feature: Ceres CLONE 293192-F
  misc_feature: Translation starting site: 300
  misc_feature: SWISSPROT Homolog: EC 1.1.1.195 Cinnamyl-alcohol dehydrogenase
  misc_feature: SWISSPROT Homolog: EC 1.1.1.2 Alcohol dehydrogenase (NADP(+))
attttccccccggagctggtgcgcgagtyggagctggtgcagggtcaccttcccctcggcctcaagagctctgcgttgccgcggccaagggcgtccgtggagaagcgggacaggtggcggcgatggaagagcaaggcgccaggcggcgctcggatgggcggccagggacgactccggcgtctctccccctacagcttctccagaagggttcctaaagacgacgatgtcacgatcaaggtgctctactgcgggatctgccacaccgacctgcacgtcatcaagaacgactggcgaaacgcatgtacccagttgtcccggggcacgagatcgtgggcgtggtgaccggcgtcggcggcggcgtcacgcggttcaaggccggcgacacggtcggcgtgggctacttcgtggggtcctgccgctcctgcgacastgcggcaagggggacgacaactactgcgcggggatcgtgctcacctccaacggcgtcgac

SEQ ID NO: 3847 - DNA, 477 bp, Zea mays
  misc_feature: Ceres CLONE 293209-F
  misc_feature: Encodes the peptide sequence at SEQ ID NO. 3848
  misc_feature (63)..(63): n is a, c, t, g, unknown, or other
  misc_feature (380)..(380): n is a, c, t, g, unknown, or other
atcgttcaccgaaccggtgcttctccgtgcatatatatataagcgcgcgaccccggccgggcntcatcacagcacagcagtgcgccgtcattcattcatcgctgccatggcttcccctgtcctgctcgtcgccgcgctctgctgtctctgcgcgctgctcggagcggcgggggagccggcgaggggagcggcggcgaacgtcggcactccgcagcaaggcggccacggaccccaacatggaggtgaagttcgacttcacgccgttcctgatccagtacaagagcggccgcgtgcaccggttcatgggcacgtcgttcgtcccggcgtccgtggacccgcgcaccggggtggcctccagggacgtggtcgtggacavgggnactggcctcgcggtgcggctgtaccggccgagccgccaagccgtcgccgccggctcgggcagggctccccgtgctggtgtacttccacggcggcgcg

SEQ ID NO: 3848 - protein, 158 aa, Zea mays
  misc_feature: Ceres CLONE 293209-F
  misc_feature (21)..(21): Xaa is any aa, unknown, or other
  misc_feature (125)..(125): Xaa is any aa, unknown, or other
RSPNRCFSVHIYISARPRPGXITAQQCAVIHSSLPWLPLSCSSPRSAVSARCSERRGSRRGERRRTSALRSKAATDPNMEVKFDFTPFLIQYKSGRVHRFMGTSFVPASVDPRTGVASRDVVVDXGTGLAVRLYRPSRQAVAAGSGRAPRAGVLPRRR

SEQ ID NO: 3849 - DNA, 107 bp, Zea mays
  misc_feature: Ceres CLONE 293214-F
acacgcacaccgcgacccagtccagagccagtacgtgcgamggcacgcacgctgctggtccgcgtacsagacgacggtcaggtcggccggtgcttttcagtttggaa

SEQ ID NO: 3850 - DNA, 380 bp, Zea mays
  misc_feature: Ceres CLONE 293223-F
  misc_feature: Translation starting site: 48
  misc_feature: Pfam Name: MSP Pfam Description: Manganese-stabilising protein / photosystem II polypeptide
  misc_feature (178)..(178): n is a, c, t, g, unknown, or other
gaaaagggcaaaagccaaaaggcatcaccgccgcgacgacgacgacgatggcagcctcgctccaagccgcggccaccctgatgcagccggccaagatcggcggccgggcgccctttgcctcgctgccgtcccgcccgtcgtcgcaactcgcctgcaggstttccggcgtcgacgcggncgccgccaggatcacgtgctccctgcaggacgtcgccagcaggtgcgtcgacgccgcgaastcgccggcttcgcgctcgccacctcggcgctcctcgtctcgggcgcgacgcggagggcacgcccaagaggctgacctacgacgagatccagagcaaaacgtacatggaggtgaagggcacgggcacggcgaaccagtgccg

SEQ ID NO: 3851 - DNA, 479 bp, Zea mays
  misc_feature: Ceres CLONE 293224-F
  misc_feature: Encodes the peptide sequence at SEQ ID NO. 3852
  misc_feature (371)..(371): n is a, c, t, g, unknown, or other
  misc_feature (374)..(374): n is a, c, t, g, unknown, or other
atcccttgatcaaaaacccacaggccacaacaccaagaaaccagcatcttctgcagctctgaagaaaactcgatcaccatggacatgccttctcttgttctcctcctgctcgtcttcattgcaacaggcagccgcgccgcgggcaggtgttctgccgctcgcagttcaacctggccaacgaggcctgcagcctgcgcaccttctccgggcccaacccggcgcaaccgctgcagctgcacagcaacagctcctcggcatcctacgagatacaggcggaccaccacgagcacgagcacagccacgagcacgagcacgagcacgagcatagccacgagcacgagcacgagcacagccacgaacacgagcgcgangangcacacgcacagccggcggcacggcttcgggcacggcggccgcgacccctacgacaccgcctgctgccgccgcctcatgggcatcgacaacgcctgcatctgcca

SEQ ID NO: 3852 - protein, 133 aa, Zea mays
  misc_feature: Ceres CLONE 293224-F
  misc_feature (98)..(98): Xaa is any aa, unknown, or other
  misc_feature (99)..(99): Xaa is any aa, unknown, or other
MDMPSLVLLLLVFIATGSRAAGRCSAARSSTWPTRPAACAPSPGPTRRNRCSCTATAPRHPTRYRRTTTSTSTATSTSTSTSIATSTSTSTATNTSAXXHTHSRRHGFGHGGRDPYDTACCRRLMGIDNACIC

SEQ ID NO: 3853 - DNA, 472 bp, Zea mays
  misc_feature: Ceres CLONE 293252-F
  misc_feature (196)..(196): n is a, c, t, g, unknown, or other
  misc_feature (378)..(378): n is a, c, t, g, unknown, or other
aagcgccacacacacgccgacgcgaaccaaccaaccagctggtagtaggttcgccgcgctgacgatgatgcctcgccgcgcccttctcttcgccgcggtgctcctcgcggcctccgccgcgcgtctccgggttccacctgggaggggacgagagcggtctcgtgaggggtgtgctcgccgcgctccgsagsaccgnaggccgaggacgccgctcgcttcgccgtcgcccactacaacaagaaccagggcgccgctttggagtttactagggtgctcaaatccaagcggcaggtgggtgaccgggaccctgcatgacctgatactgggaggcagctgatgctggaaaaaagagtgtgtacagagcaaaggtttggggtnaagcgtgggaagatttcaagtctgtcgttgagtttcgccttgttggagactctgaatctgaacccgagccttctgttgcttctgatgttakctc

SEQ ID NO: 3854 - DNA, 504 bp, Zea mays
  misc_feature: Ceres CLONE 293274-F
  misc_feature: Encodes the peptide sequence at SEQ ID NO. 3855
  misc_feature (23)..(23): n is a, c, t, g, unknown, or other
  misc_feature (462)..(462): n is a, c, t, g, unknown, or other
accttccccgcacaccggttgcnatccgccgccatcgcttcaagcagcgaaccctagccgccctcagcgacggattgcagatctcccagccatgacgttcaagcggaggaacggcggacgcaacaagcacgggcgcggccacgtcaagtacatacgctgctccaactgcgccaagtgctgtccaaaggataaggctatcaagcggttcttggtgaggaacattgttgagcaggctgctgtgagggacgtgcaggaggcctgtgtgcatgatggatatgttcttcccaaattgtacgcaaaggttcatcactgtgtctcatgcgcaatccatgcgcacattgttcgtgttcgctctcgtgagaacaggaggaaccgtgagcccccgcagcgtttcaggcgccgggatgatggcccaaggcaggttcagggcccaccgcgcccaggtgctgctgccacagcrtnccccctgctgccgctcctcgtgcctaagttcaggatgcgatt

SEQ ID NO: 3855 - protein, 137 aa, Zea mays
  misc_feature: Ceres CLONE 293274-F
  misc_feature (1)..(114): Pfam Name: Ribosomal_S26e Pfam Description: Ribosomal protein S26e
  misc_feature (124)..(124): Xaa is any aa, unknown, or other
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRQVQGPPRPGAAATAXPLLPLLVPKFRMR

SEQ ID NO: 3856 - DNA, 153 bp, Zea mays
  misc_feature: Ceres CLONE 293289-F
  misc_feature: Encodes the peptide sequence at SEQ ID NO. 3857
gagagagaggaccgaggagggaaacagagaagatgacgacgaagcgcgacaccgagtcggacggsgaaggctccaaccccgtcggtggtggcgcgactccgccgcccctagccgccgccccttgttcgtattgcctccttccgcttccgccgg

SEQ ID NO: 3857 - protein, 40 aa, Zea mays
  misc_feature: Ceres CLONE 293289-F
MTTKRDTESDGEGSNPVGGGATPPPLAAAPCSYCLLPLPP

SEQ ID NO: 3858 - DNA, 216 bp, Zea mays
  misc_feature: Ceres CLONE 293317-F
  misc_feature (105)..(105): n is a, c, t, g, unknown, or other
  misc_feature (121)..(121): n is a, c, t, g, unknown, or other
  misc_feature (165)..(165): n is a, c, t, g, unknown, or other
atcacacactcgactctcctctctcgcatccgcagcctttcgagctctactccaccccctcgatctcgaagcgcmagcagcagtcaggcggccatggacsgagcncmscggtagccggcgngaaggcgaagaagggcgcggyygggcgcaaggccggcgggcgangggaagaagtcggtgacgaggtccgtcaaggccgggctgcagtttcccgtc

SEQ ID NO: 3859 - DNA, 115 bp, Zea mays
  misc_feature: Ceres CLONE 293331-F
acacgcacaccgcgacccagtccagagccagtacgtgcgamgcacgcacgctgctggttccgcgtacsaggacgacggtcaggtcggccggtgcttttcagtttggaataatgac

SEQ ID NO: 3860 - DNA, 509 bp, Zea mays
  misc_feature: Ceres CLONE 293399-F
  misc_feature: Encodes the peptide sequence at SEQ ID NO. 3861
aaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactcctagggcaaggcaaggaaggttgtaggctgctcctgtgtcgttgtcaaggactacggtgaagaatctgagggccttaacatagtgcaggagtatgtcaaagtcgcactagatg

SEQ ID NO: 3861 - protein, 105 aa, Zea mays
  misc_feature: Ceres CLONE 293399-F
  misc_feature (25)..(105): Pfam Name: Ribosomal_L7Ae Pfam Description: Ribosomal protein L7Ae/L30e/S12e/Gadd45 family
MADQEAPVAVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIDS

SEQ ID NO: 3862 - DNA, 176 bp, Zea mays
  misc_feature: Ceres CLONE 293405-F
aacgacgcagctagcgcgcatctcccgatcagctgcactgcaccttcgtcgaacgtcgatcgtactcgtacaccatgaaggcagtcgtcgcggcgasatgcttctkctggtgctggtggccgcggcgacggtggcgagcgcagaccaccgtgacacgccacaccaccacgccaccg

SEQ ID NO: 3863 - DNA, 443 bp, Zea mays
  misc_feature: Ceres CLONE 293440-F
  misc_feature: Encodes the peptide sequence at SEQ ID NO. 3864
  misc_feature (113)..(113): n is a, c, t, g, unknown, or other
gtttcttcggaggctttatttatcgtttatccacggaacttccggtgccggcggcgaccacttgtgcgatccatccctcaccatgtcgtcggagaaggaggcggcgctcgcgngcttcgatgacagcccaaccatatttgacaagatcatcaaaaaggaaataccttctactgtggtttatgaggacgagaaggtactggcctttcagggacataaaccctcaagctccaacacacattctcatcatccccaaagtcaaggatggactaactggcctggcaaaggctgaagagaggcacatagaaatacttggctatctcctctatgttgccaaggttgttgcgamrggtaaggacttgaagatggctatcgcgtcgtcatcaatgacggcccaagtgggatgtcaatctgtttaccacatccacgttcatctcctcggaggc

SEQ ID NO: 3864 - protein, 108 aa, Zea mays
  misc_feature: Ceres CLONE 293440-F
  misc_feature (24)..(108): Pfam Name: HIT Pfam Description: HIT domain
  misc_feature (76)..(76): Xaa is any aa, unknown, or other
MTAQPYLTRSSKRKYLLLWFMRTRRYWPFRDINPQAPTHILIIPKVKDGLTGLAKAEERHIEILGYLLYVAKVVAXGKDLKMAIASSSMTAQVGCQSVYHIHVHLLGG

SEQ ID NO: 3865 - DNA, 182 bp, Zea mays
  misc_feature: Ceres CLONE 293505-F
  misc_feature: Encodes the peptide sequence at SEQ ID NO. 3866
  misc_feature (116)..(116): n is a, c, t, g, unknown, or other
gtttaatcaatccttcaagcgcaakgcctcctcctcgtcgtccggtcgtgagaagggatggcgggccgtggcaaggctatcggcgctggcgccggaagaaaggcaacgtcgagganctccaaggccggactccagttccccgtcggcaggattgctaggttcctcaaggcgggcaagtacgc

SEQ ID NO: 3866 - protein, 41 aa, Zea mays
  misc_feature: Ceres CLONE 293505-F
  misc_feature (20)..(20): Xaa is any aa, unknown, or other
MAGRGKAIGAGAGRKATSRXSKAGLQFPVGRIARFLKAGKY

SEQ ID NO: 3867 - DNA, 478 bp, Zea mays
  misc_feature: Ceres CLONE 293510-F
  misc_feature (193)..(193): n is a, c, t, g, unknown, or other
atctcaagccaccatcgaccttcaagtctcgctacgtagcagtgcaataaaaaaagcagccgcaatggcgagcagcaccatggccctctcctccacggccttcgcsgcaaggccgtgaacgtgccgtcgtcgtccgccttcggsaggcccgcgtgacgatgcgcaagacggcggcgaaggcaagccagcgsgncgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcggccaagaaccggggagctggaggtgatccactcccgctgggccatgctggggcgcgctcggctgcgtcttccccgagctgctcgcccgcaacggcgtcaagttcggcgaggcgttgtggttcaaggccggctcccagatct

SEQ ID NO: 3868 - DNA, 102 bp, Zea mays
  misc_feature: Ceres CLONE 293529-F
  misc_feature (68)..(68): n is a, c, t, g, unknown, or other
acacgcacaccgcgacccagtccagagccagtacgtgcgamrgcacgcacgctgctggtccgcgtacnagacgacggtcaggtcggccggtgcttttcagtt

SEQ ID NO: 3869 - DNA, 454 bp, Zea mays
  misc_feature: Ceres CLONE 293546-F
  misc_feature: Translation starting site: 88
  misc_feature (139)..(139): n is a, c, t, g, unknown, or other
tccactcgccctcccacacagaaaaccctagcygccgccaccgaagcggcctcccaggtaagcaggagcgtccaccccgccgccgtcatgaagcgcaatccccgcgtcacgagctcccgccggaagtgccgcaasscanctttacggccccgtcctccgtccgccgcgttctcatgtccgccgggctgtcgacggagctccgccacaagtacaacgtgcgctccatcccgatccgcaagacgacgaggtgcaggtcgtgcgcggcamcttacaagggccgctagggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaagctgctcctggaccgcaagcccg

SEQ ID NO: 3870 - DNA, 1022 bp, Zea mays
  misc_feature: Ceres CLONE 293549
  misc_feature: Encodes the peptide sequence at SEQ ID NO. 3871
gaacaacacgcattcctacaatcggacaatcctactccaagcattgagggacacggaggcggcgccgttcggcactgcacgctcacgggctcgcgcattagtggatactctcccccggcgccacgaaatcgtccgctctcaccaccttccatcggtccctcacgatcttgccaagaatccaagatccgcctgcggtagctagcggtcctatcttgatccgatggtgtcaccgactccgggagggaaggatgcaagggagggtggcggcaaggcggagtggatgatctacgccttcgtggcgcgcggcaccgcggtgctggcggagtacacggagttccccggcaacttccccgccatcgccgcgcaatgcctgcagcggctacccgccgggtcgtcctccgccggcaccggccctgacggccgtggcgatgcgccggcacggttcagctacgcctgtgaccgacacacattcaacttcctcttgtaccgcggctacgcctattgtgtagttgcggaggaatccgttccaaagaatgtctcagtggcatttcttgaaaggttaaaagatgacttcatgaagagatatggtggtggtaaagctgacacagctcttgcaaaatgtctaaataaagaatatggacaagttataaagcagcacattcaatatgttcttgatcattcagaggaactagataaaatgttaaaagtgcaagcccaagtttcagaagtgaaaaatataatgttagacagcatagaaaagacactgggccgtggagagaaattgagtgaactccaagacaagacttctgagctacatattcaggcccagcagttcaagaaacagggagtgaagattcgcaggaagacatggctacagaacatgaaaattaagttggtgattcttggaatccttttgctccttgtaatcatagtatgggtatctatttgtcagggctttgactgcaccaagcatgaaacataatagaaatggtacaacgctgcacaaaaaaaaaaaaaaaaaa

SEQ ID NO: 3871 - protein, 253 aa, Zea mays
  misc_feature: Ceres CLONE 293549
  misc_feature (156)..(244): Pfam Name: Synaptobrevin Pfam Description: Synaptobrevin
MVSPTPGGKDAREGGGKAEWMIYAFVARGTAVLAEYTEFPGNFPAIAAQCLQRLPAGSSSAGTGPDGRGDAPARFSYACDRHTFNFLLYRGYAYCVVAEESVPKNVSVAFLERLKDDFMKRYGGGKADTALAKCLNKEYGQVIKQHIQYVLDHSEELDKMLKVQAQVSEVKNIMLDSIEKTLGRGEKLSELQDKTSELHIQAQQFKKQGVKIRRKTWLQNMKIKLVILGILLLLVIIVWVSICQGFDCTKHET

SEQ ID NO: 3872 - DNA, 490 bp, Zea mays
  misc_feature: Ceres CLONE 293578-F
  misc_feature: Translation starting site: 102
atattccttcgcttccgtcagtcgggtccgcagcctccccctctcgcagatccccacctgctccgccgccggccaccgcgttgctcccctcggcagccaggatgacagaagtaccatttctgccacgtgagaggctcttcaagcagcaacattacttccagaacttgaccaagcacacctacctgaaaggcgctacgacgtgatcacctccgtcgccatcccccttgcactcgctgcctccagcatgttcatgattgggcgtggagtttacaacatgtctcatggggttgggaagaaagagtgatctcccactggttaactattgtttctgcttggcatggaagtcataccgtcgagactgcgaagtcctcttcgcttgcaaaataatacggccaaataacaattcgactacattttcgcatcaattttctgtttgtatttgtgggtgtgaagtggcagtaacttgaaaatcagcactgtcactgttttg

SEQ ID NO: 3873 - DNA, 435 bp, Zea mays
  misc_feature: Ceres CLONE 293599-F
  misc_feature: Translation starting site: 31
  misc_feature (289)..(289): n is a, c, t, g, unknown, or other
atatgcactagcagtatcacctcatttaatatgcggccggcatcgtcgccagagctctcgatcaagctcgccagmbkcttcatctcatacgccggagtgctccagagagcagggctgaagaggtgcggcaagagctgcaggctgaggtacaccaactatcgcgcgctgatctgggcgacgaactgcgtgcgcgtttgcaggtggtccctgatcgcgamcagctgccggggcggacgggcaacgacgtgaggaaccgttggaacacgaaactkagagcaagcagctgcgncasgcggtgatcgaccccaccgcccccatcgccggcctcatgcacatcttcgtcggcgccctctccttacggcgacgacggcacgggtaacgacgacggcacggaagagatcatcgacgccaccctggactgcgacaagaagacac

SEQ ID NO: 3874 - DNA, 233 bp, Zea mays
  misc_feature: Ceres CLONE 293606-F
  misc_feature (177)..(177): n is a, c, t, g, unknown, or other
  misc_feature (179)..(179): n is a, c, t, g, unknown, or other
  misc_feature (231)..(231): n is a, c, t, g, unknown, or other
  misc_feature (232)..(232): n is a, c, t, g, unknown, or other
aaacaaagaaagaaaaaatcgagaggacgccagggccgattctctgcgtgacttggggcgtcgtcgcgagttttctccggccgagggcggcgcgaccggacaaccagcgtgabctgaccggcgacatgactcgcggcaaccagcgtgaccgcgaccgtgagckcgcggcggcggganangcccaacgccaagaactcccaggacgggctcaccccggagcagcgccgcganna

SEQ ID NO: 3875 - DNA, 493 bp, Zea mays
  misc_feature: Ceres CLONE 293616-F
  misc_feature: Encodes the peptide sequence at SEQ ID NO. 3876
agttagtagttcaccagagttcacacaaaaatcacaagcaagcagtcgcgtgtgtagctcgcaacaatggcgacgaaccccggcctcttcaccgagtggccgtggaagaagctcggcaacttcaaggtagctcccggcaccggccccgtctcagtaccctgcgtgcgtacgtccatggcacagagcgggggagaaggtgaaggaaaattagcaactcgtcttctgctcaccggcggcgtgccatgccatggcaatcttgggcgcatggtatatggccatgtgcggcacrgtgtcggaacatgcatgcacgcatggacttgctatacatacatgcatgcaccggcagccgtgagaccatctgtgcatgagtcttatgctcctgtgcatctcatgttccggccgacccatgagcatggaaggaagccaccaaaagttcattaatttgataggtcgcgtgtgcatggctgatcgactctcctacagttcttttgtc

SEQ ID NO: 3876 - protein, 124 aa, Zea mays
  misc_feature: Ceres CLONE 293616-F
  misc_feature (75)..(75): Xaa is any aa, unknown, or other
MATNPGLFTEWPWKKLGNFKVAPGTGPVSVPCVRTSMAQSGGEGEGKLATRLLLTGGVPCHGNLGRMVYGHVRHXVGTCMHAWTCYTYMHAPAAVRPSVHESYAPVHLMFRPTHEHGRKPPKVH

SEQ ID NO: 3877 - DNA, 441 bp, Zea mays
  misc_feature: Ceres CLONE 293645-F
  misc_feature: Encodes the peptide sequence at SEQ ID NO. 3878
  misc_feature (377)..(377): n is a, c, t, g, unknown, or other
  misc_feature (388)..(388): n is a, c, t, g, unknown, or other
  misc_feature (399)..(399): n is a, c, t, g, unknown, or other
atccaatcctcggaacgacgcgcgggcgaggaggacccccgacggaggatggcggcggcggctagggttttacgcgggtccctcttcctgatgtccccggcggcgggcgcaaggcgtcggcagccaagaaggcgggcgcggcggcggcggcggcggcggtggccaagaagaccgaggcggccactacgaagccgagactgccgaccgggatcacgaagccgatgccggtctccgatgagttccgcagttcgccggcggccgcccgaggtcgcacgctccgaggccatcaagctcatctgggcccacatcaaggcccacggctccagaacccagccaagaaaacggagatcaactgcgacgccacgctcaaaagcttntttggcggganggacaaggttnggattctggagatcaacaggctactgaacgctcacttcccga

SEQ ID NO: 3878 - protein, 73 aa, Zea mays
  misc_feature: Ceres CLONE 293645-F
  misc_feature (20)..(73): Pfam Name: SWIB Pfam Description: SWIB/MDM2 domain
  misc_feature (52)..(52): Xaa is any aa, unknown, or other
  misc_feature (56)..(56): Xaa is any aa, unknown, or other
  misc_feature (60)..(60): Xaa is any aa, unknown, or other
MPVSDEFRSSPAAARGRTLRGHQAHLGPHQGPRLQNPAKKTEINCDATLKSXFGGXDKVXILEINRLLNAHFP

SEQ ID NO: 3879 - DNA, 1113 bp, Zea mays
  misc_feature: Ceres CLONE 293676
  misc_feature: Encodes the peptide sequence at SEQ ID NO. 3880
agccacaacacatcccacaaccattattcttgttccactgcatcaggtcgtccaactctccaagcggcaagcgccatgccttcttccgcgcaggttctgctctgcctcgccgccgtgctcgcggcggcggcggccaccaccgccgaggcgcactcgcagtgcctggacaacccgccagaccggtccatccacggccgccagctggccgaggccggcgaggtcgtccacgacctccccggtggcctcagggcctacgtcagcggcgccgcgagctcgagccgcgccgtcgtcctcgcctccgacgtcttcgggtacgaggcgccattgctcagacagatagcagacaaggtcgccaaggcagggtacttcgtcgtcgtgcccgatttcttgaagggagactacttagacgacaagaaaaactttacggaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggcccagaacgacacgaccacgccgccgaaagaagtgtaccggttcgtgcatgtgctgcgtgaaagacacgaggttccctactacgccaagatcttccagggagtcgagcacgggttcgcctgcaggtacaacaccaccgaccctttcgccgttcaagaccgcagagacggccctcgcctacatggtcagctggttcaacaagcacctcaactgaatgaagcctgcactgcacgcaccagactgaattgaataaaccacagcagtgctgtgatattttgtttcgattcatggctccccagattgatttgtcatggctaagacctctactactgtaatttcccccatttttttgtctcttcaaactctctgtatttctttttttttgctttttttatgatcgcaataaagttcagtaggggtatacccctcctatttgcttcaaaaaaaaaaaaaaaa

SEQ ID NO: 3880 - protein, 276 aa, Zea mays
  misc_feature: Ceres CLONE 293676
  misc_feature (57)..(256): Pfam Name: DLH Pfam Description: Dienelactone hydrolase family
MPSSAQVLLCLAAVLAAAAATTAEAHSQCLDNPPDRSIHGRQLAEAGEVVHDLPGGLRAYVSGAASSSRAVVLASDVFGYEAPLLRQIADKVAKAGYFVVVPDFLKGDYLDDKKNFTEWLEAHSPVKAAEDAKPLFAALKKEGKSVAVGGYCWGGKLSVEVGKTSDVKAVCLSHPYSVTADDMKEVKWPIEILGAQNDTTTPPKEVYRFVHVLRERHEVPYYAKIFQGVEHGFACRYNTTDPFAVQDRRDGPRLHGQLVQQAPQLNEACTARTRLN

SEQ ID NO: 3881 - DNA, 347 bp, Zea mays
  misc_feature: Ceres CLONE 293699-F
  misc_feature: Translation starting site: 105
  misc_feature: SWISSPROT Homolog: EC 2.7.11.1 Non-specific serine/threonine protein kinase
  misc_feature (45)..(45): n is a, c, t, g, unknown, or other
  misc_feature (243)..(243): n is a, c, t, g, unknown, or other
  misc_feature (280)..(280): n is a, c, t, g, unknown, or other
aaggacgttcatttccgcgtcgtctccgcccgyagyyggcagcdnaccacccaccacatggccgccatgccgggtggggcccacggcgccggcgcccggacccgatgcaggtggaccagccgctcccccctgccgccgcasacagcacacgcccccgcckgtacgccaagcatgctggttctatgattgaagggagtratccggtcacaggtcatataatctcgacaaccattggaggggaanaatggagagcctaaaaggactatcagctacatggcanagagatttttggggaactgggatcatttggaatcgttcttccaggcaaaatgtctggagactggtga

SEQ ID NO: 3882 - DNA, 438 bp, Zea mays
  misc_feature: Ceres CLONE 293704-F
  misc_feature: Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
  misc_feature (2)..(2): n is a, c, t, g, unknown, or other
  misc_feature (52)..(52): n is a, c, t, g, unknown, or other
  misc_feature (170)..(170): n is a, c, t, g, unknown, or other
  misc_feature (222)..(222): n is a, c, t, g, unknown, or other
anggtgcgaaaggyacttccctgcccgattggcgatttaagtggtggggganggaaggccgattggttccagtgaaagakaggtaggtggccggacggtggtggcatcgcaattcaactccgcatctgaatcggcactcggcagcgcgccastccatagtgtaggaggangagatggcgctcacaagaatcggtcttgctggccttgcggtcatgggggcanaaccttgccctcaacattgcagagaaagggttccccatctctgtgtacaacaggacaacctccaaggtggacgakaccgtgcagcgtgccaaggcataaggaaaccttcccgtctacggcttccatgaccccgcgtcctttgtgaactccattcagaagccacgggtggtgatcatgctcgtyaagccggcgcgccarttgaccagaccatcgcga

SEQ ID NO: 3883 - DNA, 491 bp, Zea mays
  misc_feature: Ceres CLONE 293714-F
  misc_feature: Encodes the peptide sequence at SEQ ID NO. 3884
agcggcctcaccaagtcaccatcaccacccgcaccacacacgagcacacgcgacgactgacaaggcgaggggagcaatcggcggcgatgggcggcggcggcgcaaatgggcggctccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgtttggcatgttccaacaactaaagtttgagttaataaattctatcaccctgcatgggactcatgttgtttgcaactggtttagcacgaactggtcttgttactattgtgctaatgtatttgattcgaagtttcagtt

SEQ ID NO: 3884 - protein, 74 aa, Zea mays
  misc_feature: Ceres CLONE 293714-F
MGGSTYKGYTIPHNKRWHTVAGKGLCAVMWFWVFYRAKQDGATLLGLRHPWEGHDDHSHGHGHGHEASSSSSSH

SEQ ID NO: 3885 - DNA, 117 bp, Zea mays
  misc_feature: Ceres CLONE 293741-F
acaccgcgacccagtccagagccagtacgtgcgamggcacgcacgctgctggtccgcgtacsagacgacggtcaggtcggccggtgcttttcagtttggaataatgacggcgacgac

SEQ ID NO: 3886 - DNA, 423 bp, Zea mays
  misc_feature: Ceres CLONE 293762-F
  misc_feature: Translation starting site: 74
  misc_feature (67)..(67): n is a, c, t, g, unknown, or other
  misc_feature (107)..(107): n is a, c, t, g, unknown, or other
  misc_feature (166)..(166): n is a, c, t, g, unknown, or other
  misc_feature (168)..(168): n is a, c, t, g, unknown, or other
  misc_feature (187)..(187): n is a, c, t, g, unknown, or other
  misc_feature (243)..(243): n is a, c, t, g, unknown, or other
aacagcgaacacatctgcttcgcatttyttcccatcccccttcgcaacccaaaccccaactcgctyngcatcgatggcgcccaaggccgagaagaagcccgcggcrnagaagccggcggaggaggagcccgcggctgagaaggcgcccgccggaagaagccgavgnangaagcgggtccccgctggncaagtccgctgccaaggagggcggcgagggcaatakggggcaggaakaagggcaanaagagcgtggagacctacaagatctacatcttcaaggtgctgaagcaggtkcacccggacattggcatctcctccaaggccatgtcgatcatgaactccttcattaacgatatcttcgagaagctagctgctgaggccgccaagctcgcgcgctataacaagaagccaaccatcacctcc

SEQ ID NO: 3887 - DNA, 501 bp, Zea mays
  misc_feature: Ceres CLONE 293766-F
  misc_feature: Encodes the peptide sequence at SEQ ID NO. 3888
  misc_feature (487)..(487): n is a, c, t, g, unknown, or other
cttcctcccttcttacagccgccgccgccgcatcccagcctccatcaccgtttccgtctcgttgccatgggtaaggtgcacggatcgttggcgcgcgccgggaaggtccgcgggcagacccccaaggtggcgamrggacaagaagaagaagccccgcgccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctntccaaataatttga

SEQ ID NO: 3888 - protein, 61 aa, Zea mays
  misc_feature: Ceres CLONE 293766-F
  misc_feature (3)..(60): Pfam Name: Ribosomal_S30 Pfam Description: Ribosomal protein S30
  misc_feature (23)..(23): Xaa is any aa, unknown, or other
MGKVHGSLARAGKVRGQTPKVAXGQEEEAPRRAHKRMQYNRRFVTAVVGFGKKRGPNSSEK

SEQ ID NO: 3889 - DNA, 197 bp, Zea mays
  misc_feature: Ceres CLONE 293771-F
  misc_feature: Encodes the peptide sequence at SEQ ID NO. 3890
awattctgattttttgttcccttcaccgacggcgaggagtgagggttgacaacgggatggcgcggasyattccgtacgtttcggcggcgaactggtatccatggcgcgaggcaatccccgcctcgccatcatcgacgtcagggatgaggagaggagctaccaggctcacatcgcgggttcgcaccacttcgccagcg

SEQ ID NO: 3890 - protein, 32 aa, Zea mays
  misc_feature: Ceres CLONE 293771-F
  misc_feature: SWISSPROT Homolog: EC 3.1.3.48 Protein-tyrosine-phosphatase
MARGNPRLAIIDVRDEERSYQAHIAGSHHFAS

SEQ ID NO: 3891 - DNA, 399 bp, Zea mays
  misc_feature: Ceres CLONE 293786-F
  misc_feature: Encodes the peptide sequence at SEQ ID NO. 3892
  misc_feature (30)..(30): n is a, c, t, g, unknown, or other
  misc_feature (92)..(92): n is a, c, t, g, unknown, or other
  misc_feature (289)..(289): n is a, c, t, g, unknown, or other
aggaaacaagataagtcgcggtttgckagncgagaagcgcaattgagtgtccactgtccacaagtccagattccaattccagtccgatcgtnagctcagctcagctccgctagtcctctccccgcacgcaccaccaccagcagcagkccagcaccatgggcggcgctgctcctcacgctgctcctcgcggccgtgccctctccttgggcggcggcggcggcgcgcacccgggctactccgacgacgacgagagcgcctgcacggtggacgcgggcgcggactgctgcgncggatggaggagcgcgggcccgacaggcgcatcatcgacatcacgcacgcggtcgtscggacctgccgcgttcgccacgggggcggtcgcggggcccatgctgcgcctca

SEQ ID NO: 3892 - protein, 81 aa, Zea mays
  misc_feature: Ceres CLONE 293786-F
  misc_feature (45)..(45): Xaa is any aa, unknown, or other
  misc_feature (64)..(64): Xaa is any aa, unknown, or other
MGGAAPHAAPRGRALSLGGGGGAHPGYSDDDESACTVDAGADCCXGWRSAGPTGASSTSRTRSXGPAAFATGAVAGPMLRL

SEQ ID NO: 3893 - DNA, 1032 bp, Zea mays
  misc_feature: Ceres CLONE 293796-R
  misc_feature (973)..(973): n is a, c, t, g, unknown, or other
cagattgggtaccgggccccccctcgaggtcgacggtatcgataagcttttttttttttttttttaataagaacggcacaaaattacagagcttctggcttcgtttctcaccatttcattcactcattccattattacttaagctactgcatgcagtgcaaaataaattgttggcagagccggcggagcggagatgatactgataaatataagtggagtaggaaagggaagtgttcactcggatctggcggcgtatcgctccacctttgggtcgttgaggttgatgccgaccatggcctccccgagccccgcgctgacgtcggcgaggatgctggggtcgctgtagtgggtgaccgcctgaacaatggaccgggcgccgccccgcggaggtccccgctcttgaagatgccggagccgaacaaaaaatccctcccagccgaacctcaacaagaaaccccagcgttccttacgcgaggccaccctccctcctccgcctaataccaccaacgggatagcaccccccatctgctttggtcctgtaaggacctatactcctactgtacttccccgcctccccattgcccgttaggtccacactccccctggcgcgtagattaatgtccctcgcaaccttccgccccaccgcacttcgcccgaatccagctaaccgcctcataggggtatcgctccgcgccacacaaacgaggttagcccatcttctccgtgcctctctctcttatgttgccttatactcacgctaaggtccccccactcgttcacccagtgggcccaacggccatcatatacttcccgccacacgagcaacccgatcgatgatgcaccccctgcatcatcttcctcaagtccaccatccggcattcttcatccgcctctcgcaccctagagcgcttttattgcttttcagcgtattcctcgtctctcttttatcaccagtattatctttctaccccancggcttgcgcggatcttactcctgcgctttcctgcggcgcgttatttcttatatatttg

SEQ ID NO: 3894 - DNA, 480 bp, Zea mays
  misc_feature: Ceres CLONE 293797-F
  misc_feature: Translation starting site: 46
  misc_feature: SWISSPROT Homolog: EC 4.1.2.10 Mandelonitrile lyase
  misc_feature (366)..(366): n is a, c, t, g, unknown, or other
  misc_feature (455)..(455): n is a, c, t, g, unknown, or other
ataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgccagcgtgtcgtactacgactacatcatcgtgggcggcggcacggccggggtgcccgctggccgccacbctgtcggagcgcttccgcgtgctgctgctggagcgcggcgcctcgcctacgacgacgaccgcatcggggacatggcccgcttcgssacacgctgtcggacacctccccgggctcgcccgcgcnsttcgtgtcggaggacggcgtcatcaactcgcgcccgcgggtkctgggcggcggcactgcatcaacgccggcttctacacgcgggccancgacgactacgtgcggggcgtcggg

SEQ ID NO: 3895 - DNA, 134 bp, Zea mays
  misc_feature: Ceres CLONE 293819-F
  misc_feature: Encodes the peptide sequence at SEQ ID NO. 3896
attccaaaacatcactccctcgcgaaccccaagaactgcagcgacggcaatggcgatggcggcggagggcgcggcgagcgagccagagctggtgtcgatcccggcgacgccacggtctgtcgacgccggaggcc

SEQ ID NO: 3896 - protein, 44 aa, Zea mays
  misc_feature: Ceres CLONE 293819-F
SKTSLPREPQELQRRQWRWRRRARRASQSWCRSRRRHGLSTPEA

SEQ ID NO: 3897 - DNA, 281 bp, Zea mays
  misc_feature: Ceres CLONE 293824-F
  misc_feature: Encodes the peptide sequence at SEQ ID NO. 3898
  misc_feature (163)..(163): n is a, c, t, g, unknown, or other
awaatatctctccccacctcccctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcasrgttnaaagaagggcggcggcggtgaaggcggaggcggaggcagtgttagcgtaasstaggcgtcaacctgaatccctgggagtgctcgcccaagtgcgggttcgcggtgctccaagacgcat

SEQ ID NO: 3898 - protein, 45 aa, Zea mays
  misc_feature: Ceres CLONE 293824-F
  misc_feature (27)..(27): Xaa is any aa, unknown, or other
  misc_feature (28)..(28): Xaa is any aa, unknown, or other
  misc_feature (29)..(29): Xaa is any aa, unknown, or other
MVTKVICFLVLASVLLAVAFPVSALRXXXKKGGGGEGGGGGSVSV

SEQ ID NO: 3899 - DNA, 431 bp, Zea mays
  misc_feature: Ceres CLONE 293827-F
  misc_feature: Translation starting site: 199
  misc_feature: SWISSPROT Homolog: EC 2.3.1.74 Naringenin-chalcone synthase
  misc_feature (193)..(193): n is a, c, t, g, unknown, or other
  misc_feature (194)..(194): n is a, c, t, g, unknown, or other
cctctagctgadkgatctctggtttaccactctttccttccctccttcaattctaaataccacaaatcaaagttgctttacgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccc

SEQ ID NO: 3900 - DNA, 390 bp, Zea mays
  misc_feature: Ceres CLONE 293860-F
  misc_feature: Translation starting site: 88
ctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaa

SEQ ID NO: 3901 - DNA, 402 bp, Zea mays
  misc_feature: Ceres CLONE 293878-F
  misc_feature: Encodes the peptide sequence at SEQ ID NO. 3902
  misc_feature (69)..(69): n is a, c, t, g, unknown, or other
  misc_feature (254)..(254): n is a, c, t, g, unknown, or other
  misc_feature (260)..(260): n is a, c, t, g, unknown, or other
aaaaacacttccgcagctctggaattcggaggctcaggaatcatgatgcagcagcctcaggcgcatgcntcggcacttgcggtggcgcacccgcacgatccggcgggcggggacgcgccgcsaagcaggtggctcaggcgatggagcggctgggccgtgcgggccgtctcatcgcagacatccggctcggcgcggaccgcctcctcgaggccctcttcgtctccggcgacgcgcccccgtacagcgtgcgccanwycggnacaggatggagcacattatcgtcaaggaggatgccgccatgcgcctccacttccaggacctacgcgccctcgggcaggcaactagaggagtctggagttcttaatggggcccttaaaggctcgaggcaattcatgggggctt

SEQ ID NO: 3902 - protein, 133 aa, Zea mays
  misc_feature: Ceres CLONE 293878-F
  misc_feature (23)..(23): Xaa is any aa, unknown, or other
  misc_feature (84)..(84): Xaa is any aa, unknown, or other
  misc_feature (85)..(85): Xaa is any aa, unknown, or other
KHFRSSGIRRLRNHDAAASGACXGTCGGAPARSGGRGRAAKQVAQAMERLGRAGRLIADIRLGADRLLEALFVSGDAPPYSVRXXGTGWSTLSSRRMPPCASTSRTYAPSGRQLEESGVLNGALKGSRQFMGA

SEQ ID NO: 3903 - DNA, 443 bp, Zea mays
  misc_feature: Ceres CLONE 293923-F
  misc_feature: Encodes the peptide sequence at SEQ ID NO. 3904
  misc_feature (59)..(59): n is a, c, t, g, unknown, or other
ccgccccgctccttgcctccgatccccaattcctccttcggatctcgcattcagcgcanaaggttgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcgagaggccgtgttgttgaagccagagatgagctccacaggatgctgaacgaggatgagctacgtgatgct

SEQ ID NO: 3904 - protein, 99 aa, Zea mays
  misc_feature: Ceres CLONE 293923-F
  misc_feature (5)..(100): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSERPCC

SEQ ID NO: 3905 - DNA, 533 bp, Zea mays
  misc_feature: Ceres CLONE 293924-F
  misc_feature: Translation starting site: 83
ccattcccttcgtgcttgtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaascatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagcttcttctgagcggccggctgcgggcatgttcttgagcctgcctgtattctactccgtgtgtgttgagccatatat

SEQ ID NO: 3906 - DNA, 729 bp, Zea mays
  misc_feature: Ceres CLONE 293951-R
ccaattgggtaccgggccccccctcgaggtcgacggtatcgataagcttttttttttttttttttagaaagaaaaaaggcagctacaggttatatttctgcatcaatagcagttcaaatctttgtgttaaatgtttcacatcctctacaagaaaattaatatagcatacacaattacaaacaaagaagaaagccccacacacacaaaaaaaacaccaaatcccttcctacacggtggtccacaggcggcttcagtgtgacggagcggcttgttggtctgtgctcgtttcaacgcgcaggctgttttcacgacggtacatagactctgcgccttggaatatcgttccgagctttttcaacgctttggctcgcagcttcaggacatctttggagaccatgctatctctcagaactgcttggcagacacgtgagagcgttgactcgatatcaaccacattgattttccaaagcgagctgagcatggcatcttttttctcctcaaaactcttcataagttgctcctcgctgttctcactcccctccatcttcttcatcccttcttgaagttgtattaaagaaatagcacctgaagcagcattaacctgtgatttaatgtggtgtcctttgtctctaacccattcagctataaatggtacacccatgtaaattctacttttaccgagttctcttgctgcttgccggacaaaatataaccaatggtgtgaagcaa

SEQ ID NO: 3907 - DNA, 439 bp, Zea mays
  misc_feature: Ceres CLONE 293952-F
  misc_feature: Encodes the peptide sequence at SEQ ID NO. 3908
  misc_feature (116)..(116): n is a, c, t, g, unknown, or other
  misc_feature (211)..(211): n is a, c, t, g, unknown, or other
  misc_feature (230)..(230): n is a, c, t, g, unknown, or other
  misc_feature (273)..(273): n is a, c, t, g, unknown, or other
cacatttgcatgggcaagcacctacctgccgccgcydccgccgccgccgccgccgcgttcgctcgtacgcccgcagccttcgcgtcccatccgataccgccgcatccgccgggakngcagataagacgccgtctgccccgctggatacgcccaggaaatccgctgccgccgctgccgcgscagctccgggcgggccgaggtgcgggatttngcggcggcgtgcgggctanaggcggacgagagggttccgctcgcggaggtggtgtcggactncacgaggcggtggttccaggacgcactcaaggaggcgcgcgccgycgaacatcaccatgcaggtgctcggtcggccagatgtaccgcagcggatacggtgtcaacaagaacgagcacaaggcaagagtttggatggagaaagcatcaagatatcggtctacagtat

SEQ ID NO: 3908 - protein, 29 aa, Zea mays
  misc_feature: Ceres CLONE 293952-F
MYRSGYGVNKNEHKARVWMEKASRYRSTV

SEQ ID NO: 3909 - DNA, 285 bp, Zea mays
  misc_feature: Ceres CLONE 293959-F
  misc_feature (152)..(152): n is a, c, t, g, unknown, or other
aattattatcgcttttgggacaggccggaaggaagcgtaaagggtagggcggtggttggtgacagcagcaggcctccttcctcctcgctcgcggcgcctccgctatacctgttgcggcaggcaacaaggcaggcaggcaggcagcagcggancttggtgatctacgaagaggatgaattccaggatctccctcctctgcgccctcgtcctcgcctcctccctcctgcactgcgccagattccgacggcaatgacgcgcatcctcaagggcatcaacagctacagg

SEQ ID NO: 3910 - DNA, 176 bp, Zea mays
  misc_feature: Ceres CLONE 293962-F
ccccggcctcctccgcccgcatccccgatcccgctcgctcgctcgctcgccgccatttgtccagcagctcggatcgtctcatacctcggcgaagatgagagagatcttgcacatccagggagggcaatgtggcaaccagatcggtgccaagttctgggaggtcgtgttgtgacgaa

SEQ ID NO: 3911 - DNA, 484 bp, Zea mays
  misc_feature: Ceres CLONE 293985-F
  misc_feature (119)..(119): n is a, c, t, g, unknown, or other
actagtcaaattttacgtaacttgcgtggttctcttcctgcgacggaascaaacactgcccgagacatagacagcgggacgtcgagatggccgacggggaggacgccgccgcygcgkcngccgggccgccatcacagactaccgcaagavgctgctcaactgcagggagctagagtmgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagat

SEQ ID NO: 3912 - DNA, 97 bp, Zea mays
  misc_feature: Ceres CLONE 293988-F
actcaatcttgttgagagtcgccggcgccggcatttcctcctccaccgattcgcccggcgggagtctccgcaggctcaccgggaccagcgggtcaac

SEQ ID NO: 3913 - DNA, 142 bp, Zea mays
  misc_feature: Ceres CLONE 293996-F
  misc_feature (36)..(36): n is a, c, t, g, unknown, or other
tkaattcctctctgccctagcaccagccatggcgangcagcttcttctctgtttcctacttcgccgcctccgcgccgctaatcgtcgccacggccaagaaatccggggacgtgtcggagctccagatcggcgtcaagtacaa

SEQ ID NO: 3914 - DNA, 113 bp, Zea mays
  misc_feature: Ceres CLONE 294012-F
acacgcacaccgcgacccagtccagagccagtacgtgcgamgcacgcacgctgctggtccgcgtacsagacgacggtcaggtcggccggtgcttttcagtttggaataatgac

SEQ ID NO: 3915 - DNA, 109 bp, Zea mays
  misc_feature: Ceres CLONE 294022-F
acacgcacaccgcgacccagtccagagccagtacgtgcgamgcacgcacgctgctggtccgcgtacsagacgacggtcaggtcggccggtgcttttcagtttggaataa

SEQ ID NO: 3916 - DNA, 403 bp, Zea mays
  misc_feature: Ceres CLONE 294042-F
  misc_feature (229)..(229): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcgcangtcggcagcggttgcccccgtctacytcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgt

SEQ ID NO: 3917 - DNA, 300 bp, Zea mays
  misc_feature: Ceres CLONE 294057-F2
atttttccccgcatccgcagctcacatcgctcccccgaacccgaacccaaatcccaagcaaccacttcgtcgaccatggtgdcagggcactccgggagggatgggcaagcagggcgcgcggcgaccgcaagccgggggacgccggcgacaagaaggacaagaagttcgagccgccggccgcgccctcccgcgtcggccggaagcagcgcaacagaagggcgccgaggcggccgckcgcytccccaacgtcgcgccgctctccaagtkccgactccgcctcctcaagctcgkccgggtcaa

SEQ ID NO: 3918 - DNA, 300 bp, Zea mays; identical to SEQ ID NO: 3917
  misc_feature: Ceres CLONE 294057-F
  misc_feature: Encodes the peptide sequence at SEQ ID NO. 3919

SEQ ID NO: 3919 - protein, 99 aa, Zea mays
  misc_feature: Ceres CLONE 294057-F
  misc_feature (27)..(27): Xaa is any aa, unknown, or other
  misc_feature (80)..(80): Xaa is any aa, unknown, or other
  misc_feature (89)..(89): Xaa is any aa, unknown, or other
  misc_feature (97)..(97): Xaa is any aa, unknown, or other
FFPASAAHIAPPNPNPNPKQPLRRPWXQGTPGGMGKQGARRPQAGGRRRQEGQEVRAAGRALPRRPEAAQQKGAEAAARXPNVAPLSKXRLRLLKLXRV

SEQ ID NO: 3920 - DNA, 104 bp, Zea mays
  misc_feature: Ceres CLONE 294077-F
acgcacaccgcgacccagtccagagccagtacgtgcgamggcacgcacgctgctggtccgcgtacsagacgacggtcaggtcggccggtgcttttcagtttgga

SEQ ID NO: 3921 - DNA, 480 bp, Zea mays
  misc_feature: Ceres CLONE 294087-F
  misc_feature: Encodes the peptide sequence at SEQ ID NO. 3922
ccattctctgtcgccttcgcccctccaaggttctctgattccagacgcaaccccgcgggtcaaggagccagagggggggtgcacagcgatcgttctgccggagatcgaaaccctaaggtagggtttgaggcgccgggctgcggccgccgagatgtcgacgccggcgaggaagcggctgatgcgggacttcaggcgcctgcagcaggacccgcccgccggatcagcggcgcgccgacgacaacaacatcatgctctggaacgccgtcatattcgggccggatgatacgccttgggacggaggcacgttcaagcttaccttgcagtttacagaagattacccaaacaagccaccaactgttcggtttgtctctaggatgtttcatccaaacatatatgctgatggaagcatctgcttggatatcctacagaaccagtggagtcctatatatgatgttgctgcaatcttgacttctattcagt

SEQ ID NO: 3922 - protein, 77 aa, Zea mays
  misc_feature: Ceres CLONE 294087-F
  misc_feature (1)..(77): Pfam Name: UQ_con Pfam Description: Ubiquitin-conjugating enzyme
  misc_feature: SWISSPROT Homolog: EC 6.3.2.19 Ubiquitin--protein ligase
MLWNAVIFGPDDTPWDGGTFKLTLQFTEDYPNKPPTVRFVSRMFHPNIYADGSICLDILQNQWSPIYDVAAILTSIQ

SEQ ID NO: 3923 - DNA, 450 bp, Zea mays
  misc_feature: Ceres CLONE 294105-F
  misc_feature: Translation starting site: 302
  misc_feature: SWISSPROT Homolog: EC 5.2.1.8 Peptidylprolyl isomerase
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacscatcgagggcatgaacggcaaggagctggacggccgcaacatcaccgtcaacgaggcccagtcccgcggcggccgtggaggcggcgcgggakagcggccattgccactcctactgccattgccattgatcttggcctcgctcggttcattcctttcttt

SEQ ID NO: 3924 - DNA, 486 bp, Zea mays
  misc_feature: Ceres CLONE 294126-F
  misc_feature: Encodes the peptide sequence at SEQ ID NO. 3925
  misc_feature (50)..(50): n is a, c, t, g, unknown, or other
  misc_feature (105)..(105): n is a, c, t, g, unknown, or other
aacaacgcctcctccagtccttcttcgtaagccttcaaaccgacgaattngagcaactgcacccagagcgcgatccattgccggggaagaagcaacttgttsgangcytcctctatggcgagctccgaccatggttccaccaccgcccccaaggacgtgccgggcagctacggcctgccgctggtgggcgccgtgcgaccgcctcgacttctactacttccaggggcaggacaagtacttcgagtcccgcgtggagcgctacggctccaccgtggtgcgcatgaacgtgccgccgggccccttcatggcgcgcgacccgsgggtggtggcggtcctggacgccaagagcttccccgtgctcttcgacatggacaaggtggagaagaaggacctgtdcacgggcacctacatgccgtccacctccctcaccgggcggctacccgcgtctgctcgtacctggaccccctccgagcccaccacaccaag

SEQ ID NO: 3925 - protein, 118 aa, Zea mays
  misc_feature: Ceres CLONE 294126-F
  misc_feature: SWISSPROT Homolog: EC 4.2.1.92 Hydroperoxide dehydratase
  misc_feature (64)..(64): Xaa is any aa, unknown, or other
  misc_feature (89)..(89): Xaa is any aa, unknown, or other
MVPPPPPRTCRAATACRWWAPCDRLDFYYFQGQDKYFESRVERYGSTVVRMNVPPGPFMARDPXVVAVLDAKSFPVLFDMDKVEKKDLXTGTYMPSTSLTGRLPASARTWTPSEPTTP

SEQ ID NO: 3926 - DNA, 1083 bp, Zea mays
  misc_feature: Ceres CLONE 294140
  misc_feature: Encodes the peptide sequence at SEQ ID NO. 3927
aaaagcagaccatatccccaggcaaaggccaaggccaagcgagacagggagggaggggaagtaaccaagtgtctcaagcaacctaccgcccgcccgcccrcccgccgcttcatttcctccactccacactcaccacgacacgacacaccaccaccctcttcccttctcttctctcaagaaagaaccagctagcgcgcgcacacacacacacaagcctccccacacccgccatgtctgcgtcgccggagttctacaagccagcgccgccggcgttctcgccgtgcagctcgccgctcctgctgcacggggcaggggtggcggtgggagcagtagccgaggagagcaccgccgccgcggcgaccgtgtcgcaggatgaggaggaggactaccgctgccggacgccgacgggcggggagagccaggtgaggccgccggggacctgcccgccggcgccgcggaagccgcgggcgcccgcggcccccgcgccgtgccggaagcgcctgttcgaggtggaggtgttcagcctgcggcttgaggagctggagcgcctcttctggcgcccggccccgcgcgccgccaccgccgccgccgtccgcccagaagaagcgccggagggtggcctgcccggagcccaagaagagatagtagctaccttcgtgtggcaggtgctagtcgtagtagtagtacaggtcgtgtagcagcggtagctagctaggtgcagagccaagtggttttggcttggatcgatcacatacagcagcttattattaggatcggaggtccatggtaggggggtgcttaggagaggactgctgtacttgtactgctacagctcgtcggcacatctctctagctagtttcctctatctatagctcacaatcagttcctgtagttgctagatgctgttcagtgtgtgtatgtggtgatgatagtgtcatggtgtcaaaaggtgtaagcgcaatactaggcactagctagctagctgtaggcaggagctgcatgccctgaatctccattyttccatgtagcccctgtgtgtaacgaagaagctaagctcacttgtatcaaaaaaaaaaaaaaaa

SEQ ID NO: 3927 - protein, 155 aa, Zea mays
  misc_feature: Ceres CLONE 294140
MSASPEFYKPAPPAFSPCSSPLLLHGAGVAVGAVAEESTAAAATVSQDEEEDYRCRTPTGGESQVRPPGTCPPAPRKPRAPAAPAPCRKRLFEVEVFSLRLEELERLFWRPAPRAATAAAVRPEEAPEGGLPGAQEEIVATFVWQVLVVVVVQVV

SEQ ID NO: 3928 - DNA, 334 bp, Zea mays
  misc_feature: Ceres CLONE 294147-F
  misc_feature: Encodes the peptide sequence at SEQ ID NO. 3929
aaaactgaaccagcaacaaaccgatgcccatgagattgacatggtgatcgagctacaggccggtcgtcttctccaacgctagacaacgaagaaggagcaattaatcaagtagatcgattcaatccaatccaatggggttgctgataccagcccgtccggagcaatgcacgttgagccgtgtcgtgtctctcatcaccgtcggtktcgtcatcgtggtttgcacgtacgtcacatcttctccggccggtggcgacgcggggaaggaggagttcttcagcatatggcaccgtcgatcatcggattttgtccccgacgatctggaggtggcgctgcg

SEQ ID NO: 3929 - protein, 67 aa, Zea mays
  misc_feature: Ceres CLONE 294147-F
  misc_feature (25)..(25): Xaa is any aa, unknown, or other
MGLLIPARPEQCTLSRVVSLITVGXVIVVCTYVTSSPAGGDAGKEEFFSIWHRRSSDFVPDDLEVAL

SEQ ID NO: 3930 - DNA, 378 bp, Zea mays
  misc_feature: Ceres CLONE 294156-F
  misc_feature: Translation starting site: 222
atccaatcctcggaacgacgcgcgggcgaggaggacccccgacggaggatggcggcggcggctagggttttacgcgggtccctcttcctgatgtccccggcggcgggcgcaaggcgtcggcagccaagaaggcgggcgcggcggcggcggcggcggcggtggccaagaagaccgaggcggccactacgaagccgagactgccgaccgggatcacgaagccgatgccggtctccgatgagttccgcagttcgccggcggccggcccgaggtcgcacgctccgaggccatcaagctcatctgggcccacatcaaggcccacggcttccagaacccagccaagaaaacggagatcaactggcgacgccacgctcaaaagct

SEQ ID NO: 3931 - DNA, 409 bp, Zea mays
  misc_feature: Ceres CLONE 294161-F
  misc_feature: Encodes the peptide sequence at SEQ ID NO. 3932
  misc_feature (208)..(208): n is a, c, t, g, unknown, or other
ctttctaacctgcgatctccgtcgatccagccgagaggtcgtgtgcgcgtggatctctgcgtagaagggatgaagattacggcgctcctggtgctgaagccgtcgacctccggagccgggagctcctcgtccggcggcgagtcgggcccggagcggtggtgctcgcgaacgsattagacgtcagccacttcggctatttccagcgcmncgcccgcgagttcatcgtctttgttgcccgcaccgtcgctcagcgcacccagccaggccagcggcagtccgtccagcacgaaraatacaaggtccactcccacaatagaaatgggctttgtgcggttgcattcatggatgatcattatcctggtacggagtgcgttttctcttctgaatcaggttcttgatgagtaccaga

SEQ ID NO: 3932 - protein, 57 aa, Zea mays
  misc_feature: Ceres CLONE 294161-F
LSNLRSPSIQPRGRVRVDLCVEGMKITALLVLKPSTSGAGSSSSGGESGPERWCSRT

SEQ ID NO: 3933 - DNA, 306 bp, Zea mays
  misc_feature: Ceres CLONE 294176-F
  misc_feature: Encodes the peptide sequence at SEQ ID NO. 3934
  misc_feature (108)..(108): n is a, c, t, g, unknown, or other
aagaaggatccccaccccgaccgacctaccctaatcggcgatggcgacggtggcgatggacatctcgaagcccactccagtgcgtccggcgacgaggccgcggcggcnaaagggggaggagcggcggagggggcgakgggctgcggcagtactacctgcagcacatccacgacctgcagctccagatccggcagaagacccacaacctcaaccgtctcgagggcccagcgcaatgacctcaactcccgakttagaatgctcagggaagakttgcagttgcttcaagagcctggctcatatgttggt

SEQ ID NO: 3934 - protein, 77 aa, Zea mays
  misc_feature: Ceres CLONE 294176-F
  misc_feature (36)..(36): Xaa is any aa, unknown, or other
  misc_feature (45)..(45): Xaa is any aa, unknown, or other
EGSPPRPTYPNRRWRRWRWTSRSPLQCVRRRGRGGXRGRSGGGGXGLRQYYLQHIHDLQLQIRQKTHNLNRLEGPAQ

SEQ ID NO: 3935 - DNA, 132 bp, Zea mays
  misc_feature: Ceres CLONE 294197-F
acacgcacaccgcgacccagtccagagccagtacgtgcgamrcacgcacgctgctggtccgcgtacsagacgacggtcaggtcggccggtgcttttcagtttggaataatgacggcgacgacgacgacagcc

SEQ ID NO: 3936 - DNA, 109 bp, Zea mays
  misc_feature: Ceres CLONE 294203-F
atcaccaatcagtcattcacagctcacagcaaacaccgcgamcgcccccgctcccaaacccgaccgagcaaagcgaaagccccccaaccgcggatcaatccgcagcatc

SEQ ID NO: 3937 - DNA, 194 bp, Zea mays
  misc_feature: Ceres CLONE 294223-F
  misc_feature: Encodes the peptide sequence at SEQ ID NO. 3938
  misc_feature (85)..(85): n is a, c, t, g, unknown, or other
accacctgcagaggacccgcgctcgccgctatcattcgtttctagagacccttctagccccgccgccaccacaccaccaatggynggactcggatcaaaggccctcgccgtggtcgccgtcctggcggccgtcgtcctctcggtggcctccgcggccgaggcgcccgcgcccagccccgtctccgccgccgccg

SEQ ID NO: 3938 - protein, 38 aa, Zea mays
  misc_feature: Ceres CLONE 294223-F
  misc_feature (2)..(2): Xaa is any aa, unknown, or other
MXGLGSKALAVVAVLAAVVLSVASAAEAPAPSPVSAAA

SEQ ID NO: 3939 - DNA, 474 bp, Zea mays
  misc_feature: Ceres CLONE 294226-F
ctcccttcttacagccgccgccgccgcatcccagcctccatcaccgtttccgtctcgttgccatgggtaaggtgcacggatcgttggcgcgcgccgggaaggtccgcgggcagacccccaaggtggcgacgaggacaagaagaagaagccccgcgccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttattt

SEQ ID NO: 3940 - DNA, 233 bp, Zea mays
  misc_feature: Ceres CLONE 294238-F
  misc_feature: Encodes the peptide sequence at SEQ ID NO. 3941
  misc_feature (82)..(82): n is a, c, t, g, unknown, or other
  misc_feature (143)..(143): n is a, c, t, g, unknown, or other
  misc_feature (145)..(145): n is a, c, t, g, unknown, or other
agggccgattctctgcgtgacttggggcgtcgtcgcgagttttctccggccgagggcggcgcgaccggacaaccagcgtgancgaccggcgacatgactcgcggcaaccagcgtgaccgcgaccgtgagcgcgcggcggcggnanagcccaacgccaagaactcccaggacgggctcaccccggagcagcgccgcgagagggacaagaaagctctggaggagaaggcggccaa

SEQ ID NO: 3941 - protein, 46 aa, Zea mays; identical to SEQ ID NO: 3277
  misc_feature: Ceres CLONE 294238-F
  misc_feature (1)..(46): Pfam Name: 4F5 Pfam Description: 4F5 protein family
  misc_feature (17)..(17): Xaa is any aa, unknown, or other
  misc_feature (18)..(18): Xaa is any aa, unknown, or other

SEQ ID NO: 3942 - DNA, 230 bp, Zea mays
  misc_feature: Ceres CLONE 294247-F
cgcaaaccctcctaccccattccgccgcccgccccgsaccccgaggaggaggcaagatgaagacgatcctggcgtcggagmwtggacatcccggagcgtcacagtgacggtggcggccaagctggtgacggtggagggccccccgcggaagctcaccccggaacttcaagcacctcaacctcgacttccagctgcaggagggcggccgcaagctcaaaggtggacgcatg

SEQ ID NO: 3943 - DNA, 110 bp, Zea mays
  misc_feature: Ceres CLONE 294275-F
acacgcacaccgcgacccagtccagagccagtacgtgcgamgcacgcacgctgctggtccgcgtacsagacgacggtcaggtcggccggtgcttttcagtttggaataat

SEQ ID NO: 3944 - DNA, 489 bp, Zea mays
  misc_feature: Ceres CLONE 294346-F
  misc_feature: Translation starting site: 303
  misc_feature (36)..(36): n is a, c, t, g, unknown, or other
aaaacctctcctggcacgagatcacgcttctcgttngatcgaacagctagggtttccaagatgttcgggcgcgcgccgwagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcasaakgcagcgaatgggagaggatgtggttcatcctctaaaggtttctctggaggatttgtacaatggcacatcaaagaagctctctctgt

SEQ ID NO: 3945 - DNA, 395 bp, Zea mays
  misc_feature: Ceres CLONE 294349-F
  misc_feature (47)..(47): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
accaccgccgcgccgcccaaaccctagccgccgccgccgtcgccgynatggtcgccgtgnnngccctctcgtctccgtgaaggccctagagggagacatggtaaccgacgcccccggcatcgyywtaccgcccgtcttcggggcgccgatccgccccgacgtggtcaggttcacccacaagctgctgtcctgcaacaagcgccascctacgcatctcccgccgcgccgccaccagacgtcggccgagtcctggggtacggccgcgcstgttctcgtatcccccgcgtccccggcggcggcacccaccgcgccggccagggagcgttcggcaacatgtgccgcggcgggcgcatgttcgcgccaccaagatctggcgcaagtggcaccgccggcgt

SEQ ID NO: 3946 - DNA, 464 bp, Zea mays
  misc_feature: Ceres CLONE 294371-F
  misc_feature: Translation starting site: 87
  misc_feature (413)..(413): n is a, c, t, g, unknown, or other
actccgccggctcccccactcagaaaacccagccgccgccgcatcggcctcccaggtaagcagtagcgtccaccccagccgccgccatgaagcgcaacccccgcgtcacgagctcccgccggaagtgccgcaagcacttcacggccccgtcctccgtccgccgcgtgctcatgtccgcggcgctatcgacggagctccgccacaagtacaatgtgcgttccatcccgatccgcaagacggacgaggtgcaggtcgtgcgcggcacctacaagggccgtgaggcaaagtggtscaggtgtaccgccgtcgctgggtcatccacgttgagcggatcacccgcgagaaggtgaacggctccaccgtgaacgtgggcatccacccttccaaggtcatggttacaaagctgaagcttnacaaggaccgcaagcgctcctcgaccgcaagcccggggckcgccgccgaca

SEQ ID NO: 3947 - DNA, 148 bp, Zea mays
  misc_feature: Ceres CLONE 294384-F
atyccccttctcacgcggctcgctcasggctcgarcgtctccccatcggaaccctaatcctctctttccctactcgcggaaccaactccaccggcaggcaagckgaagggaagcacctcggccccggcaagatggtgctcgcacagct

SEQ ID NO: 3948 - DNA, 232 bp, Zea mays
  misc_feature: Ceres CLONE 294489-F
  misc_feature: Encodes the peptide sequence at SEQ ID NO. 3949
  misc_feature (42)..(42): n is a, c, t, g, unknown, or other
  misc_feature (43)..(43): n is a, c, t, g, unknown, or other
atcgtccatccgtatttccgtcacaactcacaacccgagccnncaaacccgaagcagcaggagctcccctgaccttgctccgcctccgatcaaggaaaaggaagatgagctactackgccagcagccccccgtcggcgtcccgcgcagcaaggctacccggggaaggacggctacccgccagcggggtaccgmgggccggctaccccccgccgcgcagggctacccgccgca

SEQ ID NO: 3949 - protein, 76 aa, Zea mays
  misc_feature: Ceres CLONE 294489-F
  misc_feature (14)..(14): Xaa is any aa, unknown, or other
  misc_feature (39)..(39): Xaa is any aa, unknown, or other
  misc_feature (64)..(64): Xaa is any aa, unknown, or other
RPSVFPSQLTTRAXKPEAAGAPLTLLRLRSRKRKMSYYXQQPPVGVPRSKATRGRTATRQRGTXGRLPPAAQGYPP

SEQ ID NO: 3950 - DNA, 452 bp, Zea mays
  misc_feature: Ceres CLONE 294492-F
  misc_feature: Encodes the peptide sequence at SEQ ID NO. 3951
aacgtgcgttcatctgcagtgcacgaacaatcgagccagcaacataaacgatcgaggcgcggtggccgtagcaaccgcagcaagcatgaataactcgcgcgctctagtgttggtgctcctgctgctggccatcgccatggcgagctgcaggctctcgctcgccgcccacgagagcagcaccagcctcgcgacaccctcggccgcgacctgcgggctccatcgccagggccgccggcaacctcttcagaccggacggtggctggcgcgccgcgaacgtcaccgccgacgccgaggcaaagaacctgagggccgtggcgtcccggagcggcggcccgcaccaggaagtcctccggcgtcggcgcgggctgcgtcacgccgcggacgttgccggaagaggcgggtcatctgcggcaagaggtgctacgacggcgcctcgtcgcggcgccgccgcc

SEQ ID NO: 3951 - protein, 122 aa, Zea mays
  misc_feature: Ceres CLONE 294492-F
MNNSRALVLVLLLLAIAMASCRLSLAAHESSTSLATPSAATCGLHRQGRRQPLQTGRWLARRERHRRRRGKEPEGRGVPERRPAPGSPPASARAASRRGRCRKRRVICGKRCYDGASSRRRR

SEQ ID NO: 3952 - DNA, 461 bp, Zea mays
  misc_feature: Ceres CLONE 294512-F
  misc_feature: Encodes the peptide sequence at SEQ ID NO. 3953
ggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaakgtgtatggaagcatgccaagagtgatgggcatgaggactatggmctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttgg

SEQ ID NO: 3953 - protein, 133 aa, Zea mays
  misc_feature: Ceres CLONE 294512-F
  misc_feature (24)..(133): Pfam Name: Calreticulin Pfam Description: Calreticulin family
  misc_feature (48)..(48): Xaa is any aa, unknown, or other
MMGGRALLLLLVSALLVQIRASDPLLYEPFDEDFEGRWIVSKKDEYQXVWKHAKSDGHEDYGLLVSDKARKYAIIKELDEPVTLNDGTVVLQFEVRLQNGLECGGAYIKYIRPQDAGWDAKEFDNETPYTIMF

SEQ ID NO: 3954 - DNA, 469 bp, Zea mays
  misc_feature: Ceres CLONE 294515-F
  misc_feature: Encodes the peptide sequence at SEQ ID NO. 3955
  misc_feature (313)..(313): n is a, c, t, g, unknown, or other
  misc_feature (314)..(314): n is a, c, t, g, unknown, or other
  misc_feature (419)..(419): n is a, c, t, g, unknown, or other
actactgtattcgtatcattatactgtttggtttccatccctggcagatctcccactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgnngccgtgtgcctcgcctgcctctccgtcgacgactggtcgtgccccgtctgcccgctcggccgccgcatcctcccctcgccagatgaaggcgctggcggttacgtnggcgtacatggtgtacgacgcggcgtgctgccacctcaacggcgacacgc

SEQ ID NO: 3955 - protein, 115 aa, Zea mays
  misc_feature: Ceres CLONE 294515-F
  misc_feature (64)..(64): Xaa is any aa, unknown, or other
MATAAAAAAAAMEEPDVVNGRDVVSWVASGVVLWSTAFLLVRALFPKRSYDFCNRAVSTMHAVXAVCLACLSVDDWSCPVCPLGRRILPSPDEGAGGYVGVHGVRRGVLPPQRRH

SEQ ID NO: 3956 - DNA, 485 bp, Zea mays
  misc_feature: Ceres CLONE 294530-F
  misc_feature: Encodes the peptide sequence at SEQ ID NO. 3957
accgagccgaccgatcgtcgctcatctttgtaggacacccgcaccctccgcgtcgaacacccgatccggacaccgctccaggctccacctctctcccatctcacgccaacgctcactggaccattcctccgtgcttgggagcggcggagagctatccacctcgtctcaggcaccctctggcgtccccctccccccgccgcgtgccggcgagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgttaacattggtgcggcaaatgccccatcccaggtcctggcaacgcttagtggccactatggtcctgtgtggcgtgttgcttgg

SEQ ID NO: 3957 - protein, 65 aa, Zea mays
  misc_feature: Ceres CLONE 294530-F
MSSKKIELDHKDMVHDSAIDYYGKRLATASSDFTVKIVNIGAANAPSQVLATLSGHYGPVWRVAW

SEQ ID NO: 3958 - DNA, 452 bp, Zea mays
  misc_feature: Ceres CLONE 294534-F
  misc_feature: Encodes the peptide sequence at SEQ ID NO. 3959
aataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggctggtcagggcccgccgcgcccaggcgtgcagctcctgcag

SEQ ID NO: 3959 - protein, 122 aa, Zea mays
  misc_feature: Ceres CLONE 294534-F
  misc_feature (1)..(114): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRLVRARRAQACSSC

SEQ ID NO: 3960 - DNA, 323 bp, Zea mays
  misc_feature: Ceres CLONE 294576-F
  misc_feature: Encodes the peptide sequence at SEQ ID NO. 3961
  misc_feature (105)..(105): n is a, c, t, g, unknown, or other
  misc_feature (108)..(108): n is a, c, t, g, unknown, or other
ggaggctttatttatcgtttatccactgaacttccggtgccggcggcgaccacttgtgcgatccatccctcaccatgtcgtcggagaaggaggcggcgctcgcgnggnccttcgatgacagcccaaccatatttgacaagatcatcaaaaaggaaataccttctactgtggtttatgaggacgagaaggtactgccttttcaggggacataaacccttcaagctccaacacacattctcatcatccccaaattcaaggatggactaactggcctggcaaaggctgaagagaggcacatagaaatactkggctatctcctctat

SEQ ID NO: 3961 - protein, 45 aa, Zea mays
  misc_feature: Ceres CLONE 294576-F
  misc_feature (11)..(11): Xaa is any aa, unknown, or other
  misc_feature (12)..(12): Xaa is any aa, unknown, or other
MSSEKEAALAXXFDDSPTIFDKIIKKEIPSTVVYEDEKVLPFQGT

SEQ ID NO: 3962 - DNA, 134 bp, Zea mays
  misc_feature: Ceres CLONE 294589-F
atccatcacagctagctagcatacagacgaataatctcttcttcacctcactaacaccagctakdvaactctttctctcctgcaataatggccgctcgctcctcctcctcccagccgcagctgttcgcggcggc

SEQ ID NO: 3963 - DNA, 156 bp, Zea mays
  misc_feature: Ceres CLONE 294619-F
aagactagagggggaagagagagaggagcagcagagagaagagggggaggcagtccagtgtccacgcacgtacgctccacagaagagagatggcgatgcggatggcggcggcggcggcggcagtggcgctggtggcggtgatgggcgtgctggcgc

SEQ ID NO: 3964 - DNA, 389 bp, Zea mays
  misc_feature: Ceres CLONE 294636-F
  misc_feature: Translation starting site: 57
  misc_feature (222)..(222): n is a, c, t, g, unknown, or other
gaacgcattcctcccatctcccaagacctcctcagacccgagaagcgcmkgcggccatggacgccaccggcactggagctggagggaaggcgaagaagggagcggccggtcgcaaggycsttggtcgattggaagaagtcggtgacgaggtccgtgaaggccgggctccagttccccgtcggccgcatcgggcgctacctcaagaagggccgctacgcgcancgtgcggcagcggtgcccccgtctacctcgcggccgtcctggagtacctcgccgctgaggtcctggagctcgccggcaacgctgccaaggacaacaagaagacgcgcatcgtcccgcgccacgttgctgctggcgatccgcaacgacgaggagctcgggaagctgct

SEQ ID NO: 3965 - DNA, 190 bp, Zea mays
  misc_feature: Ceres CLONE 294654-F
  misc_feature: Encodes the peptide sequence at SEQ ID NO. 3966
  misc_feature (79)..(79): n is a, c, t, g, unknown, or other
acacaaaaacccagcatcagtcaagctcgctcacacgaccatggccgcggcgatgaccggcagtactcgcgccascggnctccttcctcgtgcttcthtttgtcgtgttggccggtgtcgtcgacgtcgcgtccgctgccaccactgcggcgagtgctactgttgccactaacagcggtgacagcgacgc

SEQ ID NO: 3966 - protein, 43 aa, Zea mays
  misc_feature: Ceres CLONE 294654-F
  misc_feature (12)..(12): Xaa is any aa, unknown, or other
  misc_feature (20)..(20): Xaa is any aa, unknown, or other
MAAAMTGSTRAXGLLPRASXCRVGRCRRRRVRCHHCGECYCCH

SEQ ID NO: 3967 - DNA, 386 bp, Zea mays
  misc_feature: Ceres CLONE 294666-F
  misc_feature: Encodes the peptide sequence at SEQ ID NO. 3968
  misc_feature (202)..(202): n is a, c, t, g, unknown, or other
  misc_feature (283)..(283): n is a, c, t, g, unknown, or other
  misc_feature (320)..(320): n is a, c, t, g, unknown, or other
ayactctctctctctccactggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctkgggatcatcggcggcatgctctkcatcatgggcaacgcantatttcatccacaaggccgcgcacggyaatgcckaagtcacatcgggaacgatatgtgggacgtcgccatggagcgccgcncaaagaagctcgtggaacaatcctccggcaactaggntattgatcaacctcaaacttttctggatcttcacgaacctccttcaawagcacagaagtactgctc

SEQ ID NO: 3968 - protein, 64 aa, Zea mays
  misc_feature: Ceres CLONE 294666-F
  misc_feature (21)..(21): Xaa is any aa, unknown, or other
  misc_feature (27)..(27): Xaa is any aa, unknown, or other
  misc_feature (36)..(36): Xaa is any aa, unknown, or other
  misc_feature (38)..(38): Xaa is any aa, unknown, or other
  misc_feature (54)..(54): Xaa is any aa, unknown, or other
MARLHWLEAVLPLGIIGGMLXIMGNAXFHPQGRARXCXSHIGNDMWDVAMERRXKKLVEQSSGN

SEQ ID NO: 3969 - DNA, 694 bp, Zea mays
  misc_feature: Ceres CLONE 294806-R
ccaattgggtaccgggccccccctcgaggtcgacggtatcgataagcttatttttttttttttttgattttttttgagaaaaatatgtctaccataaaatgttaattatcggatgataaggagcaatcacttcattctataatacatctcaacaaacaccgtacgagccggcacacgtgcttaccttttactgtgaatgccggacctcacgaccccagccggtacatcccgcagacatccgccatgaacgggggcgcccgcctgaccatatacagcgctgcggcgccctgcgcgacgtgtaacccgccctccatcatcgcgaacggcatgtcatcagacgccggcttccaatgccgcttccgctggatgataaaacagttgttgatctgcttcaggtccaacccggacatctctgccagcgccaactactccgactcagaagggtagggccacttgaactgcagctcccacgagtgcagcaacttctgcctcgccaccttggggagcttcactttcttcttcctacttggagaactcctgacgaatgccgcccacgtagacgtcatacttcctcagaagctggagcttgagctccttgtcctcggcgcaggaatcgatctcctcaggacagctagggtcctgctcatcctcagactactcggcgacctcatagatgctgtcaacagatccagaa

SEQ ID NO: 3970 - DNA, 465 bp, Zea mays
  misc_feature: Ceres CLONE 294840-F
  misc_feature: Encodes the peptide sequence at SEQ ID NO. 3971
  misc_feature (178)..(178): n is a, c, t, g, unknown, or other
  misc_feature (179)..(179): n is a, c, t, g, unknown, or other
  misc_feature (346)..(346): n is a, c, t, g, unknown, or other
agaccaccgacgggaaaaaaaacatcacgaacaccgttctccatagcgggagtagtgaggaacgaaagagagggggcggcctagggcttcgattccgcagccatggacgccgctgacgtgtggggccgctcatcgtcctcgtcttcttcgtccgccgccgccgcgaggccctgcaggnnccttacgatctgtacatggggatcgacgacgcggacgccggcttggacgaggtgacggatccgcgcgtcgkggcggagtcctacaactgccccttctgcggcgaggacttcgactttgtsggcctctgctgtcacatcgacgacgagcatgccgttgaggctaagancggggcatgccccatctgtgctacaagggtcggaatggacttgataggacatttgactatgcaacatggaagttatttcaagatgcaacgcrggcgcatagtccgaaaagtatcttctg

SEQ ID NO: 3971 - protein, 90 aa, Zea mays
  misc_feature: Ceres CLONE 294840-F
  misc_feature (1)..(90): Pfam Name: Di19 Pfam Description: Drought induced 19 protein (Di19)
  misc_feature (19)..(19): Xaa is any aa, unknown, or other
  misc_feature (51)..(51): Xaa is any aa, unknown, or other
  misc_feature (82)..(82): Xaa is any aa, unknown, or other
MGIDDADAGLDEVTDPRVXAESYNCPFCGEDFDFVGLCCHIDDEHAVEAKXGACPICATRVGMDLIGHLTMQHGSYFKMQRXRIVRKVSS

SEQ ID NO: 3972 - DNA, 444 bp, Zea mays
  misc_feature: Ceres CLONE 294861-F
atccccttcctattctgctttcccctcgctccagagtccagtccccagacgagcggttggagcttcgacgtgcggtttccatttccttccctgctctgatggccgtcgccgaagtggcgatcgagattctcccgcagcagcagcagcagccgccgccgccgccgccgccgcggaaccggcgtagcgcccccgaacctctccgtgccgagagtgctccagtatctgtacctcttgagcgcgtgggtcgcctgcgcgggcgtggctgccgggaccgtggcgcgccgagccttgggcgactcttccccgttggtctacgggttcctcaaagtctcgatcggagccctcgttttccccgcgctgctcatcctcgtcttcgccctgcgggtcttgcgcgccatgcttgcggtggggttcagacggtcactccgcactcacgccagggag

SEQ ID NO: 3973 - DNA, 474 bp, Zea mays
  misc_feature: Ceres CLONE 294903-F
  misc_feature: Encodes the peptide sequence at SEQ ID NO. 3974
acatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccttccgtccgcctagcttgctacaagca

SEQ ID NO: 3974 - protein, 89 aa, Zea mays
  misc_feature: Ceres CLONE 294903-F
MKSRSSTLLVILVLQALLLSAAVAKGPAGPKKQCWCGECTSWSGVWTCDDLLTKCAATCKNCVPVSTDKGATKYRCRDFLPENCGCKIH

SEQ ID NO: 3975 - DNA, 472 bp, Zea mays
  misc_feature: Ceres CLONE 294905-F
  misc_feature: Encodes the peptide sequence at SEQ ID NO. 3976
aagatttcgctaatggaaagccaaacacctttctttcatggcaccatcgatcagggacgccagcccagctgctgcaaaggaggtactcatgcagcggtgatgagcgaggaggccccaaggaggagttcctgtgctgcccaccaccaccacctctgaaaagggcccggatgggatacgagagcatgcagggaagccatggagtcagtgatgcgaggactactgctgggggagggggactgtactgcatcgatgattacatgcaagccatggccgtgggctggagaataaaggaggagggcctcatcagatggcagaggagagatgcggctgctgctacgccttccaatctccaagccatgggatgtttggtgcaagaatctggcccctttaagcaggtacgccgaccagaagcacaccgtcttggttctgcgctgaagcagcaggacggcgacgactccagcaaagaggacgg

SEQ ID NO: 3976 - protein, 156 aa, Zea mays
  misc_feature: Ceres CLONE 294905-F
DFANGKPNTFLSWHHRSGTPAQLLQRRYSCSGDERGGPKEEFLCCPPPPPLKRARMGYESMQGSHGVSDARTTAGGGGLYCIDDYMQAMAVGWRIKEEGLIRWQRRDAAAATPSNLQAMGCLVQESGPFKQVRRPEAHRLGSALKQQDGDDSSKED

SEQ ID NO: 3977 - DNA, 186 bp, Zea mays
  misc_feature: Ceres CLONE 294943-F
agagccggtcgaggcacgccactccgcagtgtcagtcactgcccccccatcacgccgcccgccctttctcggccgttgccgcgagctcgctccgacccaccgccaatggsacggcgatgggcgcgatggccgccacctgcatggcctcgatgccggccgccgctacgttccccggtgatctcggcg

SEQ ID NO: 3978 - DNA, 138 bp, Zea mays
  misc_feature: Ceres CLONE 294985-F
  misc_feature (115)..(115): n is a, c, t, g, unknown, or other
aggagtgcccgaagacgaagagtccggcctcctcccccgcccgtycgcagccggccgacggcttcctctcgcggtgcccgcttcccgcctccaccggcagcctgggcgacggtgnacggccccctcggcttccgctgg

SEQ ID NO: 3979 - DNA, 225 bp, Zea mays
  misc_feature: Ceres CLONE 295012-F
  misc_feature: Encodes the peptide sequence at SEQ ID NO. 3980
atcacaattcacagcgctcaagttctcgcgcccacagccaaatttttctccactcaatcgcggcataagctgcactgcascatggacgccagcggascggtagcaaggcgaagaagggggcggctggbvcgcaaggtctggcggccccaggaagaagtcggtgtygcggtccgtcaaggccgggctgcagttccccgttcggccggatcgggcgctacctcaaga

SEQ ID NO: 3980 - protein, 33 aa, Zea mays
  misc_feature: Ceres CLONE 295012-F
  misc_feature (27)..(27): Xaa is any aa, unknown, or other
  misc_feature (32)..(32): Xaa is any aa, unknown, or other
SQFTALKFSRPQPNFSPLNRGISCTAXWTPAXR

SEQ ID NO: 3981 - DNA, 87 bp, Zea mays
  misc_feature: Ceres CLONE 295034-F
  misc_feature: Encodes the peptide sequence at SEQ ID NO. 3982
gaaaaatactcccgtgttcttcgaccggcggcggtggtgcgamgagggcggtaagggagacgagatgagggggacgaagcggccgct

SEQ ID NO: 3982 - protein, 28 aa, Zea mays
  misc_feature: Ceres CLONE 295034-F
  misc_feature (14)..(14): Xaa is any aa, unknown, or other
KNTPVFFDRRRWCXEGGKGDEMRGTKRP

SEQ ID NO: 3983 - DNA, 450 bp, Zea mays
  misc_feature: Ceres CLONE 295072-F
  misc_feature: Encodes the peptide sequence at SEQ ID NO. 3984
  misc_feature (145)..(145): n is a, c, t, g, unknown, or other
agaagccgctctagttggattattccgttcgtcagttccgtccggagcggcggaggctctgttacgtggtgcaaaaatgagtgacaacctgatggacaaggttagcgcctttggtgagcgcttgaagatcaccgggacagaagtnagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacttggtcaacacagagaaggttgacagtgtggaactcatccgtgggatcaagaagaggattatgctgaaggatgccagggtccagtacctctccttggtcctgcttgagactattgtcaagaactgcgacaaggccttctcggaagtcgcggccga

SEQ ID NO: 3984 - protein, 124 aa, Zea mays
  misc_feature: Ceres CLONE 295072-F
MSDNLMDKVSAFGERLKITGTEVSKKMTAGMSSMSFKMKELFQGQTPADKIVEGATSEDLDGPDWNSNLEICDLVNTEKVDSVELIRGIKKRIMLKDARVQYLSLVLLETIVKNCDKAFSEVAA

SEQ ID NO: 3985 - DNA, 186 bp, Zea mays
  misc_feature: Ceres CLONE 295074-F
accacctcccgcagcaggcagccaggcacaagcacactaagccttcgcattcctgtccggcggaaccgcggaaggaagggagccgaacgagcaagcaagccaccaaggaaggttgctagggccggggcggatggggttcatactgcgggtgaggctcgcctccttcttcgccggcgcggctgccgc

SEQ ID NO: 3986 - DNA, 405 bp, Zea mays
  misc_feature: Ceres CLONE 295105-F
  misc_feature: Encodes the peptide sequence at SEQ ID NO. 3987
  misc_feature (350)..(350): n is a, c, t, g, unknown, or other
agatctgagatcgacatcgatccaccgaggtttcttgtgcgtgccgccatggccatggcagtagctcaccttcttcctcagctctccgccgamrattggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccactcgccgccgctcgcgcagtcgggcttctacctggcgccgtccgccacgtccagcatggaccwgccgtcgtcggggacatggtccggcacgttgtgggcgcgcacgggctncgtggccgaccccgccaccgggcgcttctcctgcgccacggccgaytgcggcacg

SEQ ID NO: 3987 - protein, 37 aa, Zea mays
  misc_feature: Ceres CLONE 295105-F
  misc_feature (3)..(3): Xaa is any aa, unknown, or other
  misc_feature (19)..(19): Xaa is any aa, unknown, or other
MDXPSSGTWSGTLWARTGXVADPATGRFSCATADCGT

SEQ ID NO: 3988 - DNA, 414 bp, Zea mays
  misc_feature: Ceres CLONE 295107-F
  misc_feature: Encodes the peptide sequence at SEQ ID NO. 3989
  misc_feature (303)..(303): n is a, c, t, g, unknown, or other
  misc_feature (305)..(305): n is a, c, t, g, unknown, or other
cacgagaaggccagggagacgtcttgcttctccttcgctcgtctacctgcttcctagttgttccatcatccatggcgcgcttcgcctccgctgtcctcttcgccgctgtcctgctcatggctggacggctgacccatgcggggccgtcgacggcgaggtgctttggcggcgcgcagtcctgccgggctccgcgtgccgaacgccgtcctccggctcctacgcccctatagccacttcgtaagckascaatgccgaggacaccgggcgatccaacgctccgttcaactaccaaaactacaagcnhnvctctgcgactgckacctcacctccaggtaccgcagtgaagcagggctcgctggtggcagcggcgcgagagatgacacgccgttcagctacagctacagggcgccgagc

SEQ ID NO: 3989 - protein, 79 aa, Zea mays
  misc_feature: Ceres CLONE 295107-F
TRRPGRRLASPSLVYLLPSCSIIHGALRLRCPLRRCPAHGWTADPCGAVDGEVLWRRAVLPGSACRTPSSGSYAPIATS

SEQ ID NO: 3990 - DNA, 97 bp, Zea mays
  misc_feature: Ceres CLONE 295116-F
  misc_feature: Encodes the peptide sequence at SEQ ID NO. 3991
gtcggctagtttggacgcatggctgctgmggagattagagaccacagcgcgcgaggcgaggagaataagctatgggcgcgccgaagcagaaatggac

SEQ ID NO: 3991 - protein, 32 aa, Zea mays
  misc_feature: Ceres CLONE 295116-F
SASLDAWLLRRLETTAREARRISYGRAEAEMD

SEQ ID NO: 3992 - DNA, 106 bp, Zea mays
  misc_feature: Ceres CLONE 295161-F
acacgcacaccgcgacccagtccagagccagtacgtgcgamggcacgcacgctgctggtccgcgtacsagacgacggtcaggtcggccggtgcttttcagtttgga

SEQ ID NO: 3993 - DNA, 109 bp, Zea mays; identical to SEQ ID NO: 3915
  misc_feature: Ceres CLONE 295165-F

SEQ ID NO: 3994 - DNA, 112 bp, Zea mays
  misc_feature: Ceres CLONE 295177-F
acacgcacaccgcgacccagtccagagccagtacgtgcgamggccacgcacgctgctggtccgcgtacsagacgacggtcaggtcggccggtgcttttcagtttggaataat

SEQ ID NO: 3995 - DNA, 102 bp, Zea mays
  misc_feature: Ceres CLONE 295199-F
acacgcacaccgcgacccagtccagagccagtacgtgcgamgtcacgcacgctgctggtccgcgtacsagacgacggtcaggtcggccggtgcttttcagtt

SEQ ID NO: 3996 - DNA, 117 bp, Zea mays; identical to SEQ ID NO: 2403
  misc_feature: Ceres CLONE 295208-F

SEQ ID NO: 3997 - DNA, 293 bp, Zea mays
  misc_feature: Ceres CLONE 295216-F
  misc_feature: Encodes the peptide sequence at SEQ ID NO. 3998
  misc_feature (227)..(227): n is a, c, t, g, unknown, or other
aacgtggagactcgttggtctacaacgtaaacgataaagggggcggcasagcaagcatgacgaggtcgcgagctgtagtgacgttagtgctcctgctggccgtcgccacggcgagctgcaggctgtcgctcgccgccgacgagaccatcgcagccatcttgggccgcgacctgcggggttcatcgccagggccggcaacctcttcaggtcggacggcagcgctggcngccgcgaacctcaccgcggccgaggcgaagaacctgagggccgccagaagtcgtcctccggcggca

SEQ ID NO: 3998 - protein, 79 aa, Zea mays
  misc_feature: Ceres CLONE 295216-F
MTRSRAVVTLVLLLAVATASCRLSLAADETIAAILGRDLRGSSPGPATSSGRTAALAAANLTAAEAKNLRAARSRPPAA

SEQ ID NO: 3999 - DNA, 163 bp, Zea mays
  misc_feature: Ceres CLONE 295218-F
attttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgc

SEQ ID NO: 4000 - DNA, 257 bp, Zea mays
  misc_feature: Ceres CLONE 295230-F
  misc_feature: Encodes the peptide sequence at SEQ ID NO. 4001
  misc_feature (48)..(48): n is a, c, t, g, unknown, or other
  misc_feature (49)..(49): n is a, c, t, g, unknown, or other
gcaatccgtatcatcatcttggcctcgtcaatccaccaccaccgtcgnnctgagctcctcctccggcttcgcttcgcttcgctgtcttgcctcctcctcggtcgaagaagaagaagaaaacatgtgtccgggatccgtggagtcgtcgtcggcggcggcggcgggcaagagcgtgtgcgtgatggacgccgcggggccgctgggccacgcctcggtgaccgcctcctccggcgcgggtacacagtccacgccgccac

SEQ ID NO: 4001 - protein, 45 aa, Zea mays
  misc_feature: Ceres CLONE 295230-F
MCPGSVESSSAAAAGKSVCVMDAAGPLGHASVTASSGAGTQSTPP

SEQ ID NO: 4002 - DNA, 389 bp, Zea mays
  misc_feature: Ceres CLONE 295232-F
  misc_feature: Encodes the peptide sequence at SEQ ID NO. 4003
ctctgccaacaaacaaagaacagacctatcgctacacagtccgccgtggctctctgcaattaatggctgcctccacagcgtcgtcgtcatactctgccggtgtaagcgccgcctgctgtgtgtctccgcgccatggcagcagcttcgtcaagccgcagcgctctggacggccggcggcggcggcggcgaccctacctgcgtcaggcggcgaccagcsaatcctatcgttagactgctgtcgtaggagtaagagtagggctagaagaggcgagcgaatcagggcttcagatgatgctgcgaccatcatggacgcgggcggctkggcagcacggcttgaagccccgccgccggtagccgtcgtcactggagcgtctagagggattggcaga

SEQ ID NO: 4003 - protein, 109 aa, Zea mays
  misc_feature: Ceres CLONE 295232-F
  misc_feature (52)..(52): Xaa is any aa, unknown, or other
  misc_feature (87)..(87): Xaa is any aa, unknown, or other
MAASTASSSYSAGVSAACCVSPRHGSSFVKPQRSGRPAAAAATLPASGGDQXILSLDCCRRSKSRARRGERIRASDDAATIMDAGGXAARLEAPPPVAVVTGASRGIGR

SEQ ID NO: 4004 - DNA, 422 bp, Zea mays
  misc_feature: Ceres CLONE 295234-F
  misc_feature: Encodes the peptide sequence at SEQ ID NO. 4005
acctcacttcctctccctccctcactcggccaaagctgactacagcctacaagcgavttaagaagagctcttcccgatagccatggccaagcccccgcttcaaacggctgcgatcatcctcctcgtactcctctcggccgcgtcgtgcctccacaccgtcgatgccgccactttagggttctgttggggcaagtgcagcgttcggtgcgcgggggcgaccgcgggtcaggcgsayccgcgttgcatgagctcctgtggcctctgctgcgaggcatgcaactgcgtgccgcacgacatccatgactgcccctgctaccgcaacatgctcaccgccggccccaagaagagggcccaattgcccctgagactgagactacgaggtcgactcacacgggcggcatcaatgggactgcgactgctgc

SEQ ID NO: 4005 - protein, 113 aa, Zea mays
  misc_feature: Ceres CLONE 295234-F
  misc_feature (1)..(86): Pfam Name: GASA Pfam Description: Gibberellin regulated protein
  misc_feature (51)..(51): Xaa is any aa, unknown, or other
MAKPPLQTAAIILLVLLSAASCLHTVDAATLGFCWGKCSVRCAGATAGQAXPRCMSSCGLCCEACNCVPHDIHDCPCYRNMLTAGPKKRAQLPLRLRLRGRLTRAASMGLRLL

SEQ ID NO: 4006 - DNA, 371 bp, Zea mays
  misc_feature: Ceres CLONE 295263-F
  misc_feature: Encodes the peptide sequence at SEQ ID NO. 4007
  misc_feature (265)..(265): n is a, c, t, g, unknown, or other
aggaaaagcacgcgagagcttgtcggagggctctctgtctctgtgataaaccgatacgcagaggaagctgcggagaggtgtccctgctctgccggtgagctgcggccagcggtgaagagaagtggaccggacggggacgaaggagagatgakaagaagaaaaaggcgccgcgggggccatggctggacacgcgccggckagggacaagaccaccaccggcttcgcsctwacgtgcagcctgctgagccagtttctcaaggagaanaagggcggcctgcagggctccggcggcctcgcatggcgccggcgcggcagctggagcaggggctttccggccgccgaccaccatgaacttgctgtccgcgctcgac

SEQ ID NO: 4007 - protein, 64 aa, Zea mays
  misc_feature: Ceres CLONE 295263-F
  misc_feature (29)..(29): Xaa is any aa, unknown, or other
MAGHAPARDKTTTGFALTCSLLSQFLKEXKGGLQGSGGLAWRRRGSWSRGFPAADHHELAVRAR

SEQ ID NO: 4008 - DNA, 481 bp, Zea mays
  misc_feature: Ceres CLONE 295271-F
  misc_feature: Translation starting site: 85
  misc_feature: SWISSPROT Homolog: EC 2.3.1.74 Naringenin-chalcone synthase
  misc_feature: SWISSPROT Homolog: EC 2.3.1.95 Trihydroxystilbene synthase
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcannntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagaatggcgacggaggcgtccctgtcgtgcgtccgctcgtggggcggcgcgctctcgtccatcaccca

SEQ ID NO: 4009 - DNA, 377 bp, Zea mays
  misc_feature: Ceres CLONE 295279-F
  misc_feature: Encodes the peptide sequence at SEQ ID NO. 4010
  misc_feature (137)..(137): n is a, c, t, g, unknown, or other
gtagtcctaggcactttcatctgtggcctctgcgttcgagatcgatctgagctggcaccgtcccacttcgccatggcggaggaccggagccccaagcycatccactgcaaagcggcggtgtgcagagccgccggcrngccactcaccatcgaggagatcgtcgtcgacccgccgaaagcktacgakatccgcatccgggtcgtctgcacctcactctgccacaccgatatcaccttctggaaagctaaggtggcaccggtgtttccaagaatacttkkrgcatgaggcgtacggggtagtggagagcgtgggggagcacgtggagggcttcgcggcgggggacaccgtggtgccgacgttcctggggcagtgcgagc

SEQ ID NO: 4010 - protein, 70 aa, Zea mays
  misc_feature: Ceres CLONE 295279-F
  misc_feature: SWISSPROT Homolog: EC 1.1.1.1 Alcohol dehydrogenase
  misc_feature (9)..(9): Xaa is any aa, unknown, or other
  misc_feature (22)..(22): Xaa is any aa, unknown, or other
  misc_feature (38)..(38): Xaa is any aa, unknown, or other
  misc_feature (69)..(69): Xaa is any aa, unknown, or other
MAEDRSPKXIHCKAAVCRAAGXPLTIEEIVVDPPKAYXIRIRVVCTSLCHTDITFWKAKVAPVFPRILXA

SEQ ID NO: 4011 - DNA, 117 bp, Zea mays
  misc_feature: Ceres CLONE 295346-F
aataagaaaaatactcccgtgttcttcgaccggcggcggtggtgcgamgaggcggtaagggagacgagatgagggggacgaagcggccgctcggstggtgacgtcgtgggtgcggcg

SEQ ID NO: 4012 - DNA, 504 bp, Zea mays
  misc_feature: Ceres CLONE 295350-F
  misc_feature: Translation starting site: 234
  misc_feature: SWISSPROT Homolog: EC 2.7.10.2 Non-specific protein-tyrosine kinase
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgckacaacggaactggcatggtcaaggctgggttcgccrgcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgttggctcccgaggagcaccccgtcctcctcaccgaggcgcccctgaaccccaaggctaacagggagaagatgacccagatcatgttcgagacctttcaacaccccccgctatgt

SEQ ID NO: 4013 - DNA, 159 bp, Zea mays
  misc_feature: Ceres CLONE 295357-F
  misc_feature (82)..(82): n is a, c, t, g, unknown, or other
tcctccgcacaaacgcgtcgcatccgctccacaggatcctctgcgccaccgcaaccgtgtgaccgcccgtgcygccgggwdncccgatccgccgacccgtcccagccccgctcgcagccatgtcgccgtcggagccgacgcggtgaggagagcgtgtac

SEQ ID NO: 4014 - DNA, 103 bp, Zea mays
  misc_feature: Ceres CLONE 295372-F
  misc_feature (59)..(59): n is a, c, t, g, unknown, or other
aaccgcgtccccaacgcgaatcatccttcttccgtcaccagacagacgggtagagatkncgaacaatcgccggctcgacgcccctcttcccgacgccgcacgc

SEQ ID NO: 4015 - DNA, 334 bp, Zea mays
  misc_feature: Ceres CLONE 295388-F
  misc_feature: Encodes the peptide sequence at SEQ ID NO. 4016
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
acacaaccaagctcgatccatctcactctccgctggtcgctcactcttgcagctccacccttcactcagtcttagtctcttattagctctaggctctagctagccgcgccactccttcgtgtagccatcagycttctyatcgnnnccaatggccactgccgaggtccagaccccgaccgtcgtggcggccgaggaagcgcccgtggtggagaccccgccgccggccgtcgtgcccgagcagtctgcccccgccgaggccgaggccgaggccgaggctgtctgctcctgctgatcccgaggagcttcccgcggccgagcagcaggcagccgccga

SEQ ID NO: 4016 - protein, 47 aa, Zea mays
  misc_feature: Ceres CLONE 295388-F
MATAEVQTPTVVAAEEAPVVETPPPAVVPEQSAPAEAEAEAEAVCSC

SEQ ID NO: 4017 - DNA, 476 bp, Zea mays
  misc_feature: Ceres CLONE 295397-F
ctcttttccgccgcccatggtggccgcgccmtcccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggttggttacaataaaagttatccgcaataggcaaacaggacagtcagaggggtatggatttgttgagttcttttctcatgcatcagcaggagaaagctcttcagaattttactggtcatgtgatgccaaacactgaccggccatttaaattgaactgggcatcgtatagcatgggtgaaaagcgatctgaagtggcttctgatcactcgatatttgttggcgatctagctgctgatgtcact

SEQ ID NO: 4018 - DNA, 528 bp, Zea mays
  misc_feature: Ceres CLONE 295410-F
  misc_feature: Encodes the peptide sequence at SEQ ID NO. 4019
aaaaaagttcccgtcttcggtcttcccaaacccccaacatccatgatccatctcatcgacaccccctccgctctccttatcccttccattcgcccaaacccccgccgccgtgacccctgccagcccgcggccttcccctcgttctaggcttcaactgccggcctcgtgtcttctgcgcgtccctgtggcagggcaagtgaagagagagatggcgtcgcaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgttaactccatcgtcggggagaggatcgccactgtcagcgctttccagtctgagggtctgagaccgatgatgtggtcgcgcacaagggcagggttcaccttgaacattatcgacactcctgggcttaattgaaggttggatacatttaaattgagcaggctg

SEQ ID NO: 4019 - protein, 54 aa, Zea mays
  misc_feature: Ceres CLONE 295410-F
MGKGGVGKSSTVNSIVGERIATVSAFQSEGLRPMMWSRTRAGFTLNIIDTPGLN

SEQ ID NO: 4020 - DNA, 495 bp, Zea mays
  misc_feature: Ceres CLONE 295429-F
  misc_feature: Encodes the peptide sequence at SEQ ID NO. 4021
aaaaaagttcccgtcttcggtcttcccaaacccccaacatccatgatccatctcatcgacaccccctccgctctccttatcccttccattcgcccaaacccccgccgccgtgacccctgccagcccgcggccttcccctcgttctaggcttcaactgccggcctcgtgtcttctgcgcgtccctgtggcagggcaagtgaagagagagatggcgtcgcaataccgcgcgagtgggtcgggctgcagcagtttcctccggccacccagaccgagctgcacgagctcctcggcaagctcaaggaggaggatgtgagcacattgacaattctggtgatggggaaaggcggaktggggaagtcatctactgttaactccatcgtcggggagaggatcgccactgtcagcgctttccagtctgagggtctgagaccgatgatgtggtcgcgcacaagggcagggttcaccttgaacattatcgacactcctgggcttatt

SEQ ID NO: 4021 - protein, 54 aa, Zea mays
  misc_feature: Ceres CLONE 295429-F
  misc_feature (6)..(6): Xaa is any aa, unknown, or other
MGKGGXGKSSTVNSIVGERIATVSAFQSEGLRPMMWSRTRAGFTLNIIDTPGLI

SEQ ID NO: 4022 - DNA, 375 bp, Zea mays
  misc_feature: Ceres CLONE 295437-F
  misc_feature: Encodes the peptide sequence at SEQ ID NO. 4023
  misc_feature (355)..(355): n is a, c, t, g, unknown, or other
attaaagatcacaacagctagcgttctcccgctagcttccctctctcctctgctgatctttttcgtccaccagcattgaggagaagaggaagctgcagtggcggcgagggcgtgatggcatcgtgcagtaccctcacctgttcttcgcggccctggcctggccctcctagtcgcggacccgttcggcctcagtccgctggccgaggtcgactaccggccggtgaagcacgagctcgcgccgtacggggaggtcatggggcagctggccagagacaatkccagccggctcaggcgcgggaggctggagttcgtcggcgaggtgttcgggccggagtccatcgagttcgatctccangggccgcgggcgtacgccgg

SEQ ID NO: 4023 - protein, 40 aa, Zea mays
  misc_feature: Ceres CLONE 295437-F
  misc_feature (9)..(9): Xaa is any aa, unknown, or other
  misc_feature (34)..(34): Xaa is any aa, unknown, or other
MGQLARDNXSRLRRGRLEFVGEVFGPESIEFDLXGPRAYA

SEQ ID NO: 4024 - DNA, 393 bp, Zea mays
  misc_feature: Ceres CLONE 295517-F
  misc_feature: Encodes the peptide sequence at SEQ ID NO. 4025
  misc_feature (361)..(361): n is a, c, t, g, unknown, or other
agggatcaatcatccgtccatggagaacctaaaggagcagcggggacacgacgcggcgggcgccaacgctggatgacggtgccggcgttcggggactgggacacgaagaacggcgcgctgccggactactccatggacttctccaagatccgcgagatgcgcaasagaacaagaaggagctctcccgcgccasctcggcggcgacgacgacctcctcgcccacgcccaggcccaggccctgaagccgcagsagttaacgccccgcccaagctcggccgcccccgccccggccccgccgacgaccactccccaacggagggaagaagttcctgagctacttccggtgttgtatcaaggcctnaagaggtgctgctctagtgcctgcwgtccctg

SEQ ID NO: 4025 - protein, 110 aa, Zea mays
  misc_feature: Ceres CLONE 295517-F
  misc_feature (55)..(55): Xaa is any aa, unknown, or other
  misc_feature (65)..(65): Xaa is any aa, unknown, or other
  misc_feature (84)..(84): Xaa is any aa, unknown, or other
RDQSSVHGEPKGAAGTRRGGRQRWMTVPAFGDWDTKNGALPDYSMDFSKIREMRXRTRRSSPAPXRRRRRPPRPRPGPGPEAAXVNAPPKLGRPRPGPADDHSPTEGRSS

SEQ ID NO: 4026 - DNA, 484 bp, Zea mays
  misc_feature: Ceres CLONE 295569-F
  misc_feature: Encodes the peptide sequence at SEQ ID NO. 4027
  misc_feature (195)..(195): n is a, c, t, g, unknown, or other
  misc_feature (196)..(196): n is a, c, t, g, unknown, or other
  misc_feature (415)..(415): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagnatggcgacggaggcgtccctgtcgtgcgtccgctcgtggggcggcgcgctctcgtccatcacccacctc

SEQ ID NO: 4027 - protein, 56 aa, Zea mays
  misc_feature: Ceres CLONE 295569-F
  misc_feature: SWISSPROT Homolog: EC 2.3.1.156 Phloroisovalerophenone synthase
  misc_feature (33)..(33): Xaa is any aa, unknown, or other
MSDEILKNYPELAQEGLPTMNQRLDISNAAVTXMATEASLSCVRSWGGALSSITHL

SEQ ID NO: 4028 - DNA, 167 bp, Zea mays
  misc_feature: Ceres CLONE 295580-F
  misc_feature: Encodes the peptide sequence at SEQ ID NO. 4029
  misc_feature (119)..(119): n is a, c, t, g, unknown, or other
atcgcagaaattctccgcaacttcacagcgtatcatcgttttccatcgctcctactcctatcatccagaaaatctgagcggtattgatggcgcccaaggsgagaagaagccggcggsanagaaggtggcggaggaggagcctcggagaaggcggctccggcggagaa

SEQ ID NO: 4029 - protein, 55 aa, Zea mays
  misc_feature: Ceres CLONE 295580-F
  misc_feature (39)..(39): Xaa is any aa, unknown, or other
  misc_feature (40)..(40): Xaa is any aa, unknown, or other
SQKFSATSQRIIVFHRSYSYHPENLSGIDGAQGEKKPAXXKVAEEEPRRRRLRRR

SEQ ID NO: 4030 - DNA, 486 bp, Zea mays
  misc_feature: Ceres CLONE 295592-F
  misc_feature: Encodes the peptide sequence at SEQ ID NO. 4031
  misc_feature (110)..(110): n is a, c, t, g, unknown, or other
  misc_feature (421)..(421): n is a, c, t, g, unknown, or other
ctctgccaacaaacaaagaacagacctatcgctacacagtccgccgtggctctctgcaattaatggcttgccttccacagcgtcgtcgtcatactctgccggtgtaagcnccgcctgctgtgtgtctccgcgccatggcagcagcttcgtcaagccgcagcgctctggacggccggcggcggcggcggcgaccctacctgcgtcaggcggcgaccagcsaacctatcgttagactgctgtcgtaggagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagcatagctgtagcacttggcggasaggggtncaaggtggttgtgaactatgccaagtcaggcgtggaggccgaagaggttgcagagagatcgaggc

SEQ ID NO: 4031 - protein, 29 aa, Zea mays
  misc_feature: Ceres CLONE 295592-F
MDAGGWAARLEAPPPVAVVTGASRGIGRA

SEQ ID NO: 4032 - DNA, 468 bp, Zea mays
  misc_feature: Ceres CLONE 295609-F
  misc_feature: Translation starting site: 92
acaacagccctacaacttactgcttgctctagctagctagctgctcccggcccatatccactacacaagtaggctagcagcagcagcagcaatggcctcggtgacgrttcccggccgtggcctcgtcctgctgctcgccgccagcgccttcctggccagcgaggtggcggcgtgcggcggctgccgawaccaactcctcctcctccatcgccaccaccgccgtcgcccaccagcacgccgtscctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgcgacctggaggccgccgtctgcctctgcaccgcgctcaaggccaacgtgctcggcatcaacctcgacgtccccgtcaagctcacc

SEQ ID NO: 4033 - DNA, 113 bp, Zea mays
  misc_feature: Ceres CLONE 295614-F
acacgcacaccgcgacccagtccagagccagtacgtgcgamggcacgcacgctgctggtccgcgtacsagacgacggtcaggtcggccggtgcttttcagtttggaataatga

SEQ ID NO: 4034 - DNA, 130 bp, Zea mays
  misc_feature: Ceres CLONE 295641-F
  misc_feature (49)..(49): n is a, c, t, g, unknown, or other
gcgaacccacgaaggcacgaacggtagaacccgaccgagcgcggcavanaacctccgatccctgctgcgagcaagggatggcggcggcatgggcagtgctggcggcggtcctcgtcgcggcgcaggtggc

SEQ ID NO: 4035 - DNA, 493 bp, Zea mays
  misc_feature: Ceres CLONE 295683-F
  misc_feature: Translation starting site: 302
aaaacctctcctggcacgagatcacgcttctcgttggatcgaacagctagggtttccaagatgttcgggcgcgcgcgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttrtacaatggcacatcaaagaagctctctctgtccgca

SEQ ID NO: 4036 - DNA, 341 bp, Zea mays
  misc_feature: Ceres CLONE 295732-F
  misc_feature: SWISSPROT Homolog: EC 1.1.1.1 Alcohol dehydrogenase
  misc_feature (191)..(191): n is a, c, t, g, unknown, or other
  misc_feature (277)..(277): n is a, c, t, g, unknown, or other
acaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggargttgangtagcgcctccgcagccattgaggttcgcgtcaagatcctcttcacctcgctctkccacaccgacgtctacttcttggaggccaangggcacactcccgtgttccctcggatcttttkgccacaaggctytgaggtatcatakagagtgt

SEQ ID NO: 4037 - DNA, 488 bp, Zea mays
  misc_feature: Ceres CLONE 295733-F
  misc_feature: Encodes the peptide sequence at SEQ ID NO. 4038
ccctgttcctcctgtcatctcctcctcctcagaaacccaccaaccccgtccagccgccgsttctcggccgtcgccgccgccgccgccgccctatcccggtccttcaggtgaaccaggttggccatggcttcaacaagatcaaggtcgccaaccccatcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaaggagtttgcttgaaggctatgtggaagagcccaaatggcacaattaggaatattctgaatggcactgtgttcagagaaccaattcatctgcaaaaacatcccacggctt

SEQ ID NO: 4038 - protein, 129 aa, Zea mays
  misc_feature: Ceres CLONE 295733-F
  misc_feature: SWISSPROT Homolog: EC 1.1.1.42 Isocitrate dehydrogenase (NADP(+))
  misc_feature (20)..(20): Xaa is any aa, unknown, or other
LFLLSSPPPQKPTNPVQPPXLGRRRRRRRPIPVLQVNQVGHGFNKIKVANPIVEMDGDEMTRVFWKSIKDKLIFPFVDLDIKYFDLGLPHRDATDDKVTVEAAEATLKYNVAIKCATITPDEARVKEFA

SEQ ID NO: 4039 - DNA, 1403 bp, Zea mays
  misc_feature: Ceres CLONE 295767
  misc_feature: Encodes the peptide sequence at SEQ ID NO. 4040
ttggcctcaatccctgaagtgcctgccaccacgccgcgccgcgcccgcgatacaacgacttcctgcagtcctgcgctgcgcccctcctttccgcctccacgctgccgacgtccaccacacagcacggtcgagtcacccgatccctccatggcggcggcggtggcggcggtcgcggctgccacgacggcggaggacgaggcgcgcctgctgcgtctggaggagcaggcggagcacggcggcggcggcgcctgggactacctctgcctcgcccgccggctccgcgcccgccgccccgcccacgtcctccgcgtcggcctcgctctcctcaacaacgcctccgctcgctccggtctcgcctcagaacagtggacgctctacgagcaggtggccacggcggccatggattgccagcgtctcgatgtggcaaaggactgtattggagtcctttcaaagcaatttcctgacagcacccgggttgcccggctagaagctcttctgtttgaagcgaaaagtgaatgggctgaagctgaaagagcttacacacaaatcctggaaatcaatccatttgaccagattgtccacaagaggaaaattgctattgcaaaagcacaaggcaatatgtcgctagcgattggttatctcaataagtatctggaattatttatggcagatcatgatgcctggagagaacttgctgaaacatatgtttccttacaaatgtacaagcaagctgccttttgttatgaggagctaatattatcccaaccaactattccactctatcatatagcctatgctgaggttctgtacactatgggtggcttggaaaatcttcagacagctaagaagtactatgcatcaacaatccagttgactggaggcaagaatacaagagccctctttggtgtatgtctgtgtacttcggcaatcaatcagttgaccaaaggaaggaataaagaggaagagggctcggagctgcagagattggctgcagaagtactgctgaataattacaagcagcaggctccatcaaagggcgcccccttatcagcagcttgtttaaaagaacatgaaactcagctgataccaactagctctacacattcagaatgtcctgattcgatagatagttaagttaaattgatgtggcataatgcttgttttttttttgtggcactggcaccaacattgtgcaatggttaaaaagtaggtgctcccaatgccatgggttgtgtacactacacctgtttgcttgcagagaaatatgcatgacttctttttcattggatgttctattatagatcacaataaaccccggccattgtacttcagcacaaacaaaactttgaatcagtcgctggtgaagttgtacctgttgattttaaataaaaaaaaaaaaaaaa

SEQ ID NO: 4040 - protein, 328 aa, Zea mays
  misc_feature: Ceres CLONE 295767
MAAAVAAVAAATTAEDEARLLRLEEQAEHGGGGAWDYLCLARRLRARRPAHVLRVGLALLNNASARSGLASEQWTLYEQVATAAMDCQRLDVAKDCIGVLSKQFPDSTRVARLEALLFEAKSEWAEAERAYTQILEINPFDQIVHKRKIAIAKAQGNMSLAIGYLNKYLELFMADHDAWRELAETYVSLQMYKQAAFCYEELILSQPTIPLYHIAYAEVLYTMGGLENLQTAKKYYASTIQLTGGKNTRALFGVCLCTSAINQLTKGRNKEEEGSELQRLAAEVLLNNYKQQAPSKGAPLSAACLKEHETQLIPTSSTHSECPDSIDS

SEQ ID NO: 4041 - DNA, 480 bp, Zea mays
  misc_feature: Ceres CLONE 295776-F
  misc_feature: Encodes the peptide sequence at SEQ ID NO. 4042
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgcctgtcyygyagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggstccctgtcgtgcgtccgctcgtggggcggcgcgctctcgtccatcaccca

SEQ ID NO: 4042 - protein, 132 aa, Zea mays
  misc_feature: Ceres CLONE 295776-F
  misc_feature (10)..(132): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (35)..(35): Xaa is any aa, unknown, or other
  misc_feature (36)..(36): Xaa is any aa, unknown, or other
  misc_feature (38)..(38): Xaa is any aa, unknown, or other
  misc_feature (116)..(116): Xaa is any aa, unknown, or other
MVSSSMDTTSDKRASSMLAPNPGKATILALGHACXXAXVMQDYVVDGFMKNTNCDDPELKEKLTRLCKTTTVRTRYVVMSDEILKNYPELAQEGLPTMNQRLDISNAAVTRWRRRXPVVRPLVGRRALVHHP

SEQ ID NO: 4043 - DNA, 361 bp, Zea mays
  misc_feature: Ceres CLONE 295784-F
  misc_feature: Encodes the peptide sequence at SEQ ID NO. 4044
aagaaaaggaaggaagaagggcctcctgtctcacttccctcagtcctcgtccgtctctgctctccctcctctctctctctctacctagctagctagctagccttcctgtagcgcggcagatatggctgcctccaccacggcggcggcggcgctgctgctgctcctcctgtcgctcgccgcggcggcgacatgtcgatcgtgtcctacggggagcgcmstgatgggaggcgcggcggatttacgcggagtggatggcggcgcacggccggacctacaacgccgtcggagggagggagcggcggtaccaggtgttccgggacaacctccgctacatcgacgcgcacaacgccgccgccgacgc

SEQ ID NO: 4044 - protein, 36 aa, Zea mays
  misc_feature: Ceres CLONE 295784-F
  misc_feature: SWISSPROT Homolog: EC 3.4.22.14 Actinidain
MAAHGRTYNAVGGRERRYQVFRDNLRYIDAHNAAAD

SEQ ID NO: 4045 - DNA, 235 bp, Zea mays
  misc_feature: Ceres CLONE 295790-F
  misc_feature: Encodes the peptide sequence at SEQ ID NO. 4046
  misc_feature (177)..(177): n is a, c, t, g, unknown, or other
  misc_feature (179)..(179): n is a, c, t, g, unknown, or other
atccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgargncncaccgctgggtgcctcccaccccgccttacttcgagatgatcaaggaggctatcac

SEQ ID NO: 4046 - protein, 47 aa, Zea mays
  misc_feature: Ceres CLONE 295790-F
  misc_feature (28)..(28): Xaa is any aa, unknown, or other
  misc_feature (29)..(29): Xaa is any aa, unknown, or other
MPALAKPASRTAKPAAAPKPKPAAAKPXXHRWVPPTPPYFEMIKEAI

SEQ ID NO: 4047 - DNA, 460 bp, Zea mays
  misc_feature: Ceres CLONE 295816-F
  misc_feature: Translation starting site: 85
  misc_feature: SWISSPROT Homolog: EC 2.3.1.74 Naringenin-chalcone synthase
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttkgccacgccttcyctgcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggc

SEQ ID NO: 4048 - DNA, 172 bp, Zea mays
  misc_feature: Ceres CLONE 295831-F
aaatcgaaaaatggcgttgctgagcccgcgcgtgccgsctgccgccctccaccttcacctccgttgccggtgcccgatgctttggccctgccgcgaggtgccaggcgacggcggcgggcggcgtggcggccgcggggccccgtcgtcggagctggaggccatccggtggggc

SEQ ID NO: 4049 - DNA, 88 bp, Zea mays
  misc_feature: Ceres CLONE 295852-F
  misc_feature (63)..(63): n is a, c, t, g, unknown, or other
tccaacagaccaacagcatctaatcaatcaagacagccccgtgctagctcacccgccgggctngccacgatgagaggcctcctcgcgt

SEQ ID NO: 4050 - DNA, 437 bp, Zea mays
  misc_feature: Ceres CLONE 295866-F
  misc_feature: Translation starting site: 174
  misc_feature: SWISSPROT Homolog: EC 1.2.4.1 Pyruvate dehydrogenase (acetyl-transferring)
aacgaaccaaattcctctacggcccaccttcttcctacctgccattctcccatccaacacagcaggacgttcttccctcctcctccctcccgcttctatcgccgtcttcatttccaggacgcgtcgaattcctccatctaccgcgccggccgccgaggccgagggggaggaggatgctgggcgccgcgagaggcagcttggatccggtcccatgctgggacaggttttgcgaaggctccgccggcgcgcgggctgaggtggcgaggggctactccgctgcggcgaaggagatgactgtccgtgatgcattaactctgcactggatgaagagatgtctgctgatccttcagtttttctgatgggagaagaggttggagagtatcaaggtgcatacaagatttctaagggcttgcttgacaagtatggtcccgataggt

SEQ ID NO: 4051 - DNA, 219 bp, Zea mays
  misc_feature: Ceres CLONE 295876-F
  misc_feature: Encodes the peptide sequence at SEQ ID NO. 4052
  misc_feature (51)..(51): n is a, c, t, g, unknown, or other
  misc_feature (52)..(52): n is a, c, t, g, unknown, or other
  misc_feature (197)..(197): n is a, c, t, g, unknown, or other
agtttgccactctgtgagcctgctgcccgtcttcttccgccgccgccgccnncgtcttcgtccgtagcagagcagcagatcagagakcggggaggaagaaaaaccgatcgatggcgtccaactacgtggacacgacgggcgaggagggacggttccacggccctcacagccacagcaccagcacgaccccgacggwngcgcggcggcggcggcggcatc

SEQ ID NO: 4052 - protein, 36 aa, Zea mays
  misc_feature: Ceres CLONE 295876-F
  misc_feature (29)..(29): Xaa is any aa, unknown, or other
MASNYVDTTGEEGRFHGPHSHSTSTTPTXARRRRRH

SEQ ID NO: 4053 - DNA, 499 bp, Zea mays
  misc_feature: Ceres CLONE 295904-F
  misc_feature: Translation starting site: 201
  misc_feature: SWISSPROT Homolog: EC 2.3.1.74 Naringenin-chalcone synthase
  misc_feature: SWISSPROT Homolog: EC 2.3.1.156 Phloroisovalerophenone synthase
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttccygcagcanntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcga

SEQ ID NO: 4054 - DNA, 439 bp, Zea mays
  misc_feature: Ceres CLONE 295940-F
  misc_feature: Translation starting site: 85
  misc_feature: SWISSPROT Homolog: EC 2.4.1.207 Xyloglucan:xyloglucosyl transferase
  misc_feature (15)..(15): n is a, c, t, g, unknown, or other
  misc_feature (397)..(397): n is a, c, t, g, unknown, or other
  misc_feature (431)..(431): n is a, c, t, g, unknown, or other
  misc_feature (434)..(434): n is a, c, t, g, unknown, or other
accagctcgatcgcncggcagaagaggataagaggaagcgagtgctgggactgtgcgtgagttgggaagaaggagggggtggcaatggcgttgcggaatggtggtggtggcggastgtcccgcggcggttgtgctggtggctgcggccgtggcggcgctgctgggcgcggggtggcggcgaccaakttcgacgacgtggtgcagcccagctgggccaacgaccacgtggtgtacgacggckacctcctcaagctccgcctcgactccaactccggcggagggttcgtgtcaaggaccaatttcctgtacggcaaggccatckccgacctgaagctcgttcccgggttactccgccggcgtcgtcacggctttctatctgtcgtcggccggggacaancacaacgagttcgacttcgagttcctgggcaacntanacggg

SEQ ID NO: 4055 - DNA, 266 bp, Zea mays
  misc_feature: Ceres CLONE 295943-F
  misc_feature (111)..(111): n is a, c, t, g, unknown, or other
  misc_feature (149)..(149): n is a, c, t, g, unknown, or other
  misc_feature (163)..(163): n is a, c, t, g, unknown, or other
atttaccacaccctgctctcgctcttgttgtgacggtcgattcgcttgtacaagctagcaaccttkagatccagccaagatccagccatkagggagattctccacatccanggtggacagtgcggcaaccagatcggttccaagttctnggaggtcgtctkcnacgagcattgtatcgaccccaccggrcgctatgtcggcacctccgacctccagctcgagcgcgtcaatgtctactwcaacgaggcctcattcggcgcttcgtk

SEQ ID NO: 4056 - DNA, 449 bp, Zea mays
  misc_feature: Ceres CLONE 295964-F
  misc_feature: Encodes the peptide sequence at SEQ ID NO. 4057
  misc_feature (129)..(129): n is a, c, t, g, unknown, or other
awtcatcgagtcatccatctaaacatccgatccgaccatggcggcagacgcacttcggggccttctccccggcgtttacgctgccttgatggtaatcgccgtcacaagcgccgcctccagcgacgcgtncctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgcggggaaccgtgtccccggtcaagaaccttccagaattgtgccacaatcgtcaaagggcaacttcggtcgtgggtccctggaaatacagactacccat

SEQ ID NO: 4057 - protein, 63 aa, Zea mays
  misc_feature: Ceres CLONE 295964-F
MGKLDGFGAFSIPLSTDLHGADCVAQLHSAAGNRVPGQEPSRIVPQSSKGNFGRGSLEIQTTH

SEQ ID NO: 4058 - DNA, 138 bp, Zea mays
  misc_feature: Ceres CLONE 295979-F
  misc_feature (41)..(41): n is a, c, t, g, unknown, or other
  misc_feature (42)..(42): n is a, c, t, g, unknown, or other
aaccccaaacccacagcagtaacaggggcacactagctaanntaaacctcgccacggcacagcaatggcgccgctccccgcttccctcctgccctgcctctgstcttcctctgcctcctcgccgcgccgtgccccaca

SEQ ID NO: 4059 - DNA, 241 bp, Zea mays
  misc_feature: Ceres CLONE 295989-F
  misc_feature: Encodes the peptide sequence at SEQ ID NO. 4060
  misc_feature (227)..(227): n is a, c, t, g, unknown, or other
gcaaaaatctgggatctatctagaagcatcactcaacaaaccctaggttgcctgatcggttgatcgctccatggcgatcatctccgacttcaaggacgacgaggcaccggagcagcagctggcggccggccacgttcgaggtggccctcgtggcggcgttggagaggagcgcggcgcgctcccttcctacaggcggctatggatgtcgcccaccgcagtccggcctnttccgcgacccttc

SEQ ID NO: 4060 - protein, 57 aa, Zea mays
  misc_feature: Ceres CLONE 295989-F
  misc_feature (53)..(53): Xaa is any aa, unknown, or other
MAIISDFKDDEAPEQQLAAGHVRGGPRGGVGEERGALPSYRRLWMSPTAVRPXPRPF

SEQ ID NO: 4061 - DNA, 259 bp, Zea mays
  misc_feature: Ceres CLONE 296033-F
  misc_feature: Encodes the peptide sequence at SEQ ID NO. 4062
  misc_feature (109)..(109): n is a, c, t, g, unknown, or other
acaacaccagaatccgcgaatcacagacgcgtctatctcagcttgctgcactgcactaccctgccctgccatcatatcgtacgtgagcccggccgagcgagasmgggangaggcatggctgctccgaagctcgcgacgctggcgctggccgtgctcctggcggcgaccgtggtggctcccccggccgcggtgcgcgcgsgaattgtcgtgctccaccgtgtacagcacgctgatgccgtgcctgccgttcgtccagatg

SEQ ID NO: 4062 - protein, 48 aa, Zea mays
  misc_feature: Ceres CLONE 296033-F
  misc_feature (29)..(29): Xaa is any aa, unknown, or other
MAAPKLATLALAVLLAATVVAPPAAVRAXIVVLHRVQHADAVPAVRPD

SEQ ID NO: 4063 - DNA, 252 bp, Zea mays
  misc_feature: Ceres CLONE 296042-F
ctgcccaactgcccgctgaaaaacaaactcaccaacaaagtgacctgaaactgggagcaagcaaccgagggcgagagcatggcgamtcgcagcggccggcggcggctcctggacttagaggggcactacgccttttacggcgcctaccacagcaaccccgtcaacgtgggcatccasagctcttcgtgtggcccatcttcctcaccgcgctcatgctcctccacctcaccgccccctccacgcacgccgccg

SEQ ID NO: 4064 - DNA, 486 bp, Zea mays
  misc_feature: Ceres CLONE 296045-F
  misc_feature: Encodes the peptide sequence at SEQ ID NO. 4065
agaaaccctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaagggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaaaaaaaaa

SEQ ID NO: 4065 - protein, 56 aa, Zea mays
  misc_feature: Ceres CLONE 296045-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSREGQQEEWRG

SEQ ID NO: 4066 - DNA, 209 bp, Zea mays
  misc_feature: Ceres CLONE 296056-F
gtgccctcggtgctactgacggttgctctagatccgttcatcctggtggttttgtgaggtcgaaagcggcgagcgaattagaagatgctggacaagctgtgggacgacgtggtggccgggcctcgccsasgacggcytcgagaagctccgcaaggccaccaccgcccgtccgctcgtcatcaacaaagacgcggacggcggcactacaa

SEQ ID NO: 4067 - DNA, 122 bp, Zea mays
  misc_feature: Ceres CLONE 296057-F
acacgccacaccgcgacccagtccagagccagtacgtgcgamggccacgcacgctgctggtccgcgtacsagacgacggtcaggtcggccggtgcttttcagtttggaataatgacggcgac

SEQ ID NO: 4068 - DNA, 380 bp, Zea mays
  misc_feature: Ceres CLONE 296061-F
  misc_feature: Encodes the peptide sequence at SEQ ID NO. 4069
  misc_feature (106)..(106): n is a, c, t, g, unknown, or other
  misc_feature (110)..(110): n is a, c, t, g, unknown, or other
  misc_feature (233)..(233): n is a, c, t, g, unknown, or other
  misc_feature (238)..(238): n is a, c, t, g, unknown, or other
atcaaaccctcacagcgaaggacacaaaaacacaggtagggttaggcgacgcggcggcgagagcgcgagagtatgaggaggcgtcggccatgacggggaaggcganswangaagcacacggcgaaggagatcgccgcgaagatcgacgcggcacgacgaaccggggcggcggcaaggtcgggcaggcggatcggctagggcaggacaagggcgggcacskaastggcgtsccnccttncccgcaccccggcgcccgacatcaagtccatgcagatccaccacgaggcgcgccatcccaagctccctttcgagccggagaagctcgtcaacctgcactcctccacccccgccgccgccgaggccaccacctccaagcccaa

SEQ ID NO: 4069 - protein, 37 aa, Zea mays
  misc_feature: Ceres CLONE 296061-F
MQIHHEARHPKLPFEPEKLVNLHSSTPAAAEATTSKP

SEQ ID NO: 4070 - DNA, 442 bp, Zea mays
  misc_feature: Ceres CLONE 296097-F
  misc_feature (361)..(361): n is a, c, t, g, unknown, or other
gtcaagcttttccaaggaacctagctagctagctagtaagaggcacaggccgcaccatgtcgcaccaccattcccaccacaaatctcattctcacaaccgtacccaccaccactctcactckvactccggagrgtggaggaggcggcggcggtggcggcggcggtggaggcggaggcggagtggctaaatgccactgtgattgctcacaccatgatcattcaccgccaaggcaaccgttcttcccgtcaccgcagcttccaccaccacaaatctttcttccaggaccaccgctccctccgcctgggccgctcccatttccgccaccgatattcttcggacctccgccgccgccacccccgnccccgcctccgttcatgtgcccacgaccgccaccatgcatgtaccggagtggttaatggagataaaagttgatatacatgg

SEQ ID NO: 4071 - DNA, 487 bp, Zea mays
  misc_feature: Ceres CLONE 296115-F
  misc_feature: Encodes the peptide sequence at SEQ ID NO. 4072
aactctgaaggcgctacagcaacgtcgccacttcactcacgattggagtttcacctcggcagcccagccagccagtggttcctcggctcggaggaacagcaagagcttctgaagatgaaggcgatccccgtggctctcctgctcctcgtcctggttgctgccgcctcctcgttcaagcatctcgccgaggcagcagacggcggcgcggtgccggacgsgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgaatgcccctgctacagggacatgaagtcccccaagaaccagcgccccaagtgcccctaggccctaccgctctaagggagggaggatgacccaggatttcgctcgcgatcctgcacagcttctactactaatttagcgcgcga

SEQ ID NO: 4072 - protein, 43 aa, Zea mays
  misc_feature: Ceres CLONE 296115-F
MGLCMMCCGKCQGCVPSGPYASKDECPCYRDMKSPKNQRPKCP

SEQ ID NO: 4073 - DNA, 473 bp, Zea mays
  misc_feature: Ceres CLONE 296160-F
  misc_feature: Translation starting site: 241
aaccgagacaccgcgtgcgaaccaagcagaccacaacaagaagaagcgtagtcgtcgccggaaggaaaggcgcggacaaatgtcgtggcaggcgtacgtcgacgagcacctgatgtgcgagatcgaaggacagcatctcagcgccgccgccatcgtcggtcacgacaagcgtttgggcgcagtccgagagcttccccgagttaaagcctgaggaggttgctggtatcataaaggactttgatgaacctggtactcttgcaccaactggtcttttcgttggaggtacaaagtacattggtgatccaaggtgaacctggagttgtcatccgaggaaagaagggcactgggggcattactatcaagaaaaccggcatgtccttgattattggtgtctacgacgagccaatgactccagggcaatgcaaacatggtggttggagaggctcggcgattactgatcgaccagggcttct

SEQ ID NO: 4074 - DNA, 438 bp, Zea mays
  misc_feature: Ceres CLONE 296213-F
  misc_feature: Encodes the peptide sequence at SEQ ID NO. 4075
  misc_feature (106)..(106): n is a, c, t, g, unknown, or other
ctcctcgacgcgtctcttccacagccgcaacctctatccctcgtctggtatcgtctcccacacccctctgccccaactcagaaaaaccctcgaaaagcggcggcgncgcgacatggcggaggtcgaggctccagctgctgcggttgcggcggcgacccctgaggtggcgacggtgaccgagggcggasgctacggaggcgaagggtccgcacaagctgcaccgccagtggaccttctggtacgacatccagtccaagcccaaacccggcgctgcgtggggcactccctcaaaaaggcktacaccttcgacaccgtcgaggagttttggggcttgtatgatcatgttttccgtccaagcaagttgcctgggactgctgattttcacctattcaaggctggagtagagccaaaatgggaagaccagagtgtgcaaatggt

SEQ ID NO: 4075 - protein, 108 aa, Zea mays
  misc_feature: Ceres CLONE 296213-F
  misc_feature (6)..(106): Pfam Name: IF4E Pfam Description: Eukaryotic initiation factor 4E
  misc_feature (26)..(26): Xaa is any aa, unknown, or other
MAEVEAPAAAVAAATPEVATVTEGGXYGGEGSAQAAPPVDLLVRHPVQAQTRRCVGHSLKKAYTFDTVEEFWGLYDHVFRPSKLPGTADFHLFKAGVEPKWEDQSVQM

SEQ ID NO: 4076 - DNA, 435 bp, Zea mays
  misc_feature: Ceres CLONE 296219-F
  misc_feature: Translation starting site: 90
  misc_feature (253)..(253): n is a, c, t, g, unknown, or other
  misc_feature (351)..(351): n is a, c, t, g, unknown, or other
  misc_feature (359)..(359): n is a, c, t, g, unknown, or other
  misc_feature (402)..(402): n is a, c, t, g, unknown, or other
  misc_feature (430)..(430): n is a, c, t, g, unknown, or other
atcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggsgcnaccctccctacgctgagatgattgtagaggcgatcgctgccctcaaggagaggaaggggtcgagctcggtggccatcagcaagtacgtcgaggggaancacggcgncaagctccccaccaacttccgcaagcagctcaccgtgcagctnaagaagctcgctgccgccggcaaaactnacgag

SEQ ID NO: 4077 - DNA, 349 bp, Zea mays
  misc_feature: Ceres CLONE 296226-F
  misc_feature: Encodes the peptide sequence at SEQ ID NO. 4078
  misc_feature (129)..(129): n is a, c, t, g, unknown, or other
  misc_feature (289)..(289): n is a, c, t, g, unknown, or other
gaggaaggaaccctagcctagccttgctccgaccggtcgccgcggcgattgcgacgatgatggactgcgctggaggccgagaccccgtggaggacttcctcctcggcggcgcggtcgcggcgacgasgnagaatctcgtcgccgtcttctgcgacgacggaggacttgggattgagggtatccatggagatgcttgtggatttgagcaatctagtttggggaaaagggggtagagatgaaccatgtthcatctgggcccaacatccaaagcttgccgtgaaaaawawtnaggagggacaagctgaatgacaggtttcctggaattaagttcaattatgaatcctggtaa

SEQ ID NO: 4078 - protein, 58 aa, Zea mays
  misc_feature: Ceres CLONE 296226-F
  misc_feature (24)..(24): Xaa is any aa, unknown, or other
  misc_feature (25)..(25): Xaa is any aa, unknown, or other
MMDCAGGRDPVEDFLLGGAVAATXXNLVAVFCDDGGLGIEGIHGDACGFEQSSLGKRG

SEQ ID NO: 4079 - DNA, 216 bp, Zea mays
  misc_feature: Ceres CLONE 296235-F
  misc_feature: Encodes the peptide sequence at SEQ ID NO. 4080
  misc_feature (40)..(40): n is a, c, t, g, unknown, or other
  misc_feature (121)..(121): n is a, c, t, g, unknown, or other
  misc_feature (122)..(122): n is a, c, t, g, unknown, or other
acaaagctagcttatttcccttcccttcacgcggcaasgncggccggccttccgccgccatggccaccaccaccgctcccgtcctcctcgtcttcctcgttgccattgctcacgtccgtcnnccctcaccattccccatcctgacgatggcggcggacgcggacaacggcaccacccacctgagcttcttcatgcacgacatcacgtcgggcgcca

SEQ ID NO: 4080 - protein, 52 aa, Zea mays
  misc_feature: Ceres CLONE 296235-F
  misc_feature (21)..(21): Xaa is any aa, unknown, or other
MATTTAPVLLVFLVAIAHVRXPSPFPILTMAADADNGTTHLSFFMHDITSGA

SEQ ID NO: 4081 - DNA, 361 bp, Zea mays
  misc_feature: Ceres CLONE 296252-F
  misc_feature: Encodes the peptide sequence at SEQ ID NO. 4082
  misc_feature (212)..(212): n is a, c, t, g, unknown, or other
gagtgggagggatcatggtggcgccggacgtgaaggcggagacgattgaagctgatggatcagcggggtgccctagaggcggagatggacgccatcatcgcccgcctcactgcggcaggcggaccgggcatcaccggagcctcgtcgacgccgagggtttcccaaggtccgacatcgacatcccgaacgtcctcgcccagcgccggastttnctgaattgcgaaatgaccacaaggatgttacaaacaaaattggtaaaaatcttgaggtttttacactcagcaaagttatcaaggaatgaacaatcaaccttcaaggagatctggatacaacagatccttcacactttggatcatctcaa

SEQ ID NO: 4082 - protein, 115 aa, Zea mays
  misc_feature: Ceres CLONE 296252-F
  misc_feature (65)..(65): Xaa is any aa, unknown, or other
  misc_feature (66)..(66): Xaa is any aa, unknown, or other
MVAPDVKAETIEADGSAGCPRGGDGRHHRPPHCGRRTGHHRSLVDAEGFPRSDIDIPNVLAQRRXXLNCEMTTRMLQTKLVKILRFLHSAKLSRNEQSTFKEIWIQQILHTLDHL

SEQ ID NO: 4083 - DNA, 406 bp, Zea mays
  misc_feature: Ceres CLONE 296297-F
  misc_feature: Encodes the peptide sequence at SEQ ID NO. 4084
  misc_feature (76)..(76): n is a, c, t, g, unknown, or other
  misc_feature (157)..(157): n is a, c, t, g, unknown, or other
  misc_feature (158)..(158): n is a, c, t, g, unknown, or other
  misc_feature (191)..(191): n is a, c, t, g, unknown, or other
  misc_feature (348)..(348): n is a, c, t, g, unknown, or other
acacaaaaacccagcatcagtcaagctcgctcacacgaccatggccgcggcgatgaccggcagtactcgcgccagncggctccttcctcgtgcttctytttgtcgtgttggccggtgtcgtcgacgtcgcgtccgctgccaccactgckgckagtgnnactgttgccactaacagcggtgacagcaacsgncggcgcttctgacgatgccggcgtcgggtccacggggcagctgaatggcatcatccagtgcctgctgggctgcttcacgcaggtgttcagctgctcgttcgggtgtatgggaaatcagggcgccgacctgccgctctgcatcatcggctgcgaccanaggagcgtcgtttgtatgatccgctgcgggctcgcgccgtcgccgcccacgccctcgc

SEQ ID NO: 4084 - protein, 135 aa, Zea mays
  misc_feature: Ceres CLONE 296297-F
  misc_feature (26)..(26): Xaa is any aa, unknown, or other
  misc_feature (33)..(33): Xaa is any aa, unknown, or other
  misc_feature (50)..(50): Xaa is any aa, unknown, or other
  misc_feature (51)..(51): Xaa is any aa, unknown, or other
  misc_feature (53)..(53): Xaa is any aa, unknown, or other
  misc_feature (64)..(64): Xaa is any aa, unknown, or other
  misc_feature (116)..(116): Xaa is any aa, unknown, or other
TQKPSISQARSHDHGRGDDRQYSRQXAPSSCFXLSCWPVSSTSRPLPPLXXVXLLPLTAVTATXGASDDAGVGSTGQLNGIIQCLLGCFTQVFSCSFGCMGNQGADLPLCIIGCDXRSVVCMIRCGLAPSPPTPS

SEQ ID NO: 4085 - DNA, 429 bp, Zea mays
  misc_feature: Ceres CLONE 296321-F
  misc_feature: Encodes the peptide sequence at SEQ ID NO. 4086
  misc_feature (75)..(75): n is a, c, t, g, unknown, or other
  misc_feature (95)..(95): n is a, c, t, g, unknown, or other
  misc_feature (269)..(269): n is a, c, t, g, unknown, or other
aagatccacacctgcagctgccacagcgggtggtgcttagcttaggctagcctagctgcgcctgcbatgctcgtnaccaatggcgtccagcaagnhgccactgttcctcgtcctcaacctcctgctcttcgcggcggccaacgctgcycttactgcccgggcaacaatggccacggtagcagcgggcaccatggcggcagtgggcatggcggcggtggcaccggcggttccggtggcggcagcgggccaggtgggggcagcagcggcgnagggtacggtccgatcggtggtggtggtggcagcggcggcggtaggagggtacggtccgatcggtgatggtggcagcggcggtgggatcggacccatcggaggcggcacggggggatcggacccataggaggtggcagcggtggtgggtacggccccatc

SEQ ID NO: 4086 - protein, 105 aa, Zea mays
  misc_feature: Ceres CLONE 296321-F
  misc_feature (6)..(6): Xaa is any aa, unknown, or other
  misc_feature (64)..(64): Xaa is any aa, unknown, or other
MASSKXPLFLVLNLLLFAAANAALTARATMATVAAGTMAAVGMAAVAPAVPVAAAGQVGAAAAXGTVRSVVVVAAAAVGGYGPIGDGGSGGGIGPIGGGTGGSDP

SEQ ID NO: 4087 - DNA, 318 bp, Zea mays
  misc_feature: Ceres CLONE 296328-F
  misc_feature: Encodes the peptide sequence at SEQ ID NO. 4088
  misc_feature (131)..(131): n is a, c, t, g, unknown, or other
  misc_feature (133)..(133): n is a, c, t, g, unknown, or other
  misc_feature (227)..(227): n is a, c, t, g, unknown, or other
aacaacaacaacaacccgcacaacggcacgattctcctcctccgtccgcgtmtctcggtttcggcgatgtcggggcgcggcaagggcggcaaggggctgggcaagggcggcgcaagcgcayccgcaagtcntngcgcgacaacatccagggcatcacgaagccggcgatccgtagctggccaggaggggcggcgtcaascgcattttctgggctcatctacgagganacccgcggcgtgctcaagatcttcctcgagaacgtcatccgcgacgccgtcacctacaccgagcacgcccgccgcaagaccgtcaccgcca

SEQ ID NO: 4088 - protein, 105 aa, Zea mays
  misc_feature: Ceres CLONE 296328-F
  misc_feature (17)..(17): Xaa is any aa, unknown, or other
  misc_feature (40)..(40): Xaa is any aa, unknown, or other
  misc_feature (44)..(44): Xaa is any aa, unknown, or other
  misc_feature (66)..(66): Xaa is any aa, unknown, or other
  misc_feature (75)..(75): Xaa is any aa, unknown, or other
QQQQPAQRHDSPPPSAXLGFGDVGARQGRQGAGQGRRKRXRKSXRDNIQGITKPAIRSWPGGAASXAFSGLIYEXTRGVLKIFLENVIRDAVTYTEHARRKTVTA

SEQ ID NO: 4089 - DNA, 313 bp, Zea mays
  misc_feature: Ceres CLONE 296339-F
  misc_feature: Encodes the peptide sequence at SEQ ID NO. 4090
  misc_feature (116)..(116): n is a, c, t, g, unknown, or other
  misc_feature (241)..(241): n is a, c, t, g, unknown, or other
aaaacccacgtttcaaaaaaaagagaggaaagcaaagttccttcttccctcgaaaaaaaaaatcagtctcgccatggagagcagcgttggcatagagaaggccgcagcggtggcgnttggtgcaggtgtgggcgggggaggtggagggtacggctgcggcgggtgggagacgccgaagcgcgaggagtgccgcatcccggcgacgctgccgtgccccgcggcgccgaggaaggccgtgcgnacttcgggaagcggcgcasgcccaagaacggctacttccagccgccgacctggaggcgctcttcgcgctcgc

SEQ ID NO: 4090 - protein, 80 aa, Zea mays
  misc_feature: Ceres CLONE 296339-F
  misc_feature (15)..(15): Xaa is any aa, unknown, or other
  misc_feature (63)..(63): Xaa is any aa, unknown, or other
MESSVGIEKAAAVAXGAGVGGGGGGYGCGGWETPKREECRIPATLPCPAAPRKAVRTSGSGAXPRTATSSRRPGGALRAR

SEQ ID NO: 4091 - DNA, 98 bp, Zea mays; identical to SEQ ID NO: 3744
  misc_feature: Ceres CLONE 296357-F

SEQ ID NO: 4092 - DNA, 302 bp, Zea mays
  misc_feature: Ceres CLONE 296368-F
  misc_feature (233)..(233): n is a, c, t, g, unknown, or other
atacaagtgtcacgtccccggtccctcgcgaaccctagagccgcagcagcacactcccgcagtagcagcagccgccgccgccgccgcccagccgcagaaacaggaggaagatgccggcggggcacgggcttcggtcgcggacccgssatgtttcgcgcggccgttccgcaagaagggttacatcccgctcaccacgtacctgcgcacctacaagatcggcgactacgtsactncaaggtgaacggcgccgtgcacaagggcatgccgcacaagttctaccacggccgcaccgggtcgcgtct

SEQ ID NO: 4093 - DNA, 471 bp, Zea mays
  misc_feature: Ceres CLONE 296376-F
  misc_feature: Encodes the peptide sequence at SEQ ID NO. 4094
  misc_feature (267)..(267): n is a, c, t, g, unknown, or other
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtngcttgctgaggactgtgaccagccagattatgtcaagctggtgaaggcactctgcgcggasacaatgttcacctggtcacttgttcctgccgctaagacccttggcgagtgggctgggctttgcaagattgactctgagggcaaggcaaggaagggttgtaggctgctccctgtgtcgtcgtcaaggactacggtgaagaatct

SEQ ID NO: 4094 - protein, 97 aa, Zea mays
  misc_feature: Ceres CLONE 296376-F
  misc_feature (30)..(30): Xaa is any aa, unknown, or other
  misc_feature (50)..(50): Xaa is any aa, unknown, or other
MKKSSAHDGLVKGLRELPRPSRSTPLSFAXLAEDCDQPDYVKLVKALCAXTMFTWSLVPAAKTLGEWAGLCKIDSEGKARKGCRLLPVSSSRTTVKN

SEQ ID NO: 4095 - DNA, 427 bp, Zea mays
  misc_feature: Ceres CLONE 296377-F
  misc_feature: Translation starting site: 93
aacaacagccctacaacttactgcttgctctagctagctagctgctcccggcccatatccactacacaagtaggctagcagcagcagcagcaatggcctcggtgacgagttcccggccgtggcctcgtcctgctgctcgccgccagcgccttcctggccagcgaggtggcggcgtgcggcggctgcccgaaaccaactcctcctcctccatcgccaccaccgccgtcgcccaccagcatgccgtgccctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgcsacctggaggccgccgtctgcctctgcaccgcgctcaag

SEQ ID NO: 4096 - DNA, 115 bp, Zea mays
  misc_feature: Ceres CLONE 296406-F
acacgcacaccgcgacccagtccagagccagtacgtgcgamggcacgcacgctgctggtccgcgtacsagacgacggtcaggtcggccggtgcttttcagtttggaataatgacg

SEQ ID NO: 4097 - DNA, 174 bp, Zea mays
  misc_feature: Ceres CLONE 296426-F
  misc_feature: Encodes the peptide sequence at SEQ ID NO. 4098
actgcaggaggactcgcacagatcggtgagcgagcaagcgagagatggctgggaggctaaccgcggcagggtcccgcatcctgggcggcggcggcgcacsksgcctttccgccctccgacaccgcgccggcatgggcctccccgtcggccgccacatcgtccccgacaagcccc

SEQ ID NO: 4098 - protein, 43 aa, Zea mays
  misc_feature: Ceres CLONE 296426-F
  misc_feature (19)..(19): Xaa is any aa, unknown, or other
  misc_feature (20)..(20): Xaa is any aa, unknown, or other
MAGRLTAAGSRILGGGGAXXLSALRHRAGMGLPVGRHIVPDKP

SEQ ID NO: 4099 - DNA, 401 bp, Zea mays
  misc_feature: Ceres CLONE 296445-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaaktcaagtgctcatgatggacttstgaagggtctccgtgagctgccaakgccatcgagaagcacgccgctcagctttgcgtgcttgctgaggactgtgaccagccagattatgtcaagctggtgaaggcactctgcgcggasacaatgttcacctggtcactgttcctgccgctaagacccttsgcgagtgggctgggctytgcaagattgactct

SEQ ID NO: 4100 - DNA, 344 bp, Zea mays
  misc_feature: Ceres CLONE 296449-F
  misc_feature: Encodes the peptide sequence at SEQ ID NO. 4101
  misc_feature (229)..(229): n is a, c, t, g, unknown, or other
  misc_feature (234)..(234): n is a, c, t, g, unknown, or other
actcatacatttcgactctcaactcccaaggtcccttttttttctcgatctggaagcgccgcagtagcagccatggacgtgagcggacaggcgggaaggcgaagaagggcgcggccgggcgcaaggccggcgggcgaccgaagaagtcggtgtcgcggtcctccagggccgggctgcagttccccgtcagccgcgtcgggcgtacctcaaaaagggccggtacgcgcangttanggcacgggtgccccgtctacctcgccgccgtcctggagtacctcgcggccgaggtgctcgagctcgccggcaacgcggcaagggacaacaagaagacgcgcatcatcccg

SEQ ID NO: 4101 - protein, 114 aa, Zea mays
  misc_feature: Ceres CLONE 296449-F
  misc_feature (52)..(114): Pfam Name: Histone Pfam Description: Core histone H2A/H2B/H3/H4
  misc_feature (76)..(76): Xaa is any aa, unknown, or other
  misc_feature (78)..(78): Xaa is any aa, unknown, or other
SYISTLNSQGPFFFSIWKRRSSSHGRERTGGKAKKGAAGRKAGGRPKKSVSRSSRAGLQFPVSRVGRTSKRAGTRXLXHGCPVYLAAVLEYLAAEVLELAGNAARDNKKTRIIP

SEQ ID NO: 4102 - DNA, 469 bp, Zea mays
  misc_feature: Ceres CLONE 296451-F
  misc_feature: Translation starting site: 255
  misc_feature: SWISSPROT Homolog: EC 1.11.1.11 L-ascorbate peroxidase
  misc_feature (34)..(34): n is a, c, t, g, unknown, or other
  misc_feature (79)..(79): n is a, c, t, g, unknown, or other
  misc_feature (384)..(384): n is a, c, t, g, unknown, or other
  misc_feature (411)..(411): n is a, c, t, g, unknown, or other
  misc_feature (436)..(436): n is a, c, t, g, unknown, or other
agcagatcttgtgaccctccctcagccgcgtcgntcgcatcctacgatccaaagctctctctggtcgcaggtcgcakbnatggcgaagaactacccgaccgtgagcgccgagtacagcgaggctgtggacaaggccaggcgcaactccgagccctcatcgccgagaagagctgcgccccgctcatgctccgcctcgcgtggcactccgcggggacgttcgacgtgtcgtcaggaccggcggtcaattcggcacgatgaagcatcagtcggaattggctcacggcgctaacgcggggctggacatcgcggtgcggctgctcgagcccatcaaggaggagttcccaatcctctcttacgccgatttctaccagctcgcgggagttntggccgtggaggtcaccggttggcctnagattcccttccaccccggtaggangacaagcctcagcccccacctgagggccgcctt

SEQ ID NO: 4103 - DNA, 938 bp, Zea mays
  misc_feature: Ceres CLONE 296462
  misc_feature: Encodes the peptide sequence at SEQ ID NO. 4104
attccaacaacagcacagcagagcaagagcgcaccagcacgacacagccaagctccactccaccgacacgctgcgctcgagcccgccggcgagatccatggcgcggctgctcccgacggccgcggcagcggccatcgtggccgccgtcctggtggcgggcctgccgggcgcccgggcggcgtctgcctcgccggcggcggacgacgcgccgccgtacaggaaccacaccgttggcggcggcgacgggtggttcttcgacgccaacaccaacgcctcgtccgggaactactccgactgggccgccggcgagaccttctacctcggtgactacctcattttcaagacgaacgacaactcgtcggtggtgcagaccaccaacgccacgacatacgggctctgcgacgccagcgacgacctggcggagacgacgtccatctacggcggcggcggcggcgggggcggcggcctcgagcagaacagcaccatcgcggtggcgctcaccgccgagggcgccaactacttcttctccgaggccgacgggggcgcgcagtgccagcaggggatgcggttcgagatcaaggtcgagcacggccggggcctgccgccgtcgctactgcaccagccgccggcgcccaagggccgcgtcctcgcgccgccgccggcgggcacggcgttctcgggcaccggcggggtcgagcccggcgacggcgccggggacaacggcggcgctggcacgagcggcgcgtgcagggcggccagcggccggttcttgggggtggtggctgctgctgctgcggctctggccgttttggttctttgagtagcgatggtttaaaggcattcgtcatttggaaccactgttctgcttatgtatgtgtctgtatttaaattcatcatttaatggagatttgtgttcgatgccaaaaaaaaaaaaaaaa

SEQ ID NO: 4104 - protein, 240 aa, Zea mays
  misc_feature: Ceres CLONE 296462
  misc_feature (51)..(156): Pfam Name: Cu_bind_like Pfam Description: Plastocyanin-like domain
MARLLPTAAAAAIVAAVLVAGLPGARAASASPAADDAPPYRNHTVGGGDGWFFDANTNASSGNYSDWAAGETFYLGDYLIFKTNDNSSVVQTTNATTYGLCDASDDLAETTSIYGGGGGGGGGLEQNSTIAVALTAEGANYFFSEADGGAQCQQGMRFEIKVEHGRGLPPSLLHQPPAPKGRVLAPPPAGTAFSGTGGVEPGDGAGDNGGAGTSGACRAASGRFLGVVAAAAAALAVLVL

SEQ ID NO: 4105 - DNA, 425 bp, Zea mays
  misc_feature: Ceres CLONE 296498-F
  misc_feature: Encodes the peptide sequence at SEQ ID NO. 4106
  misc_feature (2)..(2): n is a, c, t, g, unknown, or other
  misc_feature (148)..(148): n is a, c, t, g, unknown, or other
  misc_feature (207)..(207): n is a, c, t, g, unknown, or other
  misc_feature (400)..(400): n is a, c, t, g, unknown, or other
anacaacgatctagctacttcctctctcaagcccataggtgttgtagaacaactcaactagtaatggcttccaagagcacaatgcgtccccttgtyctcatcatgatggggttgctgctgctctcgtgcagggcatcagcagcgcggncgcggctcctggaggaggtggcgcccaaggaggagtacccgcaccctgaagtgccaganctgcccaagcctgagctcccgccgcaccctacggtgccggaactccctaaacctgatgagctaccgccacatccggtcgtgccgagctgccaaagcccgaggtgccagtgcacccgccgtgccggagctgccgaagcccgagcttcctcctcaccccaccgtgcctgagctgccgaagcccgaggtgcccgcncacccgccgtgccggagctgccgaa

SEQ ID NO: 4106 - protein, 103 aa, Zea mays
  misc_feature: Ceres CLONE 296498-F
  misc_feature (29)..(29): Xaa is any aa, unknown, or other
  misc_feature (48)..(48): Xaa is any aa, unknown, or other
MASKSTMRPLVLIMMGLLLLSCRASAARXRLLEEVAPKEEYPHPEVPXLPKPELPPHPTVPELPKPDELPPHPVVPSCQSPRCQCTRRAGAAEARASSSPHRA

SEQ ID NO: 4107 - DNA, 437 bp, Zea mays
  misc_feature: Ceres CLONE 296559-F
  misc_feature: Encodes the peptide sequence at SEQ ID NO. 4108
  misc_feature (307)..(307): n is a, c, t, g, unknown, or other
  misc_feature (309)..(309): n is a, c, t, g, unknown, or other
  misc_feature (382)..(382): n is a, c, t, g, unknown, or other
acccatccacgtcttctcattcctcgacaattgagatccaggcacgacagctactggtgtctgtttttggcattctgatagcgataggtttcgccaatgccgcgctgggagagacagcaccgccggttgttgtcggcttggccaagtgctcggactgcgccaggaggaacatgaacgccgaggcagctttcagaggtcttcaggtggccatcaagtgcaagaacagcaagggggcctacgagagcgcascgtgggacaggtgaacaagtccggggccttcagcgtcccgctggccgccgacgccgtnanggaacggggagctcaagtcggaatgcttcgcgcagtcatccacagcgcgtcgagtgcgccgtgccccgggcangagccctccaggatcgtcgccgcgccacccggccacacggccacaccaacggcaa

SEQ ID NO: 4108 - protein, 86 aa, Zea mays
  misc_feature: Ceres CLONE 296559-F
  misc_feature (83)..(83): Xaa is any aa, unknown, or other
PSTSSHSSTIEIQARQLLVSVFGILIAIGFANAALGETAPPVVVGLAKCSDCARRNMNAEAAFRGLQVAIKCKNSKGAYESAXWDR

SEQ ID NO: 4109 - DNA, 899 bp, Zea mays
  misc_feature: Ceres CLONE 296567
  misc_feature: Encodes the peptide sequence at SEQ ID NO. 4110
atctagacccattgacgtgctcctccgatccaaacccaataagctagaagcccctctccggcgaggcgatgggcaccgccaaggcgaagcggaggcccgtcctgatctgttgcggggtgctggtggccgcgatcgccgtcctggccgtcgtgttcgtggcgctctacttcaccgtgtttcggccgcggtcgcccaaggtggtggcgacggcggtggtagcggacctgctccccaagggcgacggcggcggcgggcaggacctgaacctcaccgtgcacgtggacgtgaccgtgaacaaccccaactacgcggcgttccggtacggcgacgtggtgacgctggtgcggtaccacgggagcgacgtgggcatgtcggtggtgccggcgggggagatcgcgcgcgagacgctgaccgtcgccgccgcggtcgaggtggacacgctcaaggtggccgccaccccgtacttctacgtggagttccccacgggcaagctgccgttcgagacggccacggcggtggccggcgaggccgtggtgctgggcgcgttcaagatcagcgccagctcgcaggtggcgtgccaggtcaccgtgcacctgctgcctcccaacgccacgtcggagtgcacctccacggtccatataggccggtagtaacgggccggggggctatatatatctagtggttctgctctctctggacagatgttgtgcgcttgtgtgtacatcgaaatacgctctgatctgaaattgccaacgacgttattagtagcatacttgttatttcaacagttatagtagaggtatagcttctgcctttgcttaaatctataggtcccagatgacaaatgggtttaaattcaaaaataaaccgctgtactgttgtaaaaaaaaaaaaaaaaa

SEQ ID NO: 4110 - protein, 193 aa, Zea mays
  misc_feature: Ceres CLONE 296567
  misc_feature (34)..(170): Pfam Name: Hin1 Pfam Description: Harpin-induced protein 1 (Hin1)
MGTAKAKRRPVLICCGVLVAAIAVLAVVFVALYFTVFRPRSPKVVATAVVADLLPKGDGGGGQDLNLTVHVDVTVNNPNYAAFRYGDVVTLVRYHGSDVGMSVVPAGEIARETLTVAAAVEVDTLKVAATPYFYVEFPTGKLPFETATAVAGEAVVLGAFKISASSQVACQVTVHLLPPNATSECTSTVHIGR

SEQ ID NO: 4111 - DNA, 168 bp, Zea mays
  misc_feature: Ceres CLONE 296573-F
  misc_feature (82)..(82): n is a, c, t, g, unknown, or other
acggaacttccggtgccggcgggaccacttgtgcgatccatccctcaccatgtcgtcggagaaggaggcggcgctckcgggnccttcgatgacagcccaaccatatttgacaagatcatcaaaaaggaaatacctttctactgtggtttatgaggacgagaaggtact

SEQ ID NO: 4112 - DNA, 418 bp, Zea mays
  misc_feature: Ceres CLONE 296582-F
  misc_feature: Pfam Name: DSBA Pfam Description: DSBA-like thioredoxin domain
agtaattagtttgtgcccgtgtccgtgtttggttgaataataaattgacgaaagagggccaagtatagcttagagagagaagctagctagctgaaatggaggctagcagcgccgccgcgtctctcttgtgccactgctggtggtgatcatcgggtgctgtgcctgccgcgcccagatcccgatcccggcgaagasacgggttcgtgtacggcgggaagccsggccktggggcgagacggtggtggtagaggcgttcttggacccagtgtgccccgacagccgcgacgcgtggccggcgctcaagatggtcgtcgagcactatagctcacgcgtgtccgtcgtcgttcacctctttcccgctgccttaccacagctatgccttcattgcgtgccggtcaatttcatgcggtgaacaaac

SEQ ID NO: 4113 - DNA, 425 bp, Zea mays
  misc_feature: Ceres CLONE 296611-F
  misc_feature: Encodes the peptide sequence at SEQ ID NO. 4114
  misc_feature (40)..(40): n is a, c, t, g, unknown, or other
  misc_feature (379)..(379): n is a, c, t, g, unknown, or other
atcacaagccagaacagccaagaacagagatacccaagtnaccgaagcaaccgctcacaatcccaatctcccgcgtcactcaaaacccgaagtaacacaaccgtcggtccgaccaacaatgtcgctgattcgccgtggaaacgcattcgaccccttctccctcgacctctgggaccccttcgagggcttcttccccttcggctccggcgacgtccgcagcctcgttccctcgttgccgcgcaccagctcggagaccgcggcatttgccggcgcgcggatcgactggaaggagacacccgaagcgcacgtgttcaaggcggacgtgccggggctgaggaaggaggaggtcaaggtggaggtcgaggacggcaacgtctgncagatcagcggcgagcgcaacaaggagcacgaggagaagaacgaca

SEQ ID NO: 4114 - protein, 102 aa, Zea mays
  misc_feature: Ceres CLONE 296611-F
  misc_feature (87)..(87): Xaa is any aa, unknown, or other
MSLIRRGNAFDPFSLDLWDPFEGFFPFGSGDVRSLVPSLPRTSSETAAFAGARIDWKETPEAHVFKADVPGLRKEEVKVEVEDGNVXQISGERNKEHEEKND

SEQ ID NO: 4115 - DNA, 398 bp, Zea mays
  misc_feature: Ceres CLONE 296638-F
  misc_feature (29)..(29): n is a, c, t, g, unknown, or other
gatagcttgctccaggacgtacgtacgtnyagatcgatccatcgatcgctagctagctgacgaccatggcgtccctctcctctgccgccatcaccgccccttccttcacggccgcgccgctcgcagtggtcagcaggaggtccttcaccgtgcgtgcctctctccgcaagccactgccaccgccgccgtggccgttgccgccagcgtcctgcttgccggcgsggcgcatggcccaggaggtgctgctgggcgcaggcgacggcgggctcgtcttcgagcaagccagttcaccgtcaaggccggcgacaccatcaccttcaagaacaacgccggcttcccgcacaacgtcgtgttcgasaagacgaggtgccgagcggcgtcgacgcctccaagatctc

SEQ ID NO: 4116 - DNA, 476 bp, Zea mays
  misc_feature: Ceres CLONE 296653-F
  misc_feature: Encodes the peptide sequence at SEQ ID NO. 4117
  misc_feature (308)..(308): n is a, c, t, g, unknown, or other
atcagaatcggaccaccacacgcccgaggcccgactgcaagckcctgagcccaagacccatggccatggcgccgccaccgtcgcagcgtctctgcccgtggcgcaggggctcgggaagcccctctgcgccggaagcaacgcgccgtcgctccgggccgtcgcgggckcgccccgtcgtcggtcggccaggaccaggatggccgtcgtccgggcgtccgcgcaaaakcagcacccggccaaggagtgggcggccgcggctgccgtggcggcggcgctggtgcttccggagtcgcggaggccgcgccggnggatctccccgttcgctcaagaacttcctcctcagcatcgtctccggtggggtcgtgctcgtcgccatcgtcggcgccgtcgtcgccgtctctaacttcgatcccgtcagcggggttgagctgcatcgtcgttgtgtgttgttgtacctatgtactgagatctctctc

SEQ ID NO: 4117 - protein, 133 aa, Zea mays
  misc_feature: Ceres CLONE 296653-F
  misc_feature (56)..(56): Xaa is any aa, unknown, or other
  misc_feature (75)..(75): Xaa is any aa, unknown, or other
  misc_feature (103)..(103): Xaa is any aa, unknown, or other
SESDHHTPEARLQAPEPKTHGHGAATVAASLPVAQGLGKPLCAGSNAPSLRAVAGXPRRRSARTRMAVVRASAQXQHPAKEWAAAAAVAAALVLPESRRPRRXISPFAQELPPQHRLRWGRARRHRRRRRRRL

SEQ ID NO: 4118 - DNA, 202 bp, Zea mays
  misc_feature: Ceres CLONE 296673-F
  misc_feature: Encodes the peptide sequence at SEQ ID NO. 4119
gtccccgatcagacttgttcggcctcttcgacggcgtgcccgtctccccgggctcattcgccatgcattcctcagcctccgcgagakgaggacgagggctcctcttgccggcggggcttgtggtgctackgttgggtgcagtggcgccackgcgggtctgctatccgcgcgtgttcaacttcggggactctctggcggacac

SEQ ID NO: 4119 - protein, 46 aa, Zea mays
  misc_feature: Ceres CLONE 296673-F
  misc_feature (9)..(9): Xaa is any aa, unknown, or other
  misc_feature (23)..(23): Xaa is any aa, unknown, or other
  misc_feature (30)..(30): Xaa is any aa, unknown, or other
MHSSASARXGRGLLLPAGLVVLXLGAVAPXRVCYPRVFNFGDSLAD

SEQ ID NO: 4120 - DNA, 402 bp, Zea mays
  misc_feature: Ceres CLONE 296706-F
  misc_feature: Encodes the peptide sequence at SEQ ID NO. 4121
  misc_feature (38)..(38): n is a, c, t, g, unknown, or other
  misc_feature (42)..(42): n is a, c, t, g, unknown, or other
  misc_feature (280)..(280): n is a, c, t, g, unknown, or other
  misc_feature (388)..(388): n is a, c, t, g, unknown, or other
aaagcacaagcacaaccaaaagcaaagaagagacgaangttncgatcgatctcagcaactaagcaggtaggtaggcatggyggccgagaaggagggcgcggtggtgaccaagggccacgacgaggggatgaaggcggcggcggcgctgctggaggagttcgggctcccgccggggctgctgccgctggaggacgtgacggaggtggggttctgcgggccaccggctacttctggctcgcgcrscaagaaggtggagcaccggttccgcaagatcggcaancaggtgagctacgacgtcgagatcgccggctacgtccggcccaggggcatcaggaggctcaagggggtcaaggccaatgagctcgtgctctggccgcccgtccacganatggccgtcgacga

SEQ ID NO: 4121 - protein, 108 aa, Zea mays
  misc_feature: Ceres CLONE 296706-F
  misc_feature (1)..(108): Pfam Name: DUF538 Pfam Description: Protein of unknown function, DUF538
  misc_feature (2)..(2): Xaa is any aa, unknown, or other
  misc_feature (56)..(56): Xaa is any aa, unknown, or other
  misc_feature (68)..(68): Xaa is any aa, unknown, or other
  misc_feature (104)..(104): Xaa is any aa, unknown, or other
MXAEKEGAVVTKGHDEGMKAAAALLEEFGLPPGLLPLEDVTEVGFCGPPATSGSRXKKVEHRFRKIGXQVSYDVEIAGYVRPRGIRRLKGVKANELVLWPPVHXMAVD

SEQ ID NO: 4122 - DNA, 417 bp, Zea mays
  misc_feature: Ceres CLONE 296715-F
  misc_feature (230)..(230): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggcgatggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgcttccaaggacaacaagaagacgcgcatcgtcccgcgccacgtgctgctgggcgatccgcaacgacgaggagctcgggaagctgctgaccggcgtgaccatcgccac

SEQ ID NO: 4123 - DNA, 460 bp, Zea mays
  misc_feature: Ceres CLONE 296719-F
  misc_feature (139)..(139): n is a, c, t, g, unknown, or other
  misc_feature (408)..(408): n is a, c, t, g, unknown, or other
atcttgctctgaacgcattcctcccatctcccaagacctcctcagacccgagaagcgcakgcgggccatggacgccaccggcactggagctggagggaaggcgaagaagggagcggccggtcgcaaggccgcgggcganggaagaagtcggtgacgaggtccgtgaaggccgggctccagttccccgtcggccgcatcgggcgctacctcaagaagggccgctacacgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtnaccatcgcccacgggacgttttgcccaacatcaacccggtcctgctgcccaa

SEQ ID NO: 4124 - DNA, 159 bp, Zea mays
  misc_feature: Ceres CLONE 296728-F
  misc_feature: Encodes the peptide sequence at SEQ ID NO. 4125
  misc_feature (91)..(91): n is a, c, t, g, unknown, or other
  misc_feature (94)..(94): n is a, c, t, g, unknown, or other
atcacccaaaacacaagtagggttaggaaggcggcggccagcggcgagagcgcgaagaggaggaggggtcggccatgacggggaaggcgankangaagcacacagcgaaggagatcgccgcgaagatcgacgcggcgacgacgaaccggggcggcggca

SEQ ID NO: 4125 - protein, 28 aa, Zea mays
  misc_feature: Ceres CLONE 296728-F
  misc_feature (6)..(6): Xaa is any aa, unknown, or other
  misc_feature (7)..(7): Xaa is any aa, unknown, or other
MTGKAXXKHTAKEIAAKIDAATTNRGGG

SEQ ID NO: 4126 - DNA, 265 bp, Zea mays
  misc_feature: Ceres CLONE 296733-F
  misc_feature: Encodes the peptide sequence at SEQ ID NO. 4127
  misc_feature (19)..(19): n is a, c, t, g, unknown, or other
aaccacacacagagcggbntttcgaataacacaggtgagcgcgacgatgggatccctcgttaataacatcatggtcgtgggcgccgtccttgckgctcgttcgcggcgggtcgtgcgggcccccgaagtgccacccggccccaacatcaccaccaactacaacggcaagtggctcaccgctaggccacctggtacggtcagcccaacggtgccggcgctcctgacaacgggcggtgcgtgcgggatcaagaacgtgaacctgcca

SEQ ID NO: 4127 - protein, 73 aa, Zea mays
  misc_feature: Ceres CLONE 296733-F
MGSLVNNIMVVGAVLAARSRRVVRAPEVPPGPNITTNYNGKWLTARPPGTVSPTVPALLTTGGACGIKNVNLP

SEQ ID NO: 4128 - DNA, 797 bp, Zea mays
  misc_feature: Ceres CLONE 296757
  misc_feature: Encodes the peptide sequence at SEQ ID NO. 4129
atgaaggcactgtctctatttttgatgggtcagtagccaccctctgttggctaacgacatgtcccaaatagcctgttttctgttgggatatgctcttgactgcggctgcgcggccgtcggcgatggaggcatggcaccgcgggcaggagcagcaagcccggggcatcgtgttgtaggtgagggacgggaacctggagcgggcgctgtcggtcatggagctcaagatgcggtccgccgcatccggtcgcgcacccaccgccacgtgaaggactcggagaagcgcgtgctcgcgcgtgaaggcgctaatgcagcacgtccggtaccaggagctcggcaagaagctccgcgagatcctcatcaggaacatcagacatttatagtggcttgcggtgacgaattggaacggattctatagtgatcgccaagtgctcgacgaaatgtctcgtgaagttctatctaccacgcttagtggaattgagtgtgtttgcggattgagttgcgctgaggaagaagtttcagtgctgagcgcagtgtcaacccggtgcaggtatctggattggaaggtttgtgtgagaggaacactttcatgtgcacccaactcatccttagctcacttaggcatccacgaaacaggtgtgttgtatggtggtaccaggatatatgaacatgctacaaattttgaacatgctacaaatttaggagccttttggtagatttttcatggcatgtggtgatccaacgtatcaggtttgtgtcactaatttgatcctgcatctttaacaaaaaaaaaaaaaaaa

SEQ ID NO: 4129 - protein, 118 aa, Zea mays
  misc_feature: Ceres CLONE 296757
MSQIACFLLGYALDCGCAAVGDGGMAPRAGAASPGHRVVGEGREPGAGAVGHGAQDAVRRIRSRTHRHVKDSEKRVLAREGANAARPVPGARQEAPRDPHQEHQTFIVACGDELERIL

SEQ ID NO: 4130 - DNA, 658 bp, Zea mays
  misc_feature: Ceres CLONE 296767-R
  misc_feature: Encodes the peptide sequence at SEQ ID NO. 4131
ccgggccccccctcgaggtagatactatggcccccccccccccccccttttttggaaagcgataaatgcggagcgatcgctgcaccccagatacgacctaaaaaggatgcacctatttagctggaaggccgtacagaagactatgctgctgaaccagtagtcgctaagcgcggagctcatccgtagatagctccctaaaaggctcccgtggacgaagaggaagttgatatgccttcactgaaagaccgtcttgctgcctttaatataaatgactcatctcctcctgatcactctggtatggaaactgaatcaacaaatcggccgggtcgcaagaaagggagaggaaagaaggctgccacccccgctgtaaagcctaaagctcctgccgccgggaggagggcccctactcaagggggctaggctacgcgctggaaaatagatgagatcgctcaaggtcactgaggataacaccaccggtgctttgtcccctgacaagaaggtccggaagatgaggccctctcccttcaacaagaagagcggcctgatctttcggagaggctcgactgccgcttctgcaagctctgagactatcgctgaaccttcaccaccctcaggtagctgtgataatccagttgcctgcaccaaaacctggatcgga

SEQ ID NO: 4131 - protein, 73 aa, Zea mays
  misc_feature: Ceres CLONE 296767-R
  misc_feature: SWISSPROT Homolog: EC 5.99.1.3 DNA topoisomerase (ATP-hydrolyzing)
MRSLKVTEDNTTGALSPDKKVRKMRPSPFNKKSGLIFRRGSTAASASSETIAEPSPPSGSCDNPVACTKTWIG

SEQ ID NO: 4132 - DNA, 459 bp, Zea mays
  misc_feature: Ceres CLONE 296797-F
  misc_feature: Encodes the peptide sequence at SEQ ID NO. 4133
ataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggctggtcagggcccgccgcgcccaggcgtgcagctcctgcagctgcagct

SEQ ID NO: 4133 - protein, 125 aa, Zea mays
  misc_feature: Ceres CLONE 296797-F
  misc_feature (1)..(114): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRLVRARRAQACSSCSCS

SEQ ID NO: 4134 - DNA, 366 bp, Zea mays
  misc_feature: Ceres CLONE 296803-F
  misc_feature: Encodes the peptide sequence at SEQ ID NO. 4135
  misc_feature (260)..(260): n is a, c, t, g, unknown, or other
  misc_feature (262)..(262): n is a, c, t, g, unknown, or other
agagaacccaaggacgcgcctcgcctcgagatccactcggagggccaccgcgaccgctccggtsgttccggcgaggtgccgcgcggtcgtaagtcgtaacagcatacacagggcagacaaagctgcgattttgggggggctgttggtccagccgtggttgttggtggagataaaccacgtgaaggctggtgctctggtacatgttcgccaggcactgatggcatttggccgaggtggaaagatggacggccgccggyttncnattcgtcgtcggtcgtcgtcgttctgcacaaccaccacggtcgtgctctttgtggcgctctgcctagtcgggcgcttggataatgacctcgtccactktcttcc

SEQ ID NO: 4135 - protein, 49 aa, Zea mays
  misc_feature: Ceres CLONE 296803-F
  misc_feature (14)..(14): Xaa is any aa, unknown, or other
  misc_feature (15)..(15): Xaa is any aa, unknown, or other
  misc_feature (48)..(48): Xaa is any aa, unknown, or other
MAFGRGGKMDGRRXXIRRRSSSFCTTTTVVLFVALCLVGRLDNDLVHXL

SEQ ID NO: 4136 - DNA, 472 bp, Zea mays
  misc_feature: Ceres CLONE 296810-F
  misc_feature: Translation starting site: 123
  misc_feature: SWISSPROT Homolog: EC 5.2.1.8 Peptidylprolyl isomerase
  misc_feature (355)..(355): n is a, c, t, g, unknown, or other
  misc_feature (357)..(357): n is a, c, t, g, unknown, or other
  misc_feature (372)..(372): n is a, c, t, g, unknown, or other
akatcagatcacactcgtagaagaaggaaaaatatccccaaaccctagctcccgatctcgatggcgaaccctcgcgtcttcttcgacatgaccgtcggcggcgcccggcgggccggatcgtgatggagctgtacgccaacgaggtgcccaagaccgcggagaacttccgcgcgctgtgcacgggcgagaagggcgtgggcaagtccgggaagccgctccactacaaggtctccaccttccaccgcgtcatccccgagttcatgtgccagggcggcgacttcacccgcggcaacggcaccggcggcgagtccatctacggcgagaagttccccgacgagaagttcgtgcgcaasancncgctcccggtgtgtnctccatggccaacgccgggcccaacaccaacggctcccagttcttcatctgcaccgtcgcgaccccttggctcgacggcaagcacgtcggtcttcggcca

SEQ ID NO: 4137 - DNA, 458 bp, Zea mays
  misc_feature: Ceres CLONE 296822-F
  misc_feature: Translation starting site: 82
  misc_feature (137)..(137): n is a, c, t, g, unknown, or other
  misc_feature (198)..(198): n is a, c, t, g, unknown, or other
  misc_feature (234)..(234): n is a, c, t, g, unknown, or other
atcacaattcacagcgctcaagttctcgcgcccacagccaaatttttctccactcaatcgcggcataagctgcactgcascatggacgccagcggascggtagcaaggcgaagaagggggcggctggkvcgcaaggntggcggccccaggaagaagtcggtgtbgcggtccgtyaaggccgggctgcagttccccgtnggccggatcgggcgctacctcaagawggggcggtansmcascgtggsmcaccggcgaccccgtctatctcgccgccgtgcttgagtacctcgccgccgagtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggcggtgtcctccccaacatcaacccggttct

SEQ ID NO: 4138 - DNA, 480 bp, Zea mays
  misc_feature: Ceres CLONE 296826-F
  misc_feature: Encodes the peptide sequence at SEQ ID NO. 4139
atcacacactcgactctcctctctcgcatccgcagcctttcgagctctactccaccccctcgatctcgaagcgcmsagccagcagtcaggcggccatggacgcgagcgcmscggagccggcggaaggcgaagaagggcgcggccgggcgcaaggccggcgggcgaggaagaagtcggtgacgaggtccgtcaaggccgggctgcagtttcccgtcggccgcatcgggcggtacctgaagaagggccggtacgcgcasgtcggcacgggcgcccccgtctacctggccgccgtcctcgagtacctggccgccgaggtgctggagctggccggcaacgytgccaaggacaacaagaagacccggcatcatcccgcgccacgtgctccttgccatccgcaacgacgaggagctcggcaagctgcttttccggcgtcaccatcgcccacggcscgttcctccccaacatcaacccggtgctcct

SEQ ID NO: 4139 - protein, 128 aa, Zea mays
  misc_feature: Ceres CLONE 296826-F
  misc_feature (30)..(97): Pfam Name: Histone Pfam Description: Core histone H2A/H2B/H3/H4
  misc_feature (6)..(6): Xaa is any aa, unknown, or other
  misc_feature (54)..(54): Xaa is any aa, unknown, or other
  misc_feature (81)..(81): Xaa is any aa, unknown, or other
MDASAXEPAEGEEGRGRAQGRRARKKSVTRSVKAGLQFPVGRIGRYLKKGRYAXVGTGAPVYLAAVLEYLAAEVLELAGNXAKDNKKTRHHPAPRAPCHPQRRGARQAAFPASPSPTARSSPTSTRCS

SEQ ID NO: 4140 - DNA, 132 bp, Zea mays
  misc_feature: Ceres CLONE 296839-F
acacgcacaccgcgacccagtccagagccagtacgtgcgavgcacgcacgctgctggtccgcgtacsagacgacggtcaggtcggccggtgcttttcagtttggaataatgacggcgacgacgacgacagcc

SEQ ID NO: 4141 - DNA, 465 bp, Zea mays
  misc_feature: Ceres CLONE 296845-F
  misc_feature: Translation starting site: 249
aagcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgggtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctca

SEQ ID NO: 4142 - DNA, 496 bp, Zea mays
  misc_feature: Ceres CLONE 296874-F
  misc_feature: Encodes the peptide sequence at SEQ ID NO. 4143
acatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccgtccgtccgcctagcttgctacaagcaggcgctaataagctagcaagct

SEQ ID NO: 4143 - protein, 89 aa, Zea mays; identical to SEQ ID NO: 3974
  misc_feature: Ceres CLONE 296874-F

SEQ ID NO: 4144 - DNA, 779 bp, Zea mays
  misc_feature: Ceres CLONE 296875
  misc_feature: Encodes the peptide sequence at SEQ ID NO. 4145
acaagccacgcgccacccattccctccatttcatagctcgatcgagtggtgtggtgaacatgtaccctgctgcagagatcgctagcgtccgatacctatctcctgcaggcgcagcctctctcagacctcattaccgtgacgacttcctcttcctcttccagtacagcgacctcctggcgcctgcgcacccttcgctctaccaagatgtcgctgatcacctggtcctcggagctagcttcccggctgtcggtgacaacaggtccagctcggaggagtcggacggctacctgcagcgcagcctcgcggaggagcgcaggaagaggaggatggtatccaacagggagtccgcccggcggtcgcgcgtgaggaagcagaagcagctgagcgagctctgggcgcaggtcgtccacctccgcggcaccaaccgccagcaccttgaccagctcaaccgtgtcatcagagactgcgaccgtgtcctccttgaaaactcccggctcagagatgaacggaccaggttgcagcagcagctggaggagctccctgtagagaccacggagactggtggcatgagtcgtcctcctgactcttgaagcatccaggattacatgtgttattagatgagattttaactaggaggcttccttccttccttccttatatcctgatgttttcattttttttatcgttgctctatgtttagtatcaaagctagtatgtagctgccatgtggtaaatggtgagttctccattttatttcaaaaacaaaaaaaaaaaaaaaa

SEQ ID NO: 4145 - protein, 176 aa, Zea mays
  misc_feature: Ceres CLONE 296875
  misc_feature (81)..(144): Pfam Name: bZIP_1 Pfam Description: bZIP transcription factor
  misc_feature: The sequence is a functional homolog of SEQ ID NO 2522 in the 10/374,780 US patent application
  misc_feature: The sequence is a functional homolog of SEQ ID NO 622 in the 10/225,066 US patent application
  misc_feature: The sequence is a functional homolog of SEQ ID NO 702 in the 10/412,699 US patent application
MYPAAEIASVRYLSPAGAASLRPHYRDDFLFLFQYSDLLAPAHPSLYQDVADHLVLGASFPAVGDNRSSSEESDGYLQRSLAEERRKRRMVSNRESARRSRVRKQKQLSELWAQVVHLRGTNRQHLDQLNRVIRDCDRVLLENSRLRDERTRLQQQLEELPVETTETGGMSRPPDS

SEQ ID NO: 4146 - DNA, 375 bp, Zea mays
  misc_feature: Ceres CLONE 296886-F
  misc_feature: Translation starting site: 238
  misc_feature (282)..(282): n is a, c, t, g, unknown, or other
atcacagctagctagcatacagacgaataatctcttcttcacctcactaacaccagctagcaactctttctctcctgcaataatggccgctcgctcctcctcctcccagccgcagctgtcgcggcggcggcggtcctggcagcggcgcytgctgctggcggcgggggccgggacssttcggcggcggtgagctgcggcgaggtgacgtcgtcggtggcgccgtgcctcgggtacgcgatgggcagcgcggcgtcgccctccgcggcgtgctgcagcggggtncgctcgctcaacagccgcgcgtcgtcggcggcggtaccggcagccacctgcaactgcctcaagagcattacgggccggctcggcggcggcgtc

SEQ ID NO: 4147 - DNA, 116 bp, Zea mays; identical to SEQ ID NO: 3608
  misc_feature: Ceres CLONE 296892-F

SEQ ID NO: 4148 - DNA, 135 bp, Zea mays
  misc_feature: Ceres CLONE 296910-F
acgcacaccgcgacccagtccagagccagtacgtgcgamggcacgcacgctgctggtccgcgtacsagacgacggtcaggtcggccggtgcttttcagtttggaataatgacggcgacgacgacgacagccgccg

SEQ ID NO: 4149 - DNA, 436 bp, Zea mays
  misc_feature: Ceres CLONE 296920-F
  misc_feature: Translation starting site: 123
  misc_feature: SWISSPROT Homolog: EC 5.2.1.8 Peptidylprolyl isomerase
  misc_feature (353)..(353): n is a, c, t, g, unknown, or other
  misc_feature (355)..(355): n is a, c, t, g, unknown, or other
  misc_feature (357)..(357): n is a, c, t, g, unknown, or other
agatcagatcacactcgtagaagaaggaaaaatatccccaaaccctagctcccgatctcaatggcgaaccctcgcgtcttcttcgacatgaccgtcggcggcgcccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaanancncgctcccggtgtbtcctccatggccaacgccgggcccaacaccaacggctcccagttcttcatctgcaccgtcgcgacc

SEQ ID NO: 4150 - DNA, 471 bp, Zea mays
  misc_feature: Ceres CLONE 296930-F
  misc_feature: Translation starting site: 91
  misc_feature (417)..(417): n is a, c, t, g, unknown, or other
ctctagccaaaaccctgagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcarctcgtgatgaagaagtcaagtgctcatgatggacttgtgaagggtctccgtgaggctgccaaggccatcgagaagcacgccgctcagcttccgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaatgcaangaaggttgtaggctgctcctgtgtcgtcgtcaaggactacggtgaagaatctga

SEQ ID NO: 4151 - DNA, 181 bp, Zea mays
  misc_feature: Ceres CLONE 296967-F
aattcgcaacacaatcgtcctccgccaccctccattaaccctagcggcasagcgctcgtttgatccccgcggcggtccggcgtccgggtagggagcgaggatgacggaycctggtgcggaacaagccggggatggccagcatcaaggagatgccggtgctgcaggacgggccgccgccggg

SEQ ID NO: 4152 - DNA, 422 bp, Zea mays
  misc_feature: Ceres CLONE 296972-F
  misc_feature: Encodes the peptide sequence at SEQ ID NO. 4153
  misc_feature (300)..(300): n is a, c, t, g, unknown, or other
ccacaacgcaggacaagccatcgccccgatgacaccgccgcctcatgccgcctcctctcgccggcctcctcctctccgcccccctgtccgaagcagctacccaagcggcgaccgaccttcgcggcctcgcagcagcagtcgcccagctccagcgccaagttcaggctcctctgcctcctccatgacaagtccgcgtcgccaacgacgtcggtgcagatgcagagctcacagtcacagttgcagaggctggcgacggtgttgcagtgcggascgtctgggcagctgttgaggcgccggcgntgggcgggtgaccggcgaggaggacatcgacctgctagggatcctgccgccgctcgcgtgttcgccttcttctacttcctcgtcgctcctccgggtgatcatgaactgggatgaggctgagg

SEQ ID NO: 4153 - protein, 137 aa, Zea mays
  misc_feature: Ceres CLONE 296972-F
  misc_feature (91)..(91): Xaa is any aa, unknown, or other
PQRRTSHRPDDTAASCRLLSPASSSPPPCPKQLPKRRPTFAASQQQSPSSSAKFRLLCLLHDKSASPTTSVQMQSSQSQLQRLATVLQCGXSGQLLRRRRWAGDRRGGHRPARDPAAARVFAFFYFLVAPPGDHELG

SEQ ID NO: 4154 - DNA, 131 bp, Zea mays; identical to SEQ ID NO: 3257
  misc_feature: Ceres CLONE 297010-F

SEQ ID NO: 4155 - DNA, 458 bp, Zea mays
  misc_feature: Ceres CLONE 297011-F
  misc_feature (386)..(386): n is a, c, t, g, unknown, or other
aacaacagccctacaacttactgcttgctctagctagctagctgctcccggcccatatccactacacaagtaggctagcagcagcagcagcaatggcctcggtgacgrgttcccggccgtggcctcgtcctgctgctcgccgccagcgccttcctggccagcgaggtggcggcgtgcggcggctgccgaaaccaactcctcctcctccatcgccaccaccgccgtcgcccaccagcacgccgtscctccgccaccgtccagctccggcgcaagtkccccaagaacgcgctgaaactgggcgtgtkcgcaacgtgctgggcctcgtcaaggtgtccatcggcaaggtgcccaccgactcgtgctgcccgctgctggacggcctcgcnacctggaggccgccgtctgcctctgcaccgcgctcaaggccaacgtgctcggcatcaacctcgacgtcccgt

SEQ ID NO: 4156 - DNA, 448 bp, Zea mays
  misc_feature: Ceres CLONE 297016-F
  misc_feature: Encodes the peptide sequence at SEQ ID NO. 4157
  misc_feature (149)..(149): n is a, c, t, g, unknown, or other
  misc_feature (150)..(150): n is a, c, t, g, unknown, or other
aaataacaaaagaactcgctccattcagagattcagagaagacccgcctctcccgtgagccgtgacgcgacgccggatcgtcctcgtctcctagctcgtggaatgaagggaggtggcgtcatcaggkccgccggcggaggtgccggstnncgggtctgttgcgaacscgactgcgcttcccgtggtgctcctctcctgctccctcttcttcctcgccggcttcttcggctcgctcctcttcacccaggatccggagaggcggatatgccggttgccgakagagcggctgttggaggcggcgtkgccggagatgccttacggcgagtccggcgaggctgcgcgttccttgatcccataccagattttgagctggcagcctcgtgctttgtactttccacaatttgcgacatcagaacagtgtgaaaatatagtaaaaacggcaaaggat

SEQ ID NO: 4157 - protein, 52 aa, Zea mays
  misc_feature: Ceres CLONE 297016-F
  misc_feature (5)..(5): Xaa is any aa, unknown, or other
MPVAXRAAVGGGVAGDALRRVRRGCAFLDPIPDFELAASCFVLSTICDIRTV

SEQ ID NO: 4158 - DNA, 106 bp, Zea mays
  misc_feature: Ceres CLONE 297024-F
acacgcacaccgcgacccagtccagagccagtacgtgcgamrcacgcacgctgctggtccgcgtacsagaacgacggtcaggtcggccggtgcttttcagtttgga

SEQ ID NO: 4159 - DNA, 138 bp, Zea mays
  misc_feature: Ceres CLONE 297052-F
  misc_feature (71)..(71): n is a, c, t, g, unknown, or other
acacgcacaccgcgacccagtccagagccagtacgtgcgamggcacgcacgctgctggtccgcgtacsagnacgacggtcaggtcggccggtgcttttcagtttggaataatgacggcgacgacgacgacagccgccg

SEQ ID NO: 4160 - DNA, 119 bp, Zea mays
  misc_feature: Ceres CLONE 297084-F
acacgcacaccgcgacccagtccagagccagtacgtgcgamggcacgcacgctgctggtccgcgtacsagacgacggtcaggtcggccggtgcttttcagtttggaataatgacggcga

SEQ ID NO: 4161 - DNA, 121 bp, Zea mays
  misc_feature: Ceres CLONE 297143-F
acacgcacaccgcgacccagtccagagccagtacgtgcgamggcacgcacgctgctggtccgcgtacsagacgacggtcaggtcggccggtgcttttyagtttggaataatgacggcgacg

SEQ ID NO: 4162 - DNA, 428 bp, Zea mays
  misc_feature: Ceres CLONE 297150-F
  misc_feature: Encodes the peptide sequence at SEQ ID NO. 4163
  misc_feature (413)..(413): n is a, c, t, g, unknown, or other
atctcacgccgcaacctccctcgagcccgagcaaacaagggcggacgcggascggcggcgaasggaaatggcggagaagaagcgaggcgccggcactcgcaaggatgaggtggtgacacgcgagtacactatcaacctccacaaacgcctccacggatgcacctttaagaagaagacaccaaatgccatcaagggagatcaggaagttcgctcagaaggccatgggtactacttgatgtccggattgacgttgaagctcaacaagcacatctggagcagtggtatccgcagtgtgccgaggcgtgtccgtgttagaattgcccgcaaccggaacgatgaggaagacgccaaggaggaactctactctctgggtcacagttgctgagatcccaccggagggtctcaaaggtttnggaactaaggttgtt

SEQ ID NO: 4163 - protein, 105 aa, Zea mays
  misc_feature: Ceres CLONE 297150-F
  misc_feature (11)..(106): Pfam Name: Ribosomal_L31e Pfam Description: Ribosomal protein L31e
MAEKKRGAGTRKDEVVTREYTINLHKRLHGCTFKKKTPNAIKGDQEVRSEGHGYYLMSGLTLKLNKHIWSSGIRSVPRRVRVRIARNRNDEEDAKEELYSLGHSC

SEQ ID NO: 4164 - DNA, 492 bp, Zea mays
  misc_feature: Ceres CLONE 297181-F
  misc_feature: Translation starting site: 385
  misc_feature: Pfam Name: DUF1754 Pfam Description: Eukaryotic family of unknown function (DUF1754)
  misc_feature (49)..(49): n is a, c, t, g, unknown, or other
  misc_feature (152)..(152): n is a, c, t, g, unknown, or other
  misc_feature (353)..(353): n is a, c, t, g, unknown, or other
gggttacgttcctcgcacggcggaggcaaacaaaccctagccgccasanggcggtcagggagcgagtaccgagcgccccagttcacacgtgagatgtcagaatacaagaacgtcgttggggggaggctaaagctgaagggtaaggcactggnatgtgaaggaaggtggagtcaagaagaaaaaaaagaagcatcagcttgaagagtcgtctcagattgagcacgatgagctccacaaagggggaaactctggcttaccagctgatcacaacaatgagcttattgaagctggcaaggtgggagatgaagaaaggaatctacatccggactacgaccacctcacaccggcggasnacgctatatagatcagaagcagaagatcgacatgcaaaagctggccaaagttgctaacaagtcacacaggggaccgtatccaggacttcaaccagtatctggcgacctcagcgagcactatgacatcccttaaagttgg

SEQ ID NO: 4165 - DNA, 308 bp, Zea mays
  misc_feature: Ceres CLONE 297202-F
  misc_feature: Encodes the peptide sequence at SEQ ID NO. 4166
  misc_feature (132)..(132): n is a, c, t, g, unknown, or other
  misc_feature (212)..(212): n is a, c, t, g, unknown, or other
  misc_feature (300)..(300): n is a, c, t, g, unknown, or other
atcttgctctgaacgcattcctcccatctcccaagacctcctcagacccgagaagcgcmkgcggccatvgacgccaccggsactggagctggagggaaggcgaagaagggagcggccggtcgcaaggccgcnggccgaggaagaagtcggtgacgaggtccgtgaaggccgggctccagttccccgtcggccgcatcgggcgctacctcaanaagggccgctacgscagcgtcggcagcggtgcccccgtctacctcgcggccgtcctggaktacctcgccgctgaggtcctggagctcnccggcaac

SEQ ID NO: 4166 - protein, 102 aa, Zea mays
  misc_feature: Ceres CLONE 297202-F
  misc_feature (20)..(20): Xaa is any aa, unknown, or other
  misc_feature (23)..(23): Xaa is any aa, unknown, or other
  misc_feature (27)..(27): Xaa is any aa, unknown, or other
  misc_feature (44)..(44): Xaa is any aa, unknown, or other
  misc_feature (70)..(70): Xaa is any aa, unknown, or other
  misc_feature (75)..(75): Xaa is any aa, unknown, or other
  misc_feature (90)..(90): Xaa is any aa, unknown, or other
  misc_feature (100)..(100): Xaa is any aa, unknown, or other
LALNAFLPSPKTSSDPRSAXGHXRHRXWSWREGEEGSGRSQGRXPRKKSVTRSVKAGLQFPVGRIGRYLXKGRYXSVGSGAPVYLAAVLXYLAAEVLELXGN

SEQ ID NO: 4167 - DNA, 489 bp, Zea mays
  misc_feature: Ceres CLONE 297203-F
  misc_feature: Encodes the peptide sequence at SEQ ID NO. 4168
atccttccactcaaacgatcgcaacacgatccaaagaacgacgtggggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccaccctgaggcagaacctggactacacctgcaccctgtsccaaaacagcatggaggccggcgagaaggtccgcacgctctcctgcgaccacgtgttccactgcggcggcacgtcaaktgcgagggaatcgaccactgccttcgcaccggaccgatggagcgctgcccgacctgtgaccgggttccccatcccgtg

SEQ ID NO: 4168 - protein, 121 aa, Zea mays
  misc_feature: Ceres CLONE 297203-F
  misc_feature (70)..(70): Xaa is any aa, unknown, or other
  misc_feature (96)..(96): Xaa is any aa, unknown, or other
MADPSYWIGMDIETSVTMLVICLAAAVVSVCLFFIFMCIVQWLDSPRMRVFRLGGVTTLRQNLDYTCTLXQNSMEAGEKVRTLSCDHVFHCGGTSXARESTTAFAPDRWSAARPVTGFPIP

SEQ ID NO: 4169 - DNA, 493 bp, Zea mays
  misc_feature: Ceres CLONE 297216-F
  misc_feature: Encodes the peptide sequence at SEQ ID NO. 4170
  misc_feature (322)..(322): n is a, c, t, g, unknown, or other
cttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgtttgatgtggacatttggtgccaatccatccgccgagggtggtgaggacgaaagcgtttgatgacacagctgtgaaggtggttgatattgttgacacattccgtctacaggagcaacctcctttttngaacaagaaatcatttgtgtcttacatcaaaaaatdcatcaagaatctcactgctgtgttggagccagagaaagcggatgagttcaaaaagggtgtcgagggtgcaacaagtttctccttagcaagctgaaggacctccaatttttttgttggtgaatccattaaggatga

SEQ ID NO: 4170 - protein, 41 aa, Zea mays
  misc_feature: Ceres CLONE 297216-F
MLVYQDLLSGDELLSDSFTYKELENGVLWEVEGKWVTQGPV

SEQ ID NO: 4171 - DNA, 116 bp, Zea mays; identical to SEQ ID NO: 3608
  misc_feature: Ceres CLONE 297228-F

SEQ ID NO: 4172 - DNA, 237 bp, Zea mays
  misc_feature: Ceres CLONE 297261-F
  misc_feature (182)..(182): n is a, c, t, g, unknown, or other
  misc_feature (237)..(237): n is a, c, t, g, unknown, or other
aaaatcgaaacaaagaaagaaaaaatcgagaggacgccagggccgattctctgcgtgacttggggcgtcgtcgcgagttttctccggccgagggcggcgcgaccggacaaccagcgtgacgctgaccggcgacatgactcgcggcaaccagcgtgaccgcgaccgtgagcgcgcggcggcgngaagcccaacgccaagaactcccaggacgggctcaccccggagcagcgccgcgan

SEQ ID NO: 4173 - DNA, 471 bp, Zea mays
  misc_feature: Ceres CLONE 297312-F
  misc_feature: Encodes the peptide sequence at SEQ ID NO. 4174
tcccaaagacgccgtcgccgctcttgttgtttccgatcccaaaccccaaacacgctccaccggcacctccgctcccacaccacaccgatggcccgcacgaagcagacggcgcgcaagtccaccggagcaaggcgccgcggaagcagctggcgaccaaggcagcgcgcaagtbggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggctacctcgtcggcctcttcgaggacaccaacctctgcgccatccacgccaagcgcgtcaccatcatgcccaaggacattcagctcgcccg

SEQ ID NO: 4174 - protein, 156 aa, Zea mays
  misc_feature: Ceres CLONE 297312-F
  misc_feature (57)..(57): Xaa is any aa, unknown, or other
PKTPSPLLLFPIPNPKHAPPAPPLPHHTDGPHEADGAQVHRSKAPRKQLATKAARKXAPATGGVKKPHRFRPGTVALREIRKYQKSTELLIRKLPFQRLVREIAQDFKTDLRFQSSAVAALQEAAEATSSASSRTPTSAPSTPSASPSCPRTFSSP

SEQ ID NO: 4175 - DNA, 672 bp, Zea mays
  misc_feature: Ceres CLONE 297321
  misc_feature: Encodes the peptide sequence at SEQ ID NO. 4176
actctcgtctcctgttcgccagagccacctcgctccagaagctttcctcccctagatctccctcccgtgcccggtcgcgctgccgacccggccatggccaccaaggggaagctcggggagctagtgtgggagcaccgggtgcaggcggccgcagcggtggctttcgtggccgcggccgccgtctcgatctccgccgtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccggaggaggaggctgacagcagcctagctgtgctgtgtgctgctgcgtggcatggcgtgctccgtccccgggtgaacttcctccagtggcacgggtgggggcaaccgttgcgggcccacctgtaagtgtcaggccggcgcgccgccgtggctcggtagcctaggacttctccatgtcttgctctgctccggtgtaagataccgtggattttaataatgaatcatggcataaaacaaaaaaaaaaaaaaaa

SEQ ID NO: 4176 - protein, 106 aa, Zea mays
  misc_feature: Ceres CLONE 297321
MATKGKLGELVWEHRVQAAAAVAFVAAAAVSISAVSFFWPLLVSTGLFLVAVAVLLRISPPPAGDDDESGKELIDFVAGCRPEHLVPDAAPPAAVAPVEAPPELQI

SEQ ID NO: 4177 - DNA, 180 bp, Zea mays
  misc_feature: Ceres CLONE 297329-F
  misc_feature: Encodes the peptide sequence at SEQ ID NO. 4178
  misc_feature (168)..(168): n is a, c, t, g, unknown, or other
aaccctgatccagtgctagcatcgcatcgcatcacgccatcaccatgggcctctgcctgtycgtggctctctggaaggagaagctctacggcgccgacggscagcagcsgttcgtgcggggccgcgtcgtcgtccataaggttgccggcgtggagggtggtgactgcnagtacgggatct

SEQ ID NO: 4178 - protein, 45 aa, Zea mays
  misc_feature: Ceres CLONE 297329-F
  misc_feature (6)..(6): Xaa is any aa, unknown, or other
  misc_feature (22)..(22): Xaa is any aa, unknown, or other
  misc_feature (42)..(42): Xaa is any aa, unknown, or other
MGLCLXVALWKEKLYGADGQQXFVRGRVVVHKVAGVEGGDCXYGI

SEQ ID NO: 4179 - DNA, 420 bp, Zea mays
  misc_feature: Ceres CLONE 297355-F
  misc_feature: Encodes the peptide sequence at SEQ ID NO. 4180
gatttcgattctttctttttcccccaacgtgcgccgccgcgaccttcctcgatcccatctcccaacgcccccgcctcgcctcgggatcccgccgccgctccatctgcctttgctcccccacccgcagcagcgagcgacavtcggcgagggatggccaaggccaggtcgttggcgamagaagcaggcgcacaatcaaacggcggcggcggccacsgctgtcctccaagctcgcccggtacctcgacccggagcctccttggacaaggaccaactgctggacgcggtgcactggatccgccagcggtggggctcatatgcggcctgctctggggaccgtccccgtcgtcggcgccgtctggatcgcactatttatggccatctcgactggcattatctattggtactacacctacttgctga

SEQ ID NO: 4180 - protein, 139 aa, Zea mays
  misc_feature: Ceres CLONE 297355-F
  misc_feature (46)..(46): Xaa is any aa, unknown, or other
  misc_feature (58)..(58): Xaa is any aa, unknown, or other
  misc_feature (71)..(71): Xaa is any aa, unknown, or other
FRFFLFPPTCAAATFLDPISQRPRLASGSRRRSICLCSPTRSSERXSARDGQGQVVGXRSRRTIKRRRRPXLSSKLARYLDPEPPWTRTNCWTRCTGSASGGAHMRPALGTVPVVGAVWIALFMAISTGIIYWYYTYLL

SEQ ID NO: 4181 - DNA, 121 bp, Zea mays; identical to SEQ ID NO: 2422
  misc_feature: Ceres CLONE 297357-F

SEQ ID NO: 4182 - DNA, 123 bp, Zea mays
  misc_feature: Ceres CLONE 297389-F
acgcacaccgcgacccagtccagagccagtacgtgcgavgcacgcacgctgctggtccgcgtacsagacgacggtcaggtcggccggtgcttttcagtttggaataatgacggcgacgacgac

SEQ ID NO: 4183 - DNA, 476 bp, Zea mays
  misc_feature: Ceres CLONE 297394-F
  misc_feature: Translation starting site: 92
  misc_feature: SWISSPROT Homolog: EC 3.4.21.97 Assemblin
aatctcccaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtyggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggctacctcgtcggcctcttcgagacaccaacctctgcgccatccacgccaagcgcgtcaccatcatgcccaaggacattcagctcgcccgc

SEQ ID NO: 4184 - DNA, 167 bp, Zea mays
  misc_feature: Ceres CLONE 297406-F
  misc_feature (35)..(35): n is a, c, t, g, unknown, or other
acaccaagaatcacacaacagcagctcaaaawacncaacacacctcaacaagcagagcaaagacccgggattcgccggcgcggtasagaagcrgakatggacgggaggatgttcggtctcgagacccccctgatggtggcgctgcagcaccttctggacgtgcccga

SEQ ID NO: 4185 - DNA, 267 bp, Zea mays
  misc_feature: Ceres CLONE 297412-F
  misc_feature: Encodes the peptide sequence at SEQ ID NO. 4186
acaacaccagaatccgcgaatcacagacgcgtctatctcagcttgctgcactgcactaccctgccctgccatcatatcgtacgtgagcccggccgagcgagasmgggagaaggcatggctgctccgaagctcgcgacgctggcgctggccgtgctcctggcggcgaccgtggtggctcccccggccgcggtgcgcgcgsatgtcgtgctccaccgtgtacagcacgctgatgccgtcctgccgttcgtccagatgggcggggccatg

SEQ ID NO: 4186 - protein, 51 aa, Zea mays
  misc_feature: Ceres CLONE 297412-F
  misc_feature (29)..(29): Xaa is any aa, unknown, or other
MAAPKLATLALAVLLAATVVAPPAAVRAXVVLHRVQHADAVLPFVQMGGAM

SEQ ID NO: 4187 - DNA, 119 bp, Zea mays
  misc_feature: Ceres CLONE 297418-F
acacgcacaccgcgacccagtccagagccagtacgtgcgamrgcacgcacgctgctggtccgcgtacsagaacgacggtcaggtcggccggtgcttttcagtttggaataatgacggcg

SEQ ID NO: 4188 - DNA, 460 bp, Zea mays
  misc_feature: Ceres CLONE 297493-F
  misc_feature: Translation starting site: 339
  misc_feature: Pfam Name: DPBB_1 Pfam Description: Rare lipoprotein A (RlpA)-like double-psi beta-barrel
  misc_feature (61)..(61): n is a, c, t, g, unknown, or other
  misc_feature (62)..(62): n is a, c, t, g, unknown, or other
  misc_feature (106)..(106): n is a, c, t, g, unknown, or other
  misc_feature (251)..(251): n is a, c, t, g, unknown, or other
actccccagtccccatagactccagcctgagctgcaccgtgagcgctcgccgctccgcatnncgtcccagtcccacaccccgcatccagcctgccccagcgtaatnggcgcttcgcaggccgtcctcctggccgtggtcctcgccgcgctgctcccgctcgccctctctcgcgggttgggcttggtgcacgggcatgtgcggccgacacgcacgggctggggctcggccaccaccacgcccagccgcaytnsgcacccgcacggcacgcaccgctcgtaggtggcgcgtggtcctctgctcacgccaccttctacggcggcggcgacsgtccggcaccatgggcggtgcgtgcgggtacggcaacctctacagccaggggtacggcaccaacacggcggcgctgagcacggcgctcttcaacaacgggctcagctgcggcgcctgcttcgaggtgcgctg

SEQ ID NO: 4189 - DNA, 642 bp, Zea mays
  misc_feature: Ceres CLONE 297498
  misc_feature: Encodes the peptide sequence at SEQ ID NO. 4190
atctttttactttctttctccctcttctcttcttctgcccgaaggacaggggtggtggcggctcaaccgcggccgtgtccgtgctccgatggtggtggtgcgctcgagcccgggttcctttgggccggagctgcgaggcggtgccctgtgcctgcgtggctgtgctgckgctacgccgctctgtggctgtgctgcgtgctacgccgctctgcgcctgcgtgctcgtgccgtggctggtgcacacactgcaactttcaacagcacagtccttcaacttcgacacatgcagggcgacaggccgacagccagtggccgtgcgcctgctcacggcggcggcgtgcaccatcgacaaggcccacacccatgtgttcgcatgctctggcgcggcggctatggctcatagaatttcacggtaattacaaaaacatgactaaagcttgttcacatgccagtatgccatgtgcttgaccagtagtgaaagtgtcaactcctctctgcttctttctgttaggctgtagtgccgaagccattagaacatatgacgctttttcttcctggcttctttgtaatttgcatgtcagcttcaagccaacagataaaatatgctatagagatgtttttcttttaaaaaaaaaaaaaaaa

SEQ ID NO: 4190 - protein, 104 aa, Zea mays
  misc_feature: Ceres CLONE 297498
  misc_feature (27)..(27): Xaa is any aa, unknown, or other
MVVVRSSPGSFGPELRGGALCLRGCAXATPLCGCAACYAALRLRARAVAGAHTATFNSTVLQLRHMQGDRPTASGRAPAHGGGVHHRQGPHPCVRMLWRGGYGS

SEQ ID NO: 4191 - DNA, 412 bp, Zea mays
  misc_feature: Ceres CLONE 297504-F
  misc_feature (60)..(60): n is a, c, t, g, unknown, or other
  misc_feature (62)..(62): n is a, c, t, g, unknown, or other
aactagctgccagccgcgcgcccgccgctacctgctcgcatccagcgccccgccgccacndntcgcggtgatctatgtgggcgacgtccacggctacatcacgaagctggagagcctgttccaacctctaggccgcactccccgccgacgccttggccaccgcgctggtcatcttcctcggcgactacaacgaccgcggcccgcacacccgcagktctcaactttctcctcgcgctcccgacgcgctacccagcgcagscatgtcttcctctgcggcaaccatgacctcgccttcgtggcgttcgttggggcgctgccgctgccgccaacgstccctgttctttggccacctgcgcagccatctctctgtcctccctctctcgctcatcctcccccaccgccctgcttattt

SEQ ID NO: 4192 - DNA, 426 bp, Zea mays
  misc_feature: Ceres CLONE 297526-F
  misc_feature: Encodes the peptide sequence at SEQ ID NO. 4193
  misc_feature (89)..(89): n is a, c, t, g, unknown, or other
atacgggcccgtgtctcagcgcacacctcttcgtgctcgctcccatggaggccaccccgatctccatgaagccaccggcgccggcgcsncsacccccggtcactctggagcccatagaattgtcaacgcatgccgtcggagtgaccgagctggagcgattccagcatgaaccagctcgcaatagcgccggaccccaagcggcagagggtggaggaggctgcggatggcaacgggtgcaagcatttgcgcctgcaagaaggtccagatgcttgaagctctattgcccatgttttgctggaggtggttattggttccgataagtgtggctgccaaccatgtttcaacaaagaagcctttttcagaaacagttcagactactcgcaaggtgttactttcaagacagaagcgcatgtcgatgawaattaa

SEQ ID NO: 4193 - protein, 91 aa, Zea mays
  misc_feature: Ceres CLONE 297526-F
  misc_feature (15)..(15): Xaa is any aa, unknown, or other
  misc_feature (16)..(16): Xaa is any aa, unknown, or other
MEATPISMKPPAPAXXPPVTLEPIELSTHAVGVTELERFQHEPARNSAGPQAAEGGGGCGWQRVQAFAPARRSRCLKLYCPCFAGGGYWFR

SEQ ID NO: 4194 - DNA, 448 bp, Zea mays
  misc_feature: Ceres CLONE 297552-F
  misc_feature: Encodes the peptide sequence at SEQ ID NO. 4195
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakntgtcatgcaggactacgtcgtcgacggcttcatgaagaacgaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtygtgcgtccg

SEQ ID NO: 4195 - protein, 43 aa, Zea mays
  misc_feature: Ceres CLONE 297552-F
  misc_feature (41)..(41): Xaa is any aa, unknown, or other
MSDEILKNYPELAQEGLPTMNQRLDISNAAVTRWRRRRPCXAS

SEQ ID NO: 4196 - DNA, 423 bp, Zea mays
  misc_feature: Ceres CLONE 297599-F
  misc_feature: Encodes the peptide sequence at SEQ ID NO. 4197
ctcacacaacsaagctcgatccatctcactctccgctggtcgctcactcttgcagctccacccttcactcagtcttagtctcttattagctctaggctctagctagccgcgccactccttcgtgtagccatcagccttctcatcgythaccaatggccactgccgaggtccagaccccgaccgtcgtggcggccgaggaagcgcccgtggtggagaccccgccgccggccgtcgtgcccgaggagtctgcccccgccgaggccgaggccgagscgaggtgctgctcctgctgatcccgaggagcttcccgcggccgagcagcaggcagccgccgaggcgtaggccgcggctcctgctggtgccgaggagcccgtcgcggccgaaccggscgaaggcgaaggctgctgctcctgctggtcccga

SEQ ID NO: 4197 - protein, 46 aa, Zea mays
  misc_feature: Ceres CLONE 297599-F
  misc_feature (41)..(41): Xaa is any aa, unknown, or other
MATAEVQTPTVVAAEEAPVVETPPPAVVPEESAPAEAEAEXRCCSC

SEQ ID NO: 4198 - DNA, 1428 bp, Zea mays
  misc_feature: Ceres CLONE 297645
  misc_feature: Encodes the peptide sequence at SEQ ID NO. 4199
tttttctttccacctcgcgcctcgcctcgcctctcccaccatggcctccgccgccgccgccctctaccggagcccctccttgctgagccgccgccacctcctcatccgcctcctctccacgcagacccagctcgtcaccccaccgacgcccaccaccccggccgacctgtcccgcctcaagtcctccatccgcgacgccgccaccaccccggacgcgcttgccaccctgttcctctcgggcctcccgcacccggccttcctcgccgaccgtccgctcttcgcgctctccgtgcaccgcctcgcctccgccggccgccgcgacctcgtcgcctccgtcctctcctcctccctcaccgccctccccagcccacacccgtccgagggattcctcctacgcctcatctccctctactcggccgcaggtatgcccgaccactccctcgccgtcttccgcctcgtcaagcccgcctccgaccgcgccctctccgcgctcctatccgcctaccacgacaaccgcctttacgaccgcaccgtccgggccttcaacaccctccccgccgagctcggtatcaagccgggactcgtctcccacaacgtcctcctcaaggccctcgtcgccagcggggacgtcgccgcagcccacaccttattcgacgaaatgcctgacaccgctggcgtccaaccggacatcgtctcctgcaacgagatcctcaagggctacctcaacgccggcgacgccgacgcctttgatcggctagtcaaggagatcgctggtccgaaaaggcgcctgaagcctaatgtcgggacctacaacctccggatggccctgctgtgctccaaaatgaggagctttgaagctgaagaactgttggatgtcatgggggcaaacggcgtcccgcccaaccgcacgagcttcaacacggtcatcaaggggctctgcaacgagggggaggtgggcgctgccatggctctcttcaagaggatgccggaggtgcccaggcagcacggcaaaggggtctcccccaactttgagacctacattatgctgctcgaggctcttgtcaagaagaatttgtttgatcctgcgctggagatctgcaaggagtgcctgcgcaacaagtgggcgccgccattccaagctgttaaaggtttggttcagggtttgctcaagagcaggaaggccaagcacgcaagggaggttttcatggccatgagaaaggctgtcaagggtgacgccaagcaggagtggatcaaggttgaggctcagttcccgatgttgcttgctgacaagaaagcctaaccaccaggatcattttgcagcctacatctgttattgctcaaaatggtttgttttagatgagctttgcattttaagttaattatgaaatgggtgactgttgatggtttaaaacaaaaaaaaaaaaaaaa

SEQ ID NO: 4199 - protein, 419 aa, Zea mays
  misc_feature: Ceres CLONE 297645
MASAAAALYRSPSLLSRRHLLIRLLSTQTQLVTPPTPTTPADLSRLKSSIRDAATTPDALATLFLSGLPHPAFLADRPLFALSVHRLASAGRRDLVASVLSSSLTALPSPHPSEGFLLRLISLYSAAGMPDHSLAVFRLVKPASDRALSALLSAYHDNRLYDRTVRAFNTLPAELGIKPGLVSHNVLLKALVASGDVAAAHTLFDEMPDTAGVQPDIVSCNEILKGYLNAGDADAFDRLVKEIAGPKRRLKPNVGTYNLRMALLCSKMRSFEAEELLDVMGANGVPPNRTSFNTVIKGLCNEGEVGAAMALFKRMPEVPRQHGKGVSPNFETYIMLLEALVKKNLFDPALEICKECLRNKWAPPFQAVKGLVQGLLKSRKAKHAREVFMAMRKAVKGDAKQEWIKVEAQFPMLLADKKA

SEQ ID NO: 4200 - DNA, 496 bp, Zea mays
  misc_feature: Ceres CLONE 297650-F
  misc_feature: Encodes the peptide sequence at SEQ ID NO. 4201
gttccgtcgccccgcattgctcgcccagagttcttgtttaggcaaaggcaaaagcaggagcaaaaaggtttcgttggcgatggcaagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcawagaatcttttgawaatggtactcttcaccttattgggttgttgagtgatggtggtgtccactcccgc

SEQ ID NO: 4201 - protein, 139 aa, Zea mays
  misc_feature: Ceres CLONE 297650-F
  misc_feature (15)..(139): Pfam Name: iPGM_N Pfam Description: BPG-independent PGAM N-terminus (iPGM_N)
  misc_feature: SWISSPROT Homolog: EC 5.4.2.1 Phosphoglycerate mutase
  misc_feature (117)..(117): Xaa is any aa, unknown, or other
  misc_feature (121)..(121): Xaa is any aa, unknown, or other
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIXESFXNGTLHLIGLLSDGGVHSR

SEQ ID NO: 4202 - DNA, 341 bp, Zea mays
  misc_feature: Ceres CLONE 297670-F
  misc_feature: Translation starting site: 67
atctccctgtttaatcaatccttcaagcgcaastgcctcctcctcgtcgtccggtcgtgagaagggatggcgggccgtggcaaggctatcggcgctggcgccgaagaaggcaacgtcgaggagctccaaggccggactccagttccccgtcggcaggattgccaggttcctcaaggcgggcaaktacgcggagcgtccggcgccggcgcccccgtgtacctcgccgccgtcctcgagtacctcgcggctgaggttctcgaacttgccgggaacgccgcgaggkacaacaagaagacccgcattttgccgcgccacatccagcttgctgtgcgcaacgacga

SEQ ID NO: 4203 - DNA, 486 bp, Zea mays
  misc_feature: Ceres CLONE 297687-F
  misc_feature: Encodes the peptide sequence at SEQ ID NO. 4204
atccacacacacacatccatcaacgaaacaagcgcacaagaaaaaatacctcgccgccaacaatggcctccatgtcctccatcctgctcgcaacggcgatgctggctgcgctgtttgcggttggtttgtgcaccaccccgctcaccttccaggttggcaagggatccaagcctggccacctgatcctcacccccaatgttgcaaccatatccgatgtggaaatcaaagagcacggtggcgatgacttctcctttacgctcaaggagggaccgaccggcacctggacgctcgacaccaaggcctcgctcaagtaccccctttgcatccgctttgctgtcaagtctggtggctaccgcatcgccgacgacgtcatccccgccgatttcaaggccagcaccacctacaagaccacactcagcatctaattagcctctcatgatgaattagatttcaaaagagctcatctggcgcacatgttagcaagac

SEQ ID NO: 4204 - protein, 120 aa, Zea mays
  misc_feature: Ceres CLONE 297687-F
  misc_feature (27)..(105): Pfam Name: Pollen_allerg_1 Pfam Description: Pollen allergen
MASMSSILLATAMLAALFAVGLCTTPLTFQVGKGSKPGHLILTPNVATISDVEIKEHGGDDFSFTLKEGPTGTWTLDTKASLKYPLCIRFAVKSGGYRIADDVIPADFKASTTYKTTLSI

SEQ ID NO: 4205 - DNA, 469 bp, Zea mays
  misc_feature: Ceres CLONE 297733-F
  misc_feature: Encodes the peptide sequence at SEQ ID NO. 4206
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaaggcaaggaaggttgtaggctgctcctgtgtcgtcgtcaaggactacggtgaagaatct

SEQ ID NO: 4206 - protein, 97 aa, Zea mays
  misc_feature: Ceres CLONE 297733-F
  misc_feature (1)..(90): Pfam Name: Ribosomal_L7Ae Pfam Description: Ribosomal protein L7Ae/L30e/S12e/Gadd45 family
  misc_feature (50)..(50): Xaa is any aa, unknown, or other
MKKSSAHDGLVKGLREAAKAIEKHAAQLCVLAEDCDQPDYVKLVKALCAXTMFTWSLFLPLRPLASGLGFARLTLRAKARKVVGCSCVVVKDYGEES

SEQ ID NO: 4207 - DNA, 462 bp, Zea mays
  misc_feature: Ceres CLONE 297740-F
aggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagatgagccgtggtggtagtgccggtggtggtcaaagttctctgggttatctctttggaagcggtgagccccccaaaccagcagtggcaccagctgcaagtgctccacctgttgagaaaccatctctgcaaagactgatgcggccaagcaggttgctgctggggttaccagccaaaccaataactaccacagggctgatggtcagaacactggcaacttccttacggaccgtc

SEQ ID NO: 4208 - DNA, 495 bp, Zea mays
  misc_feature: Ceres CLONE 297750-F
  misc_feature: Encodes the peptide sequence at SEQ ID NO. 4209
attcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagatcgcctgckcgcaggacgsttgagacacaagtcatcatcatcctatcccacggtgaccgtgaagccctaggagtgcaggggtcgtcgttcctggtgaacgtgttctccgacaagagctgcccggggctgctcgtcgccgtgcttgaggccttcgacgagctggggctcagcgtgctccaggccaccgc

SEQ ID NO: 4209 - protein, 60 aa, Zea mays
  misc_feature: Ceres CLONE 297750-F
  misc_feature (58)..(58): Xaa is any aa, unknown, or other
MMSRERKKAAALQEKLKILRSITHSHALSNTSIIMDASAYIKELKQKVVRLNQEIACXQD

SEQ ID NO: 4210 - DNA, 382 bp, Zea mays
  misc_feature: Ceres CLONE 297751-F
  misc_feature: Encodes the peptide sequence at SEQ ID NO. 4211
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (250)..(250): n is a, c, t, g, unknown, or other
  misc_feature (251)..(251): n is a, c, t, g, unknown, or other
  misc_feature (254)..(254): n is a, c, t, g, unknown, or other
agattcacttcgccactccgttgccctctcctccgncgaccnntcctttccccgtctgagatggcatctccggcatcggcgtcgcttaaggaagccgtgggcagcctcgaccgcgacggctttgttggtctcctctccaacctcatcggcgagaccgcacacctgcagaacgacccgccgacctacaggcctcaggaggagcgcgtggcgagcacgtagtcgacgtgctccgcccggtgtccgcggacanngkncgkccccctccttgtgcggaagataagctacgccgagggcaggagcaacgtcatcgttgaataccccggcaccgtcccaggccgcgttgtctccttcgtcggcatgcacatggacgtcgtcctgccaa

SEQ ID NO: 4211 - protein, 52 aa, Zea mays
  misc_feature: Ceres CLONE 297751-F
MASPASASLKEAVGSLDRDGFVGLLSNLIGETAHLQNDPPTYRPQEERVAST

SEQ ID NO: 4212 - DNA, 454 bp, Zea mays
  misc_feature: Ceres CLONE 297754-F
  misc_feature: Encodes the peptide sequence at SEQ ID NO. 4213
  misc_feature (155)..(155): n is a, c, t, g, unknown, or other
  misc_feature (160)..(160): n is a, c, t, g, unknown, or other
aagctcaggcaagcggcasaaggcgttggcaatcccagtccagtcgtcggagcactcgcaatttcccgtcacagctggccaccgccccaccctcacggcctcacctcctcccgctacacgcacgcgcccacctacccaaaacgaccgcgcgcgtncctbntcmcgcggtgccaccaccaccaccacctcgtcggaccatcaccacaccgatcggcagctaagcagctcccgcctccagcaccgcgagcggcgatggcaatggacgcggccgtggcgtgaagagcggcggtggcggcgcggatcgaccggggtcaccgcggcggcctcgcagtccccgcagcgggcgactaacggcggcgagcggcggtcccggttccagcgcatctgcgtgtactggcggcagcgccaaggggccggaagcctagctaccagggacgccgccgtcgagctgggc

SEQ ID NO: 4213 - protein, 151 aa, Zea mays
  misc_feature: Ceres CLONE 297754-F
  misc_feature (6)..(6): Xaa is any aa, unknown, or other
  misc_feature (52)..(52): Xaa is any aa, unknown, or other
  misc_feature (53)..(53): Xaa is any aa, unknown, or other
SSGKRXKALAIPVQSSEHSQFPVTAGHRPTLTASPPPATRTRPPTQNDRARXXSRGATTTTTSSDHHHTDRQLSSSRLQHRERRWQWTRPWREERRWRRGSTGVTAAASQSPQRATNGGERRSRFQRICVYWRQRQGAGSLATRDAAVELG

SEQ ID NO: 4214 - DNA, 105 bp, Zea mays
  misc_feature: Ceres CLONE 297774-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttgg

SEQ ID NO: 4215 - DNA, 475 bp, Zea mays
  misc_feature: Ceres CLONE 297800-F
  misc_feature: Encodes the peptide sequence at SEQ ID NO. 4216
aattgcccccctcacacacacacactctctctctctccccccattgtgtcactgtaactagcaattgagctcttaaaattttggttgaggtgcagtagcaaggcacactactacgatctacaaacaagatgatcagttgatgcccggtgtcttcaggatcttttcaggttcgcgaggtcccattttgcttctccccccgggcttgcagttgcgtttgagtgcacctctgaggctttggttggccctcgcgctgcgtacttaagctctccgctccctccacggcgttgcatctctcatggcactcggtgtctcctgatagctgctgcttcgatctactccacctaaccgaaagagcgtcgtgtagggtcttggattcttggtccagtgctgttggcctgtttyttgakatcgaagatccaggagatgatcctgcggcggagatcgaggtckatgaacagcagcgccggckcccaga

SEQ ID NO: 4216 - protein, 40 aa, Zea mays
  misc_feature: Ceres CLONE 297800-F
MPGVFRIFSGSRGPILLLPPGLQLRLSAPLRLWLALALRT

SEQ ID NO: 4217 - DNA, 806 bp, Zea mays
  misc_feature: Ceres CLONE 297856-R
  misc_feature (1)..(1): n is a, c, t, g, unknown, or other
  misc_feature (86)..(86): n is a, c, t, g, unknown, or other
ntttttgtttatttgggtgattttcatcaatatgaatctcgtagcactcgatgttagaaaaagaggaaaggggcggggttgttgtnttttcgaattgggtacgggccccccctcgaggtcgacggtatcgataagcttttttttttttttttttgaactaggaatcgtttgtttggagttctataaccacatccgatcagtgcccgcttacttaatttgaggatatcgaactgaagacaacagacctagcatgcccagagagatcataccgaccaaactacgacgaaagcagttagatgaaattaggacatctctaaaccttcaaaatcaagccaaccgacatgaactatgacaaaactacatagacgaccttaccacatataacaaaggaattcgattgcacccgtacattgaactgttatacataaccaaggatgactatggctagggacgtgacctccctgcaggaacataaaataaaactgaaaaccaagaatgaacaaatgccacagaacgatgctgaggaaggttagacggggaagtctcaacgaaacctatgaagcaaattacacagaattagcatcctaagggccacggagcggctttcagcgtgaggccctccatgggcaacccctccatcaaaactcgaagcatcggattgaggcaaggtcaacacccctcacggaaacaaagcccccattgaaagcattccatcaatggattgaggaccccgcttactggggcaataccatagaaaacccttcaactcctggaaccctggggcccacccctggaacccgcctgga

SEQ ID NO: 4218 - DNA, 136 bp, Zea mays
  misc_feature: Ceres CLONE 297878-F
acacgcacaccgcgacccagtccagagccagtacgtgcgavgcacgcacgctgctggtccgcgtacsagacgacggtcaggtcggccggtgcttttcagtttggaataatgacggcgacgacgacgacagccgccg

SEQ ID NO: 4219 - DNA, 328 bp, Zea mays
  misc_feature: Ceres CLONE 297901-F
  misc_feature: Encodes the peptide sequence at SEQ ID NO. 4220
  misc_feature (144)..(144): n is a, c, t, g, unknown, or other
acacaaccaagctcgatccatctcactctccgctggtcgctcactcttgcagctccacccttcactcagtcttagtctcttattagctctaggctctagctagccgcgccactccttcgtgtagccatcagccttctcatcgynaccaatggccactgccgaggtccagaccccgaccgtcgtggcggccgaggaagcgcccgtkgtggagaccccgccgccggccgtcgtgcccgaggagtctgcccccgccgaggccgaggccgaggcgaggstgctgctcctgctgatcccgaggagcttcccgcggccgagcagcaggcagccg

SEQ ID NO: 4220 - protein, 60 aa, Zea mays
  misc_feature: Ceres CLONE 297901-F
  misc_feature (43)..(43): Xaa is any aa, unknown, or other
MATAEVQTPTVVAAEEAPVVETPPPAVVPEESAPAEAEAEARXLLLLIPRSFPRPSSRQP

SEQ ID NO: 4221 - DNA, 167 bp, Zea mays
  misc_feature: Ceres CLONE 297951-F
cccgacctctttccaaaccggcaaatcctcagatccgccccctcctccgcytccgcctcctgtaccctcacgcggtgcttccacagccctcccacctccgaatccagmtccgccgccaccarctcctgcttctcacctcctaggctgcttcgcgcgacaacctccgc

SEQ ID NO: 4222 - DNA, 484 bp, Zea mays
  misc_feature: Ceres CLONE 298015-F
  misc_feature: Encodes the peptide sequence at SEQ ID NO. 4223
ctctctctttctctctctctcgtggcggcgctgggcagccgtcgctgcgcctgcgctaggtgccaggtcttcttcgggcccttcgccggcgacgagtaccaccaggttgtacatgtgtacacccatgtgctttactgggtcggaccctactcatccagtcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacaagggtctttatacaaccttaccctcgatgaggtgcagaaccatttgggggagccattgcttagcatgaattttkatgagctcctgaagagcgtg

SEQ ID NO: 4223 - protein, 58 aa, Zea mays
  misc_feature: Ceres CLONE 298015-F
  misc_feature: The sequence is a functional homolog of SEQ ID NO 1538 in the 10/412,699 US patent application
  misc_feature: The sequence is a functional homolog of SEQ ID NO 1537 in the 10/412,699 US patent application
  misc_feature: The sequence is a functional homolog of SEQ ID NO 1539 in the 10/412,699 US patent application
  misc_feature: The sequence is a functional homolog of SEQ ID NO 1541 in the 10/412,699 US patent application
  misc_feature: The sequence is a functional homolog of SEQ ID NO 1540 in the 10/412,699 US patent application
  misc_feature: The sequence is a functional homolog of SEQ ID NO 2542 in the 10/374,780 US patent application
  misc_feature: The sequence is a functional homolog of SEQ ID NO 268 in the 10/225,066 US patent application
  misc_feature: The sequence is a functional homolog of SEQ ID NO 750 in the 10/412,699 US patent application
  misc_feature (52)..(52): Xaa is any aa, unknown, or other
MSSQTGGGKESDAGPGQHRQMQSLARQGSLYNLTLDEVQNHLGEPLLSMNFXELLKSV

SEQ ID NO: 4224 - DNA, 282 bp, Zea mays
  misc_feature: Ceres CLONE 298111-F
  misc_feature: Encodes the peptide sequence at SEQ ID NO. 4225
  misc_feature (201)..(201): n is a, c, t, g, unknown, or other
atgcatcccatccccattcccatccatagagctgcgggcggcctgcgctgcatgcagccaacaagctcaycagctcaccgtacctaggaagacgaccgagctagctaaggtagtagtagctagctagccagtgatggcgggctacaaagcgcagggcggggcgctcgtcgtcgtcctggctgtcgccgcgctcttcgcggncasgattggcgatggcggtggacgacgagcacatgtaccactggaagtgcttcaagtcgtgcacggggaactgccgcaacg

SEQ ID NO: 4225 - protein, 49 aa, Zea mays
  misc_feature: Ceres CLONE 298111-F
  misc_feature (23)..(23): Xaa is any aa, unknown, or other
  misc_feature (24)..(24): Xaa is any aa, unknown, or other
MAGYKAQGGALVVVLAVAALFAXXIGDGGGRRAHVPLEVLQVVHGELPQ

SEQ ID NO: 4226 - DNA, 87 bp, Zea mays
  misc_feature: Ceres CLONE 298112-F
  misc_feature (63)..(63): n is a, c, t, g, unknown, or other
tccaacagaccaacagcatctaatcaatcaagacagccccgtgctagctcacccgccgggctngccacgatgagaggcctcctcgcg

SEQ ID NO: 4227 - DNA, 465 bp, Zea mays
  misc_feature: Ceres CLONE 298114-F
  misc_feature: Encodes the peptide sequence at SEQ ID NO. 4228
atccccttcctattctgctttcccctcgctccagagtccagtccccagacgagcggttggagcttcgacgtgcggtttccatttccttccctgctctgatggccgtcgccgaagtggcgatcgakattctcccgcagcagcagcagcagccgccgccgccgccgccgccgcggaaccggcgttagcgcccccgaacctctccgtgccgagagtgctccagtatctgtacctcttgagcgcgtgggtcgcctgcgcgggcgtggctgccgggaccgtggcgcgccgagccttgggcgactcttccccgttggtctacgggttcctcaaagtctcgatcggagccctcgttttccccgcgctgctcatcctcgtcttcgccctgcgggtcttgcgcgccatgcttgckggtggggttcagacggtcactccgcactcacgccagggagattcakatccaagcyacga

SEQ ID NO: 4228 - protein, 153 aa, Zea mays
  misc_feature: Ceres CLONE 298114-F
  misc_feature (42)..(42): Xaa is any aa, unknown, or other
  misc_feature (151)..(151): Xaa is any aa, unknown, or other
SPSYSAFPSLQSPVPRRAVGASTCGFHFLPCSDGRRRSGDRXSPAAAAAAAAAAAAAEPALAPPNLSVPRVLQYLYLLSAWVACAGVAAGTVARRALGDSSPLVYGFLKVSIGALVFPALLILVFALRVLRAMLAGGVQTVTPHSRQGDSXPS

SEQ ID NO: 4229 - DNA, 291 bp, Zea mays
  misc_feature: Ceres CLONE 298181-F
  misc_feature: Translation starting site: 114
acaacaccagaatccgcgaatcacagacgcgtctatctcagcttgctgcactgcactaccctgccctgccatcatatcgtacgtgagcccggccgagcgagavgggtagaggcatggctgctccgaagctcgcgacgctggcgctggccgtgctcctggcggcgaccgtggtggctcccccggccgcggtgcgcgcggatgtcgtgctccaccgtgtacagcacgctgatgccgtgcctgccgttcgtccagatgggcggggccatgccgccccagccgtgctgcggcgca

SEQ ID NO: 4230 - DNA, 230 bp, Zea mays
  misc_feature: Ceres CLONE 298245-F
  misc_feature: Encodes the peptide sequence at SEQ ID NO. 4231
  misc_feature (35)..(35): n is a, c, t, g, unknown, or other
  misc_feature (92)..(92): n is a, c, t, g, unknown, or other
acaccaagaatcacacaacagcagctcaaaaaacnaacacacctcaacaagcagagcaaagacccgggattcgccggcgcggtasagagcrngagatggacgggaggatgttcggtctcgagacccccctgatggtggcgctgcagcaccttctggacgtgcccgacggcgacgcskccgggcggcgacaaggcgagtggtgccgcggcgggcgcgggcccacgcgcacc

SEQ ID NO: 4231 - protein, 45 aa, Zea mays
  misc_feature: Ceres CLONE 298245-F
  misc_feature (28)..(28): Xaa is any aa, unknown, or other
MDGRMFGLETPLMVALQHLLDVPDGDAXGRRQGEWCRGGRGPTRT

SEQ ID NO: 4232 - DNA, 190 bp, Zea mays
  misc_feature: Ceres CLONE 298246-F
aacctctagctgattgatctctggtatttaccatactttccttccttccttccttcaattctaaatascacaaatgcaaagttgctttgcgatsgtgagcagcaggcwyggacacgacgagtgacaagcgtgcgtcatccatgctggcccctaamcctggcaaggccacgatcctcgcccttggccacgc

SEQ ID NO: 4233 - DNA, 335 bp, Zea mays
  misc_feature: Ceres CLONE 298250-F
  misc_feature: Encodes the peptide sequence at SEQ ID NO. 4234
agaaaatcagtctccccttccaaaaccggatttgcgaaccacacctagcagccgaggttagcacgcgtcctgcggccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgccgcgctccgsagatgcaggccaaggttgccaaggagatgcaaggtgtagatcccaatgcaaccacatctgawaacaaagacggagatggattctcggtcagtattcattgga

SEQ ID NO: 4234 - protein, 64 aa, Zea mays
  misc_feature: Ceres CLONE 298250-F
MEDEEHEVYGQEIPVDGEDVDMAAGDDATKLQELDDMKRRLKEMEEEAAALRRCRPRLPRRCKV

SEQ ID NO: 4235 - DNA, 762 bp, Zea mays
  misc_feature: Ceres CLONE 298432-R
  misc_feature: Translation starting site: 277
gctgaccgggccccgccctcgaggtcgacggtatcgatatttttttttttgttttttgagcaaattcccatagtccactattaaaggtagattcatgtttgaagtacattaacaccaggcctaagtagcttctatttaacattcaggcagaagatgcaagagacacgcgccagtgttcggtgaggtcggtccatgctgcaaactctgagaaaacatacaaagggatgtatgtagtcttgtccgtaatggtaccatggcatcaactgtcattctaccatggcatcaactctctccttggcaggtggttttgaatttttggctttcttcctgcctttgccctttaatctctttatctgtattcttgagtttttcttcacactgaacgtcacttgggaagtgccctttgcagccccccaagacccttcaactgagatcatgtggacatcccccatgttgttctccagcgccttaatcatcgcagcctctttctgcttccggttgaggcggcgctcgagcttcttcttccgcttgccggacatggagacgggcgcggtcccgctgcttgagcttgccggtcccgggctccccatgcgcggcgcgcttgcggtcctgattgcactggcgcttgttcttctgcaccacgttgtacttggccctggcgtggtgacggccttggtgccctcggagacggggtgcttggccagctccccgggaaggacaaggcgcacggaagtctggatcctcccggaagtgaaggtggcg

SEQ ID NO: 4236 - DNA, 243 bp, Zea mays
  misc_feature: Ceres CLONE 298458-F
  misc_feature: Encodes the peptide sequence at SEQ ID NO. 4237
  misc_feature (43)..(43): n is a, c, t, g, unknown, or other
  misc_feature (82)..(82): n is a, c, t, g, unknown, or other
acaaacatgaagctaagactggtagcgctagtgctagcgtabncggtgtacgcttgctcgtcggcggcatcagcgttcgcgngggacgacgtcgtccgtgtcscgctaaagcatgtcgacgctgggaagcagctgtccaggcccgagctgatccggcgcgccatgcggcggascaaggcgagggcggccgcgctgtccgcgtgaggaaccgscccgcttctctggcaagaacgagcagcaaac

SEQ ID NO: 4237 - protein, 65 aa, Zea mays
  misc_feature: Ceres CLONE 298458-F
  misc_feature (12)..(12): Xaa is any aa, unknown, or other
  misc_feature (13)..(13): Xaa is any aa, unknown, or other
  misc_feature (26)..(26): Xaa is any aa, unknown, or other
  misc_feature (33)..(33): Xaa is any aa, unknown, or other
  misc_feature (56)..(56): Xaa is any aa, unknown, or other
MKLRLVALVLAXXVYACSSAASAFAXDDVVRVXLKHVDAGKQLSRPELIRRAMRRXKARAAALSA

SEQ ID NO: 4238 - DNA, 483 bp, Zea mays
  misc_feature: Ceres CLONE 298478-F
  misc_feature (214)..(214): n is a, c, t, g, unknown, or other
  misc_feature (258)..(258): n is a, c, t, g, unknown, or other
  misc_feature (259)..(259): n is a, c, t, g, unknown, or other
aacttgttcagggagttccactccactctcccataatgaggataggggcaggggcgaacatggctgcgtgctcctccgttccctgctccttccccgcgamsctgaccctcaccgccgaagccccagcgcatcttaagctctcatctccctcggctccctgctacccagtttcgtcggcttcgatcactctctgccgccgcctcgccgccgsatncgcctccgcccacgagcctccgtgtccacgtcgcccgccccgtnnaggactacgagttcactgacgggaacggagaggtggagctgagactggacatccaaaagctcggcatagcgagttcaaaagatgttttcgttgatgtcgatgacacattcctactcatcagagccaagtctgacgggacactgaggactttgatgaacgtccaaacactgtttgataggattwatgtyttccgagaccatatggttcatcgatgaggaccagtt

SEQ ID NO: 4239 - DNA, 500 bp, Zea mays
  misc_feature: Ceres CLONE 298501-F
  misc_feature: Translation starting site: 304
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctgtcccgcagtgt

SEQ ID NO: 4240 - DNA, 432 bp, Zea mays
  misc_feature: Ceres CLONE 298502-F
  misc_feature: Translation starting site: 258
  misc_feature (214)..(214): n is a, c, t, g, unknown, or other
  misc_feature (365)..(365): n is a, c, t, g, unknown, or other
  misc_feature (366)..(366): n is a, c, t, g, unknown, or other
attcccttctccatccacaactgtcctccacacacacccacacacgccacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgcacgggagccgaggcgcattngtgcgacccctccatcatcgccacccagatcgcgctvttctgcatgccggacatgcccacggsgccctgctgcgagccgatcatcgcctccgtcgacctcggcggcggcgtcccctgcctctgccgcgtcgccgcccaaccgcagctcgtnntcgcccgcctcaacgccacccacctcctcgcgctctacgcttcctgcggaggacaacacaccgtgg

SEQ ID NO: 4241 - DNA, 442 bp, Zea mays
  misc_feature: Ceres CLONE 298542-F
  misc_feature: Translation starting site: 61
caaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggt

SEQ ID NO: 4242 - DNA, 433 bp, Zea mays
  misc_feature: Ceres CLONE 298579-F
atcaaaggtgcagcttcaggaggagctctcgtggcgtcatagtctctggaaggtccaaattaagattagaagatggacgaggacgcgctgacggagatccttgckaggctgccgtgcaggtcgctggcgcggttccagtgcgtctccacgtcgtgctccgcatcatctcgagcgactacctccgccgccggctgccgctcatcacgtcgggggtgctctaccacgacgacacgcgccgcggcgacsacggcggcaggaggcagcaggtgtacacgtacgcgtgcgcgtcaggcggcggcgcaccgcaccgcacggcgtaggcccccgacatgggcttcttcccgcgccacgacacgtccaccatcatcgacggctgcaacgggctgctgctctactacgcgtcccgcccgacggggcgttccacgtcgtgaac

SEQ ID NO: 4243 - DNA, 374 bp, Zea mays
  misc_feature: Ceres CLONE 298598-F
  misc_feature: Encodes the peptide sequence at SEQ ID NO. 4244
  misc_feature (337)..(337): n is a, c, t, g, unknown, or other
acacaaccaagctcgatccatctcactctccgctggtcgctcactcttgcagctccacccttcactcagtcttagtctcttattagctctaggctctagctagccgcgccactccttcgtgtagccatcagccttctcatcgycaccaatggccactgccgaggtccagaccccgaccgtcgtggcggccgaggaagcgcccgtggtggagaccccgccgccggccgtcgtgcccgaggagtctgcccccgccgaggccgaggccgaggcgagggtgctgctcctgctgatcccgaggagcttcccgcggccgagcagcaggcagccgccgaggcgnaggccgcggctcctgctggtgccgaggagcccgtcgc

SEQ ID NO: 4244 - protein, 75 aa, Zea mays
  misc_feature: Ceres CLONE 298598-F
MATAEVQTPTVVAAEEAPVVETPPPAVVPEESAPAEAEAEARVLLLLIPRSFPRPSSRQPPRRRPRLLLVPRSPS

SEQ ID NO: 4245 - DNA, 377 bp, Zea mays
  misc_feature: Ceres CLONE 298613-F
  misc_feature: Translation starting site: 49
  misc_feature (64)..(64): n is a, c, t, g, unknown, or other
  misc_feature (122)..(122): n is a, c, t, g, unknown, or other
acatgcgttataacagcagagcagaggtcaacaagacgagacaagagaatgcctgtkagcaggntcgccgtgggttctccgggckagctgtcccaccccgacaccgccaaggccgccgtcgnvagttcatctccacgctcatcttcgtcttcgccggctcaggatcggggatggccttcagtaagctcacggacggtggcgccgcccatgcctgccggcctcatcgccgcgtctctggcgcacgcctcgccctcttcgtggccgtctccgtgggtgccaactatctccggcggccacgtgaaccctgccgtkaccttcggcgcctttgtgggcggcaacatcagyctcctcaaggccctggtctactgggtggccca

SEQ ID NO: 4246 - DNA, 231 bp, Zea mays
  misc_feature: Ceres CLONE 298650-F
  misc_feature (192)..(192): n is a, c, t, g, unknown, or other
  misc_feature (194)..(194): n is a, c, t, g, unknown, or other
aactcaacactcgagtactcgacacagcccctctgatatggctcaggcacgcgtgcgccttactccggccggccgcacgccgctcaacgtttcctctcgggctccaaccccagacccgcccacctcaccttcttcccgaagcttacccctacctccctctccgccgccggcagctgccaatgcgccgccgcnbnacatcgtcgtcgtgggctccgcaacgccgacatctac

SEQ ID NO: 4247 - DNA, 498 bp, Zea mays
  misc_feature: Ceres CLONE 298692-F
  misc_feature: Encodes the peptide sequence at SEQ ID NO. 4248
  misc_feature (196)..(196): n is a, c, t, g, unknown, or other
  misc_feature (197)..(197): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgyagcavnntgtcatgcaggactacgkcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgasagatggcgacggaggstccctgtcgtgcgtccgctcgtggggcggcgcgctctcgtccatcacccacctcgtgtacgtctcgtcg

SEQ ID NO: 4248 - protein, 138 aa, Zea mays
  misc_feature: Ceres CLONE 298692-F
  misc_feature (10)..(138): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (36)..(36): Xaa is any aa, unknown, or other
  misc_feature (37)..(37): Xaa is any aa, unknown, or other
  misc_feature (38)..(38): Xaa is any aa, unknown, or other
  misc_feature (44)..(44): Xaa is any aa, unknown, or other
  misc_feature (110)..(110): Xaa is any aa, unknown, or other
MVSSSMDTTSDKRASSMLAPNPGKATILALGHAFPXXXVMQDYXVDGFMKNTNCDDPELKEKLTRLCKTTTVRTRYVVMSDEILKNYPELAQEGLPTMNQRLDISNAAVXDGDGGSLSCVRSWGGALSSITHLVYVSS

SEQ ID NO: 4249 - DNA, 654 bp, Zea mays
  misc_feature: Ceres CLONE 298704-R
  misc_feature: Translation starting site: 232
  misc_feature: Pfam Name: PI3_PI4_kinase Pfam Description: Phosphatidylinositol 3- and 4-kinase
cggtatcgataagcttttttttttttttttttgggaggaaatagtacaccattctttgcattagccattgagttgattacatcgttattttgtcagccatgtgcatatctagaggctaacatgtcctttgatatgtcgtcgagacggcggtccatgatctccgagacagcctgcaagaagacagtctcgcatcctcctccccgttccgccgcctcacggacgatctcttcgatggcggactccttggtcagggtctctctgcacatgatgctcccgatgtggaagggggtgaggcccctctccacacccttcttcagcagcatggtggcgacgcgcagcgtgggcgcgcactcgcgcgacacctcccacccgtggagcctcaggggaggcacgtcctcctccggggtccagggagcgcacgtactccaccggctcgtcggtgaagggctggggggggggggggggggggcggggggggccgcggcgccggcgggggagggggggcgtgggcatgacggggggggggaatgcttgagcgacccggacgggagcgccacgcatcccaagcaggggtccggcgcgccgtgcgggcagcgccccccacactccccaccgagacttcgcgccgccccgcgacgggcgggggggcggcgg

SEQ ID NO: 4250 - DNA, 121 bp, Zea mays
  misc_feature: Ceres CLONE 298717-F
  misc_feature (43)..(43): n is a, c, t, g, unknown, or other
aaacgaaccactgggcacggccgcggctcgcaagtggcctgcnttcctcttccacgctccgcccacccgtcccggggcccgccgcaacccgatccctccccgcgctcaacgatgccggccg

SEQ ID NO: 4251 - DNA, 440 bp, Zea mays
  misc_feature: Ceres CLONE 298725-F
  misc_feature: Encodes the peptide sequence at SEQ ID NO. 4252
  misc_feature (11)..(11): n is a, c, t, g, unknown, or other
  misc_feature (12)..(12): n is a, c, t, g, unknown, or other
  misc_feature (144)..(144): n is a, c, t, g, unknown, or other
  misc_feature (379)..(379): n is a, c, t, g, unknown, or other
  misc_feature (397)..(397): n is a, c, t, g, unknown, or other
ctcacacaacnnagctcgatcgatctcactctcagctggtcgctcactcttgcagctccacccttcactcagtcttaggctcttagctctaggctctagctagccgcgccactccttcgtgtagccatcagccttctcatcgynaccaatggccactgccgaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcngcgtccgaaccggcgtgnaggcggaggctgctgctcctgctggtcccgaggagactcctgc

SEQ ID NO: 4252 - protein, 97 aa, Zea mays
  misc_feature: Ceres CLONE 298725-F
  misc_feature (83)..(83): Xaa is any aa, unknown, or other
MATAEVQTPTVVAAEEAPVVETPPPAVVPEESAPAEAEAEAEAEAAAPADPEELPAAEQQAAAEPEAAAPAGAEEPAASEPAXRRRLLLLLVPRRLL

SEQ ID NO: 4253 - DNA, 481 bp, Zea mays
  misc_feature: Ceres CLONE 298738-F
  misc_feature: Encodes the peptide sequence at SEQ ID NO. 4254
  misc_feature (30)..(30): n is a, c, t, g, unknown, or other
  misc_feature (190)..(190): n is a, c, t, g, unknown, or other
aaaaccctaacactccaccgacgcccagwnctgttccttctctcttccacgccgccgccgccgccctcgaattttcgaatcctcagcaacaatcggcctgccgccatgagggagatcctccacatccagggcggccagtgtggcaaccagatcggtgccaagttctgggaagtggtgtgcgcggasacgngcatcgacgccaccggccgctacggcgcgactccgacctgcagctcgagcgcgtcaacgtctactacaacgaggcctcgtgcggccgcttcgtgccccgcgccgtgctcatggacctagagcccggcaccatggactccgtgcgctccggtccctacggccacatcttccgccccgacaacttcgtcttcggccagtccggggccgggaacaactgggccaagggcactacaccgagggagccgagctcatcgactccgtgctcgacgtggtgcgcaaggaggccgagaac

SEQ ID NO: 4254 - protein, 159 aa, Zea mays
  misc_feature: Ceres CLONE 298738-F
  misc_feature (9)..(9): Xaa is any aa, unknown, or other
  misc_feature (10)..(10): Xaa is any aa, unknown, or other
  misc_feature (62)..(62): Xaa is any aa, unknown, or other
  misc_feature (63)..(63): Xaa is any aa, unknown, or other
NPNTPPTPXXVPSLFHAAAAALEFSNPQQQSACRHEGDPPHPGRPVWQPDRCQVLGSGVRGXXHRRHRPLRRDSDLQLERVNVYYNEASCGRFVPRAVLMDLEPGTMDSVRSGPYGHIFRPDNFVFGQSGAGNNWAKGTTPREPSSSTPCSTWCARRPR

SEQ ID NO: 4255 - DNA, 643 bp, Zea mays
  misc_feature: Ceres CLONE 298757-R
cagattgggtaccgggccccccctcgaggtcgacggtatcgataagcttttttttttttttttttcttggatcgaatttgctacatatgcgctccgtgcaatttttagaaacatttgctgcgctactgctactggtctgattgatgatcatcatcaacaggtagtaataatcaacaagtacatgatcctcagctgcatgtcgtgaagtcgcacatgagccttgtccgcccgccgccgcccgcgttggccctgcggaaccgcgcgccctccaggagcaccctctgcccggagctgaggagcgcgccgttcatgtggtccatgacgctggccgtggtcgggtacaggaagggacccccgggggcgttgtagtaggcgttgagcagcgccgccgtggcctcccggagcagcgtgcggtacatgtcgccgcgcccctccagcgcctccccgagcgtcagctccgacccgtaccgctgcgccgccaggggcccgaacgccatggccaccgtcgtgttcggggtcactaccttccagtggcagcggtgctccggcgacgaccacatgctgccatgccatgccatgcaatgcaatgcaaaatagtccccatcaccccatggcatgcaaatgcaaaaacgatggacggacg

SEQ ID NO: 4256 - DNA, 471 bp, Zea mays
  misc_feature: Ceres CLONE 298763-F
  misc_feature: Encodes the peptide sequence at SEQ ID NO. 4257
  misc_feature (87)..(87): n is a, c, t, g, unknown, or other
  misc_feature (108)..(108): n is a, c, t, g, unknown, or other
  misc_feature (151)..(151): n is a, c, t, g, unknown, or other
  misc_feature (209)..(209): n is a, c, t, g, unknown, or other
acaactcacaattcacatcgaggtctcagcttcaggaaagggaaggaagcatgttcgggcaccaccaccaccacggccacggcgggnaccaccaggccccgccgcckncgagcagacgctgttcaggatcttctgccgcgccgacgagstnactgcctcaccgtgcgccacgacgccgtstcctcgcgcccaccaacccccgcgacgwntaccagcactggtacaaggacatgaggcacagcacgaaggtgaaggacgcggagggccagccggcgttcgcgctcatcaacagggccaccgtcttcgccatcaagcactcgctcggccagtcccatcccgtgaagctggtgccctacaacgcggagtacctggacgagtcggtgctgtggacggagagccacgacgtggcaagggcttccgctgcatccgcatggtcaacaacatccacctcaacttcgacgccttccacgg

SEQ ID NO: 4257 - protein, 140 aa, Zea mays
  misc_feature: Ceres CLONE 298763-F
  misc_feature (13)..(13): Xaa is any aa, unknown, or other
  misc_feature (20)..(20): Xaa is any aa, unknown, or other
  misc_feature (33)..(33): Xaa is any aa, unknown, or other
  misc_feature (34)..(34): Xaa is any aa, unknown, or other
  misc_feature (44)..(44): Xaa is any aa, unknown, or other
  misc_feature (53)..(53): Xaa is any aa, unknown, or other
MFGHHHHHGHGGXHQAPPPXSRRCSGSSAAPTXXLPHRAPRRRXLAPTNPRDXYQHWYKDMRHSTKVKDAEGQPAFALINRATVFAIKHSLGQSHPVKLVPYNAEYLDESVLWTESHDVARASAASAWSTTSTSTSTPST

SEQ ID NO: 4258 - DNA, 472 bp, Zea mays
  misc_feature: Ceres CLONE 298804-F
  misc_feature: Translation starting site: 303
aaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagawagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatc

SEQ ID NO: 4259 - DNA, 487 bp, Zea mays
  misc_feature: Ceres CLONE 298824-F
  misc_feature: SWISSPROT Homolog: EC 1.1.1.100 3-oxoacyl-[acyl-carrier-protein] reductase
aatgcctctgccaacaaacaaagaacagacctatcgctacacagtccgccgtggctctctgcaattaatggctgcctccacagcgtcgtcgtcatactctgccggtgtaagcgccgcctgctgtgtgtctccgcgccatggcagcagcttcgtcaagccgcagcgctctggacggccggcggcggcggcggcgaccctacctgcgtcaggcggcgaccagcsaacctatcgttagactgctgtcgtaggagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagcatagctgtagcacttggcggacaggggtgcaaggtggttgtkaactatgccaagtcaggcgtggaggccgaagaggtgtgcagagagatcga

SEQ ID NO: 4260 - DNA, 179 bp, Zea mays
  misc_feature: Ceres CLONE 298840-F
  misc_feature (90)..(90): n is a, c, t, g, unknown, or other
aacgacgcagctagcgcgcatctcccgatcagctgcactgcaccttcgtcgaacgtcgatcgtactcgtacaccatgaaggcagtcgtcncggcgagatgcttctgctggtgctggtggccgcggcgacggtggcgagcgcagaccaccgtgacgacggccacaccaccacgccaccgc

SEQ ID NO: 4261 - DNA, 479 bp, Zea mays
  misc_feature: Ceres CLONE 298849-F
  misc_feature: Encodes the peptide sequence at SEQ ID NO. 4262
  misc_feature (84)..(84): n is a, c, t, g, unknown, or other
attcgctcctcccgcccgccgccgtcgccgcctcctctccccagcacccggagctcgcccgaccgccgctcaccatgatcattncccaagaagaaccgcaatgagatctgcaagtacctcttcaaggagggcgtgctgtatgccaagaaggactacaacctggcgaacgacccgcagatcgatgtgcccaasckccaggtgatcaagctcatgcagagctttaagtccaaggagtatgttagggagaccttctcctggcagtactactactggtatctcaccaacgatggcattgaggcacctacgcaactacctgaacctcccgtctgagatcgtgcctgccacgctcaagaagtctgccaagccacctggccgcgcatttggctctggcctcctggtgaccgcccaaggggcccaggtcgttttgacggcgacaggccaaggtttggtgacagggatgggtacgtggtggtsctcgt

SEQ ID NO: 4262 - protein, 39 aa, Zea mays
  misc_feature: Ceres CLONE 298849-F
  misc_feature (1)..(39): Pfam Name: S10_plectin Pfam Description: Plectin/S10 domain
MQSFKSKEYVRETFSWQYYYWYLTNDGIEAPTQLPEPPV

SEQ ID NO: 4263 - DNA, 1503 bp, Zea mays
  misc_feature: Ceres CLONE 298910
  misc_feature: Encodes the peptide sequence at SEQ ID NO. 4264
accacgcgtccacgcctcaccatcgcagaagcgcagtaggaagccggacaaagctacgcaaggagggagaaagcgtgtaaaccatggcgtcctccgcgttcctcaacgctctcgtcctccgatcgccatcaccgtcgctctcgtcctcgtctaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcggttccgctgtcacgggggccgcggtggcggaggcgccggaggcgagagaggtcgcggagctcaaggcgcagctaaaggacgcgctgtacggcacggagcggggcctgcgggcgtccagcgagtcacgagccaaagtgctggagctcatcacgcagctcgagacgcgcaaccccacgccggctcctacggaggcgcttacgctccttaacgggaagtggatcctcgcgtacacatcattttcccaactattcccactattggggtttggtaatctgcctcagctggtgaaggtggaggaaatatcacaaaccattgattctgagaacttcacagtgcaaaactgtatcaagttttcaggacctttggctacaacctcagttgccactaatgcaaaatttgaaattagaagccccaagcgtgtgcagatcaaatttgatgaagggattgttggtacaccacagttgaccgactccattgtgctaccagagaagtttgagttatttggacagaacatcgacctgagtccactgaaaggcatattttcttccatcgaaaatgcagcatcctcggttgcaaagaccatatctgagcagcctccgctcaaaataccgatcaggacaaacaatgctgaatcgtggttgcttacgacataccttgacgaagagctcaggatctccagaggcgatggcagcagcatctttgtgctgttcaaggagggaagtactcttctatactgagatccaaatcccgagtccatgatcgttgaagctgaaccgtgaagtagttatactgcttatgcttttctttcttatagtaatatgctccgtctcaaaatagtcaatttctagaatcacttaaagtcaattaatcttaagtttgaccaattttataggaaaggcaccatcgtctatgtctctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacagttcttgtcattagagtatatgatgactaggaccggtttaatccgaattatataaactctctatatatcagcgaaccccttttttatagcaaaaaacaaaaaaaa

SEQ ID NO: 4264 - protein, 318 aa, Zea mays
  misc_feature: Ceres CLONE 298910
  misc_feature (92)..(310): Pfam Name: PAP_fibrillin Pfam Description: PAP_fibrillin
MASSAFLNALVLRSPSPSLSSSSNRRSTGAFAFPNPPRFPCLRSARRLVLARAAAAPAPGDGPEDEWGPEPEGGSAVTGAAVAEAPEAREVAELKAQLKDALYGTERGLRASSESRAKVLELITQLETRNPTPAPTEALTLLNGKWILAYTSFSQLFPLLGFGNLPQLVKVEEISQTIDSENFTVQNCIKFSGPLATTSVATNAKFEIRSPKRVQIKFDEGIVGTPQLTDSIVLPEKFELFGQNIDLSPLKGIFSSIENAASSVAKTISEQPPLKIPIRTNNAESWLLTTYLDEELRISRGDGSSIFVLFKEGSTLLY

SEQ ID NO: 4265 - DNA, 377 bp, Zea mays
  misc_feature: Ceres CLONE 298911-F
aaagaataagtaggagcagagctgaaggacaccaataagaaacggttgctcgctgccaccaccatgtcctatgatcagatgctctcgccgcttttcggtgccggcgggcgatcggcgtggagagcggcccagcacggcggcggcgacsggtggcgaggcagatactcaagtgcacgaggtggcagctcgaggagaccaccgacttcgtcacctgcccctaccactactactgcgacastcctacccgggcgactaccccgccgccgtcggccctcgtcgccgccttcgccgcctactgctttctctccactctcgcgttcaccgtcctcgacctcgtgcggggcaacggtagcagcgcctcgtcgtcggcggtggcg

SEQ ID NO: 4266 - DNA, 443 bp, Zea mays
  misc_feature: Ceres CLONE 298927-F
  misc_feature: Encodes the peptide sequence at SEQ ID NO. 4267
  misc_feature (420)..(420): n is a, c, t, g, unknown, or other
agctcttcccgcttttcccctcacccgccgcccwtccgatgccagacgccgcggtcgcctcgtcctttccctcgtcgtcttcgttgctgtctccgccgccgcagycctcgcctacctatctttcccctctgccgggcggacatcgccccggcggttccggacggaggtcgactgctgcaggggtatggagggcctcgagctctggggcccggcggtcaagtggggctcagaccaccgcctgccctccgccgccgcctgctgcgccgcctgcaascatgtgccctcaccctaaggacggggcctgccgctgcgactcgtgggtcttctgcggtgacgagcgcaaatkcaaggacaggctcggggagtgctggctgaaaacagaaggatgtcatggcccctgctgttattgcaaagggggangacgtcatgtggacttctggtct

SEQ ID NO: 4267 - protein, 96 aa, Zea mays
  misc_feature: Ceres CLONE 298927-F
  misc_feature (35)..(35): Xaa is any aa, unknown, or other
  misc_feature (91)..(91): Xaa is any aa, unknown, or other
ALPAFPLTRRPSDARRRGRLVLSLVVFVAVSAAAXLAYLSFPSAGRTSPRRFRTEVDCCRGMEGLELWGPAVKWGSDHRLPSAAACCAACXHVPSP

SEQ ID NO: 4268 - DNA, 372 bp, Zea mays
  misc_feature: Ceres CLONE 298932-F
  misc_feature: Encodes the peptide sequence at SEQ ID NO. 4269
acacaaccaagctcgatccatctcactctccgctggtcgctcactcttgcagctccacccttcactcagtcttagtctcttattagctctaggctctagctagccgcgccactccttcgtgtagccatcagccttctcatcgycaccaatggccactgccgaggtccagaccccgaccgtcgtggcggccgaggaagcgcccgtggtggagaccccgccgccggccgtcgtgcccgaggagtctgcccccgccgaggccgaggccgagscgaggtggctgctcctgctgatcccgaggagcttcccgcggccgagcagcaggcagccgccgakggcgtaggccgcggctcctgctggtgccgaggagcccgt

SEQ ID NO: 4269 - protein, 63 aa, Zea mays
  misc_feature: Ceres CLONE 298932-F
  misc_feature (41)..(41): Xaa is any aa, unknown, or other
  misc_feature (62)..(62): Xaa is any aa, unknown, or other
MATAEVQTPTVVAAEEAPVVETPPPAVVPEESAPAEAEAEXRWLLLLIPRSFPRPSSRQPPXA

SEQ ID NO: 4270 - DNA, 207 bp, Zea mays
  misc_feature: Ceres CLONE 298953-F
aacgaagaacgaaccactgggcaccggccgcggctcgcaagtggcctgcgttcctcttccacgctccgcccacccgtcccggggcccgccgcaacccgatccctccccgcgcycaacgatgccggccggccagccgcacgcgcacgawgccgctgccgccgcctgcktcggcascgggataccactccaaccaccgagtgccggcgc

SEQ ID NO: 4271 - DNA, 480 bp, Zea mays
  misc_feature: Ceres CLONE 298954-F
  misc_feature: Encodes the peptide sequence at SEQ ID NO. 4272
  misc_feature (263)..(263): n is a, c, t, g, unknown, or other
  misc_feature (266)..(266): n is a, c, t, g, unknown, or other
  misc_feature (357)..(357): n is a, c, t, g, unknown, or other
  misc_feature (463)..(463): n is a, c, t, g, unknown, or other
  misc_feature (471)..(471): n is a, c, t, g, unknown, or other
  misc_feature (473)..(473): n is a, c, t, g, unknown, or other
acaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgcggagcgggcggcgacaaggcgggcggcggcgcacgcgsacctacgtccgcgacgcgcgcgccatggcggccaccccggccgacgtcaaggagctcgcgggantancgckttcgtggtggacatgccggggctgagcacgggcgacatcagggtgcaggtggaggacgagcgggttcttgtgatcagcggcgakcgncgccgggaggagcgcgaggacgccaagtacctgcgcatggagcggcggatgggcaakttcatgcgcaarttcgtgctgccggacaacgccgacgtggacaaggtcnccgccgtntncagggac

SEQ ID NO: 4272 - protein, 133 aa, Zea mays
  misc_feature: Ceres CLONE 298954-F
  misc_feature (56)..(132): Pfam Name: HSP20 Pfam Description: Hsp20/alpha crystallin family
  misc_feature (40)..(40): Xaa is any aa, unknown, or other
  misc_feature (61)..(61): Xaa is any aa, unknown, or other
  misc_feature (62)..(62): Xaa is any aa, unknown, or other
  misc_feature (91)..(91): Xaa is any aa, unknown, or other
  misc_feature (111)..(111): Xaa is any aa, unknown, or other
  misc_feature (128)..(128): Xaa is any aa, unknown, or other
  misc_feature (131)..(131): Xaa is any aa, unknown, or other
MDARMFGLENPLVAALHHLLDVPDGDAERAATRRAAAHAXLRPRRARHGGHPGRRQGARGXXAFVVDMPGLSTGDIRVQVEDERVLVISGXRRREEREDAKYLRMERRMGXFMRKFVLPDNADVDKVXAVXRD

SEQ ID NO: 4273 - DNA, 473 bp, Zea mays
  misc_feature: Ceres CLONE 298958-F
  misc_feature: Translation starting site: 172
  misc_feature: SWISSPROT Homolog: EC 3.1.3.16 Phosphoprotein phosphatase
  misc_feature (123)..(123): n is a, c, t, g, unknown, or other
  misc_feature (378)..(378): n is a, c, t, g, unknown, or other
aaaaaaccaagcaaatggaggcatgagctccgccgcctccccgtctctcgccgatctcccccaaaccctagcctcgacctgaccgccagcgggcccgcagccggagaaggagtcggagtcgcncccacccacccaccctctgccgcgggcggggagcgggcggcggacgagatgccgtcgcacggggatctggaccggcagatcgcgcmtgcsmcttgcaagtacctgcccgaggcggaggtcaaggtgctctgckagcaggccaaggccatcctcatggaggaatggaacgtgcagcccgtgcgctgccccgttcaccgtctgcggcgacatccacggccagttctatgacctcatcgagctcttccgcatcggcgncgactctcccgacaccaactacctcttcatgggcgactacgtsatcgtggctattattcatttgawacggtttctctgttagtggctttgawagt

SEQ ID NO: 4274 - DNA, 379 bp, Zea mays
  misc_feature: Ceres CLONE 298976-F
  misc_feature: Encodes the peptide sequence at SEQ ID NO. 4275
  misc_feature (164)..(164): n is a, c, t, g, unknown, or other
  misc_feature (298)..(298): n is a, c, t, g, unknown, or other
gaggcctcgtccccgatcagacttgttcggcctcttcgacggcgtgcccgtctccccgggctcattcgccatgcattcctcagcctccgcgagaggaggacgagggctcctcttgccggcggcggttgtggtgctactgttgggtgcagtggcgccacgggsgngttgctatccgcgcgtgttcaacttcggggactctctggcggacacgggcaactacccgttcgtctatggcaacggctcagcaagctccgtccmaccatacggcgagaccttcttccaccgcgccaccgggcgncttccaacgggcgccctagtggtggacttcatcgcggacacactcggcctcccgttcggtgcgaccgtatctgagcggacg

SEQ ID NO: 4275 - protein, 103 aa, Zea mays
  misc_feature: Ceres CLONE 298976-F
  misc_feature: SWISSPROT Homolog: EC 3.2.1.51 Alpha-L-fucosidase
  misc_feature (31)..(31): Xaa is any aa, unknown, or other
  misc_feature (32)..(32): Xaa is any aa, unknown, or other
  misc_feature (63)..(63): Xaa is any aa, unknown, or other
MHSSASARGGRGLLLPAAVVVLLLGAVAPRXXCYPRVFNFGDSLADTGNYPFVYGNGSASSVXPYGETFFHRATGRLPTGALVVDFIADTLGLPFGATVSERT

SEQ ID NO: 4276 - DNA, 410 bp, Zea mays
  misc_feature: Ceres CLONE 298995-F
  misc_feature: Encodes the peptide sequence at SEQ ID NO. 4277
  misc_feature (196)..(196): n is a, c, t, g, unknown, or other
  misc_feature (197)..(197): n is a, c, t, g, unknown, or other
awacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcggcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgakatcctcaagaactacccggagctggcgcaggaggggctgccgacgatgaatcagcgtctggacatctcgaacgcggcggt

SEQ ID NO: 4277 - protein, 69 aa, Zea mays
  misc_feature: Ceres CLONE 298995-F
  misc_feature: SWISSPROT Homolog: EC 2.3.1.74 Naringenin-chalcone synthase
  misc_feature (43)..(43): Xaa is any aa, unknown, or other
MQDYVVDGFMKNTNCDDPELKEKLTRLCKTTTVRTRYVVMSDXILKNYPELAQEGLPTMNQRLDISNAA

SEQ ID NO: 4278 - DNA, 401 bp, Zea mays
  misc_feature: Ceres CLONE 299137-F
  misc_feature: Encodes the peptide sequence at SEQ ID NO. 4279
  misc_feature (288)..(288): n is a, c, t, g, unknown, or other
gcagactgcagtgcacagggaccgtaccggggagggccggcggcagcattggcgcgcaaggacacagtgccgcttgtycactgcttccggcttcgtggtggcgtcgctgctgctcctgctctgcgccactcgctgcgamgaggtcatggcggcgagcaggagcaggagcaggagcaccagcccgctgctcaacgtgctgttcaagctcaacttcatccgcacggtggagccaccgcgccgacttcccactccgaccgccgacgccaccgtcagcctcgccgyrggsanaccaactcgccgttctgcgtcaacccaccagacgcgccgtcgtccacgrgcctccgtccacgtcatccacgtcatccacgacgyctccgtccacgtcgtccacgccttcgttg

SEQ ID NO: 4279 - protein, 133 aa, Zea mays
  misc_feature: Ceres CLONE 299137-F
  misc_feature (95)..(95): Xaa is any aa, unknown, or other
  misc_feature (96)..(96): Xaa is any aa, unknown, or other
  misc_feature (113)..(113): Xaa is any aa, unknown, or other
ADCSAQGPYRGGPAAALARKDTVPLVHCFRLRGGVAAAPALRHSLRRGHGGEQEQEQEHQPAAQRAVQAQLHPHGGATAPTSHSDRRRHRQPRRXXTNSPFCVNPPDAPSSTXLRPRHPRHPRRLRPRRPRLR

SEQ ID NO: 4280 - DNA, 216 bp, Zea mays
  misc_feature: Ceres CLONE 299153-F
  misc_feature (111)..(111): n is a, c, t, g, unknown, or other
  misc_feature (153)..(153): n is a, c, t, g, unknown, or other
gggaaggctttgctggtagttgtagcacacacggcacaccacacggtttcgtcctcgtccaccatgctatcgtcctcgcacctcgttaagctgcccctcctgccgcgcggnctcctctcgtacctccccgcatccatcctcccgagcgggcdnhgagaccgcgtacgcagcaccctccacgccgccttcttccaagaagatgtcgtcgtccgcgca

SEQ ID NO: 4281 - DNA, 475 bp, Zea mays
  misc_feature: Ceres CLONE 299167-F
  misc_feature: Encodes the peptide sequence at SEQ ID NO. 4282
  misc_feature (213)..(213): n is a, c, t, g, unknown, or other
acacctcagtctcagtcccccaccacatccgctccccgccttccgcttccctaccccccgcatcacctaccaacgccgacaccatgggggccttcgcgaaggaggagcaccagttcctagccgagctcggcctcgcgcascaacccaggcgcgttcgcatgcggtgcgtggggcggctcaggtcccaccgtcacctccacgagcccgaccaknaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcagggaatcatcgacatgtgtgattatgctgtggggctaa

SEQ ID NO: 4282 - protein, 69 aa, Zea mays
  misc_feature: Ceres CLONE 299167-F
  misc_feature: SWISSPROT Homolog: EC 1.2.1.3 Aldehyde dehydrogenase (NAD(+))
MRACFDAAKTWMAIPAPKRGEIVRQIGDALRAKLHHLGRLVSLEMGKILPEGIGEVQGIIDMCDYAVGL

SEQ ID NO: 4283 - DNA, 187 bp, Zea mays
  misc_feature: Ceres CLONE 299169-F
  misc_feature: Encodes the peptide sequence at SEQ ID NO. 4284
  misc_feature (124)..(124): n is a, c, t, g, unknown, or other
attacatttgatccgccgcgscgcccgatcgacgagcgagcctcattcacactccgatctagctagctagctagtttaggaaagagaaatctgaccacagggatgcggtggcggctgcagccgncgccgkckccgcttggctccctcgtcctggccaccatcgccgccgttcgtgggtggtgcgagc

SEQ ID NO: 4284 - protein, 28 aa, Zea mays
  misc_feature: Ceres CLONE 299169-F
  misc_feature (8)..(8): Xaa is any aa, unknown, or other
  misc_feature (10)..(10): Xaa is any aa, unknown, or other
MRWRLQPXPXPLGSLVLATIAAVRGWCE

SEQ ID NO: 4285 - DNA, 405 bp, Zea mays
  misc_feature: Ceres CLONE 299187-F
  misc_feature: Translation starting site: 67
  misc_feature (139)..(139): n is a, c, t, g, unknown, or other
  misc_feature (231)..(231): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtggcaaggccggcgggcganggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgt

SEQ ID NO: 4286 - DNA, 189 bp, Zea mays
  misc_feature: Ceres CLONE 299194-F
  misc_feature (93)..(93): n is a, c, t, g, unknown, or other
atcagttgcgggcgcgcgtccctgtttcgctcgtgccgttgcgctgcgccaaggctccccacctctctcgtctcttctccacccgccgchctngtgggagtgaaacctagctagggttctgcccgccgccgccttcgatcaagacgccagcagccttagcgcgasccgccatggacacaggacgcaagc

SEQ ID NO: 4287 - DNA, 597 bp, Zea mays
  misc_feature: Ceres CLONE 299210-R
  misc_feature (421)..(421): n is a, c, t, g, unknown, or other
  misc_feature (435)..(435): n is a, c, t, g, unknown, or other
cagattgggtaccgggccccccctcgaggtcgacggtatcgataagcttttttttttttttttttactaagcaaaagaaaagggttgcttcaaggtaaatctatgcttaggttgagttccatgttttccaatctaaacaacagtagcactaggagacgtaatcatgctagtgtttgcagaagtttaacaggcggccttttcaatttcggttactagggaatactgatgctacccagagcactatcccctgcaacctgcacagttcagttcacccctgaatgtacaaaacgccatcagtccatgctccagcatcatctgcatggatcgataatcgtacagaggtggcgccgctcgccgctgcggcctaattcttgccacctgccttaatcttgttgtccgtggaagtccccgtgccgccggncgctgcctgctgcngccttcttcgcgcctttctcctcagaggcttttcttggcccccctaaggcacgggttcccggcttggcccgaaaaaagggggaaacaaaacctttggggaaaaaaaagcgccttctggaatccccaaccccctggggtgtgggggggccccccccgcgcccc

SEQ ID NO: 4288 - DNA, 481 bp, Zea mays
  misc_feature: Ceres CLONE 299231-F
  misc_feature: Encodes the peptide sequence at SEQ ID NO. 4289
  misc_feature (288)..(288): n is a, c, t, g, unknown, or other
  misc_feature (305)..(305): n is a, c, t, g, unknown, or other
atttttcttacacttctcgtcttcttcccctttcgctttcactcttcctttgcagctcacactcacaagaatcccccgcgtcgcagmatgcggccgcttatccgaaccgctcgctgctggctcctccgcgcgcgtgttcssgcatggccacgcttccaatggcgctctcccccgccgccatttcccccttcaccaccctccccctctactattcttcgcgtcctcaccgccgcctcctcgcccgcttcttctccgtcgcttcggcaccgggcggasgatagggcacrnccggcggcctccgcgtntgaggtgggcggcgtcaagatcgcgcgcgaggatgttgtgaaggaggatgatccgacaaacaacgtgcccgacaatatcttttcgaagatcggcctgcagctgcacaggagggataaccatccccttgggatttttgaagaacacaatttatgattactttgacaaggaacttcac

SEQ ID NO: 4289 - protein, 123 aa, Zea mays
  misc_feature: Ceres CLONE 299231-F
  misc_feature (18)..(18): Xaa is any aa, unknown, or other
  misc_feature (63)..(63): Xaa is any aa, unknown, or other
  misc_feature (67)..(67): Xaa is any aa, unknown, or other
  misc_feature (73)..(73): Xaa is any aa, unknown, or other
MRPLIRTARCWLLRARVXAWPRFQWRSPPPPFPPSPPSPSTILRVLTAASSPASSPSLRHRAXDRAXPAASAXEVGGVKIAREDVVKEDDPTNNVPDNIFSKIGLQLHRRDNHPLGIFEEHNL

SEQ ID NO: 4290 - DNA, 458 bp, Zea mays
  misc_feature: Ceres CLONE 299237-F
  misc_feature: Encodes the peptide sequence at SEQ ID NO. 4291
  misc_feature (195)..(195): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanvwtgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgassagatggcgacggaggcgtccctgtcgtgcgtccgctcgtggggcg

SEQ ID NO: 4291 - protein, 77 aa, Zea mays; identical to SEQ ID NO: 1874
  misc_feature: Ceres CLONE 299237-F
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other

SEQ ID NO: 4292 - DNA, 213 bp, Zea mays
  misc_feature: Ceres CLONE 299312-F
  misc_feature: Encodes the peptide sequence at SEQ ID NO. 4293
attttccacggagccttccggataggatttgtctcccctccactgcgcytctccgtttccgccatggctccggccgccgccttcctgtcggcgtgcgccgctggttccattccccgtgcgcccttcctgatcccgaggcctcttcttctcccaattccgctctcccctgcgcgctgggaccgctcccgcagctgcagcctctttggcgtaacc

SEQ ID NO: 4293 - protein, 50 aa, Zea mays
  misc_feature: Ceres CLONE 299312-F
MAPAAAFLSACAAGSIPRAPFLIPRPLLLPIPLSPARWDRSRSCSLFGVT

SEQ ID NO: 4294 - DNA, 502 bp, Zea mays
  misc_feature: Ceres CLONE 299346-F
  misc_feature: Encodes the peptide sequence at SEQ ID NO. 4295
ctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcaksttgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtcckmtcacccactcgtgtacgtctcgtcgagcgaggc

SEQ ID NO: 4295 - protein, 77 aa, Zea mays; identical to SEQ ID NO: 1874
  misc_feature: Ceres CLONE 299346-F
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other

SEQ ID NO: 4296 - DNA, 476 bp, Zea mays
  misc_feature: Ceres CLONE 299353-F
  misc_feature: Encodes the peptide sequence at SEQ ID NO. 4297
  misc_feature (196)..(196): n is a, c, t, g, unknown, or other
  misc_feature (197)..(197): n is a, c, t, g, unknown, or other
aaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanndtgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccat

SEQ ID NO: 4297 - protein, 130 aa, Zea mays
  misc_feature: Ceres CLONE 299353-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLDISNAAVTRWRRRRPCRASARGAARSRP

SEQ ID NO: 4298 - DNA, 208 bp, Zea mays
  misc_feature: Ceres CLONE 299386-F
gtacgagactgcgccgccgttgccgtctcctcctccgacccatcactctctgctcgcgcactctcacctgcccgcgccgtcttcgaccgccaccaagatgaacaaggagaggctcatgaagatggccggcgccgtccgcaccggcggcaaggggacacgtgcaggaatcatgtcttgatatctttttacacaaaaaaaaaaaaaaaaa

SEQ ID NO: 4299 - DNA, 174 bp, Zea mays
  misc_feature: Ceres CLONE 299445-F
aactgaaactgtgtcattgtctgtcagtgctcgccgcgsgatctagggggaggggggccgtgccggcgcggacgcsaattggccgatctgcgcgccgtcgtccgactcctcggcctcggcctcgtcgggcttgggcgcccgcgtctgggtgctccacgggctagcgctcggcgg

SEQ ID NO: 4300 - DNA, 507 bp, Zea mays
  misc_feature: Ceres CLONE 299521-F
  misc_feature: Translation starting site: 351
  misc_feature: SWISSPROT Homolog: EC 4.2.1.92 Hydroperoxide dehydratase
aacaagcactcaacgtctcctccagtccttcgaaaaccctgaaaccttggtgaagccgagacgagcaatcatccaagcagctagtgcttagcatctatggcgacctccgttcgtggtttcagtagcgccctcagggatgtgccgggcagctacggccttccgctggtgggcgccgtccgcgaccgcctcgacttctactacttccagggccaggacaagtacttcgagtcccgcgtcgagcgctacggctccaccgtggtgcgcatgawcgtcccgccgggccccttcatggcgcgcgacccgsggtggtggcggtcctggacgccaagagcttccccgtcctcttcgacatggacaaggtggagaagagggacctgttcacgggcacctacatgccctccacctccctcaccggcggccaccgcgtctgcgcctacctcgacccctccgagcccacccacgccaaggtgaagcagctgctcttctccctccttgctctcccgcaag

SEQ ID NO: 4301 - DNA, 484 bp, Zea mays
  misc_feature: Ceres CLONE 299523-F
  misc_feature: Encodes the peptide sequence at SEQ ID NO. 4302
  misc_feature (194)..(194): n is a, c, t, g, unknown, or other
  misc_feature (195)..(195): n is a, c, t, g, unknown, or other
atattttggttccaaatcgaataacccaatgccgccgtagccgtctgcctcctcgctttcctttcgtccgtacgccgccggctcgcaccgccgacagtcctcagtccagaactccagatcgagcctctctcttcccagatcgggtcctaggctacagcagccgccgcatccgtcaccttcacaccgcgtgcgtnntctctctcccccctccccctctccgtgcgacgactgggtgggctaccgcgccttacgcaaggtgccgagaacttcgccaaaatctgcgccggagaagagcgcccaccagatcaggagctgagaaggcgcgctggtcggtggatgacgatggcgggtggcgggggactgaaccggtcttcatcgagggggcagctgcgccgcaagagctgcttgacgatctctgcagccggttccttctgaatgtgcccaaggaggaactggagtcgttcgagcggatcctgttcctggc

SEQ ID NO: 4302 - protein, 160 aa, Zea mays
  misc_feature: Ceres CLONE 299523-F
  misc_feature (65)..(65): Xaa is any aa, unknown, or other
ILVPNRITQCRRSRLPPRFPFVRTPPARTADSPQSRTPDRASLFPDRVLGYSSRRIRHLHTACVXSLPPPPLRATTGWATAPYARCRELRQNLRRRRAPTRSGAEKARWSVDDDGGWRGTEPVFIEGAAAPQELLDDLCSRFLLNVPKEELESFERILFL

SEQ ID NO: 4303 - DNA, 387 bp, Zea mays
  misc_feature: Ceres CLONE 299561-F
  misc_feature: Encodes the peptide sequence at SEQ ID NO. 4304
  misc_feature (110)..(110): n is a, c, t, g, unknown, or other
  misc_feature (111)..(111): n is a, c, t, g, unknown, or other
gtcacaactcacaattcacatcgaggtctcagcttcaggaaagggaaggaagcatgttcgggcaccaccaccaccacggccayggcgggcaccaccaggccccgccgccnndcgagcagacgctgttcaggatcttctgccgcgccgacgagstactgcctcaccgtgcgccacgacgccgtstcctcgcgcccaccaacccccgcgacgwgtaccatcactggtacaaggacatgaggcacagcacgaaggtgaaggacgcggagggccagccggcgttcgcgctcatcaacagggccaccgctcgccatcaagcactcgctcggccagtcccatcccgtgaagctggtgccctacaacgcggagtacctggacgagttcggtgct

SEQ ID NO: 4304 - protein, 111 aa, Zea mays
  misc_feature: Ceres CLONE 299561-F
  misc_feature (20)..(20): Xaa is any aa, unknown, or other
  misc_feature (34)..(34): Xaa is any aa, unknown, or other
  misc_feature (44)..(44): Xaa is any aa, unknown, or other
  misc_feature (53)..(53): Xaa is any aa, unknown, or other
MFGHHHHHGHGGHHQAPPPXEQTLFRIFCRADEXLPHRAPRRRXLAPTNPRDXYHHWYKDMRHSTKVKDAEGQPAFALINRATARHQALARPVPSREAGALQRGVPGRVRC

SEQ ID NO: 4305 - DNA, 473 bp, Zea mays
  misc_feature: Ceres CLONE 299568-F
  misc_feature: SWISSPROT Homolog: EC 2.7.11.1 Non-specific serine/threonine protein kinase
actcccacaccacgctcgagacgagagccagctctcccagcacacgagcacatggcgtccaccaccctcctcgctgtbttcctgctcgtggctgcgtccgcaggccggcgcggtcttgctcacctcgcgacctgcaggcgctgttgagcgtgaagcaggcgctagggaacccggcaacgctgtcgacgtggaccccagcgtcgcccgactgctgctcgtgggaccacctccggtktaacgacgccggacgcgtgaacaacgtgttcatcgacggcgcggacgacgtgcgcgggcaaatcccgtcggcggtgggcgggctgacggagctcatgtcgctgaccctgttccggctggcggggctgacgggccccatcccggcctgccytggccgcgctgtccaacctgcagttcctgaccgtctcccacaccaacgtgtccggcgccatcccggagtccctggcgcggctgcgggc

SEQ ID NO: 4306 - DNA, 296 bp, Zea mays
  misc_feature: Ceres CLONE 299572-F
  misc_feature: Encodes the peptide sequence at SEQ ID NO. 4307
  misc_feature (178)..(178): n is a, c, t, g, unknown, or other
atcttgctcctcgccctccatccgaacaacagcaggagcccgagcccgaacccgatattccgcattcctacccagcaatggtggcccttgtctaggtggacgcggtgcaagakgcgaacgggggccgatggatgaggaggggcagcgaacgccgcagccgatggtagtcgcgcggaangcccaagccacgccggatcacccaccctactgctggatgatcggcgaggcaaccgacgcgctgggccgaggacgggcggctcggaggagggactccatctctggccttttatccgcgc

SEQ ID NO: 4307 - protein, 56 aa, Zea mays
  misc_feature: Ceres CLONE 299572-F
  misc_feature (17)..(17): Xaa is any aa, unknown, or other
MDEEGQRTPQPMVVARXAQATPDHPPYCWMIGEATDALGRGRAARRRDSISGLLSA

SEQ ID NO: 4308 - DNA, 196 bp, Zea mays
  misc_feature: Ceres CLONE 299589-F
  misc_feature (119)..(119): n is a, c, t, g, unknown, or other
  misc_feature (136)..(136): n is a, c, t, g, unknown, or other
  misc_feature (137)..(137): n is a, c, t, g, unknown, or other
atcgccaccagtggccgcdtcctcttcatttccgccatccgtatcgtctccctagggtttggcactttggccgccgccatggsgtcggcgtcgcgtgcgctcctcatctctcgtgctgntccaggccggcgccgtnnctcgccgcgtccccgccctcctgcgccctgtcgctgctgccgcgagcctcctcccagcg

SEQ ID NO: 4309 - DNA, 717 bp, Zea mays
  misc_feature: Ceres CLONE 299622-R
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (444)..(444): n is a, c, t, g, unknown, or other
  misc_feature (548)..(548): n is a, c, t, g, unknown, or other
  misc_feature (549)..(549): n is a, c, t, g, unknown, or other
  misc_feature (638)..(638): n is a, c, t, g, unknown, or other
  misc_feature (653)..(653): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
cgaattgggtaccgggccccccctcgaggtcgacggtatcgataagcaaaaannnntttttttttgttttttttttgtttatttcttggtgatttctttttttttactttattattgttttttttttttgaaaaaaaaaaacccctgtttttgaagtgcccattatggttccccgtctaactccgcggagagggagaagcctactcttgaaaacaacgcacacctattacacaaccatgacggggtaaactaagcacctccagcagtagcgagcaggcgccgcaaccgaaccgcctaggcgcgctcgccgcggatgcggcgcgcgagctggatgtccttgggcatgatggtgacgcgcttggcgtggatggcacacaggttggtgtcctctaagagcccaccacgtagggctcggcggcctcctgcagcgcggcgaccgcggangattggaagcggaggtccctcttgaagtcctgcgcgatctccaggaccacacgctcgaacccgagcttgcggatcatcacctccctgctcctttctttgtcttnngacttcccgcaacgcgaccgtgcccgggcgggaagccgtgcggctttttttttgtcggtccgtctacccgcggcgacattgtgagtgcnacttctttctcaggnagtgctcgcgcgcnnnnncctggcgccccgccaaattgggcggccgtcttttttccttgggggg

SEQ ID NO: 4310 - DNA, 384 bp, Zea mays
  misc_feature: Ceres CLONE 299635-F
  misc_feature: Encodes the peptide sequence at SEQ ID NO. 4311
  misc_feature (107)..(107): n is a, c, t, g, unknown, or other
  misc_feature (122)..(122): n is a, c, t, g, unknown, or other
  misc_feature (123)..(123): n is a, c, t, g, unknown, or other
  misc_feature (286)..(286): n is a, c, t, g, unknown, or other
atctcgatttggctcgggctctcctctccccaattccccattgtcttcgtccgtccagcaccagctttcctccgcaccccgatccggacagcctcgccggaaccctnaaccctakcgcgccnnggcgggatccgccagcccgcatccagggccgtcgtgctacgcctggacgacctggcgctgcccccgcggcacctcaccgtcccctcccacctccccgtctycgacctcctccgctccatcccgctcccctcgccctcctgctactacctcaccgccgacgggncccgctgccggcctcctccccggtggcggcgctcccgcgtcggcctccgtccagctccgcctccgcgcgctccggggcggcggcggcgacggcggcgc

SEQ ID NO: 4311 - protein, 128 aa, Zea mays
  misc_feature: Ceres CLONE 299635-F
  misc_feature (36)..(36): Xaa is any aa, unknown, or other
  misc_feature (39)..(39): Xaa is any aa, unknown, or other
  misc_feature (41)..(41): Xaa is any aa, unknown, or other
  misc_feature (75)..(75): Xaa is any aa, unknown, or other
  misc_feature (96)..(96): Xaa is any aa, unknown, or other
ISIWLGLSSPQFPIVFVRPAPAFLRTPIRTASPEPXTLXRXGGIRQPASRAVVLRLDDLALPPRHLTVPSHLPVXDLLRSIPLPSPSCYYLTADGXRCRPPPRWRRSRVGLRPAPPPRAPGRRRRRRR

SEQ ID NO: 4312 - DNA, 112 bp, Zea mays
  misc_feature: Ceres CLONE 299636-F
aaaaactcggaggaaagcagaaggggaagattcagcaatggaggcgagggttcaggattkcccgaagacgaagagtccggcctcctcccccgcccgtycgcagccggccgac

SEQ ID NO: 4313 - DNA, 247 bp, Zea mays
  misc_feature: Ceres CLONE 299644-F
  misc_feature: Encodes the peptide sequence at SEQ ID NO. 4314
  misc_feature (111)..(111): n is a, c, t, g, unknown, or other
ayaagcaccagaccaattaaytagcttcttctagctctagctaggytcgtttkctgcaagawggtaacagctagcaggcatggaggggaaggaggaggacgtccgcytggncgccaacaagttctcggagcgccastccatcggcacggcggcgcagggcacggacgacaaggactacaaggtwgcccccgctcggctkccgctcttcgagcccggggagctcaagtyctggtccttctaccgcgcc

SEQ ID NO: 4314 - protein, 56 aa, Zea mays
  misc_feature: Ceres CLONE 299644-F
  misc_feature (11)..(11): Xaa is any aa, unknown, or other
  misc_feature (19)..(19): Xaa is any aa, unknown, or other
  misc_feature (50)..(50): Xaa is any aa, unknown, or other
MEGKEEDVRLXANKFSERXSIGTAAQGTDDKDYKVAPARLPLFEPGELKXWSFYRA

SEQ ID NO: 4315 - DNA, 730 bp, Zea mays
  misc_feature: Ceres CLONE 299669-R
cgattgggtaccgggccccccctcgaggtcgacggtatcgataagcttttttttttttttttttgctgatgaacgactggctctattattatatcaagaagatcatatcatcacacaatgactcgaacagaacgtaccccaagaagacgacccataccagtacccaaactgccatgcgtgagaatagatagacggaaagaacaggaactcaaccaacacaagacacaacaagctgcagccgcggcaggcatggggcaccgcgcgcactggcaccgggccccaccaccattaccacccgacgcacactttatttagcccacgggactcggagcccgcaccggacacgtacacgcgacagtcactgctagctacgtaccgggctacgtacgacacacacacgctcacggagagagagagacgccagtaaccgtagcgtactgaacagcaaaatcccgtgtcatactgccatgtacacgcgcgagagaataccccgccacgcgcgcacgcagatcccctggggcctgggccctggccgccgccgctgcgtgcgcacggcctcactcactggccttctcgggctcctagagaacagcaacctccgcctcggcggccggctcctggggaccagcacgagcacgagcatgagcctcttgctcgtccgcggcgagctactcgggagcaacaccttctgcctcagacacaggctcggcatcagagggatcctcgtgac

SEQ ID NO: 4316 - DNA, 504 bp, Zea mays
  misc_feature: Ceres CLONE 299684-F
  misc_feature: Encodes the peptide sequence at SEQ ID NO. 4317
aaaagaaaaacggtgagctagaaacttccaaatcgaacggcacacaaaaatcacaacccggaaaggaccagcagcgcaaaggtgagcgagctttccttcggaactctcgtgctcacctcatccgtccgacaaatccacacgaatcctctgattcagagcagggtgttagcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctctgcgccgggagagtaaacgggccatgctgccgatcctcccgtccagagctcctattcacatgattattaaagaaaaaattttatatata

SEQ ID NO: 4317 - protein, 80 aa, Zea mays; identical to SEQ ID NO: 816
  misc_feature: Ceres CLONE 299684-F
  misc_feature (10)..(80): Pfam Name: S1FA Pfam Description: DNA binding protein S1FA

SEQ ID NO: 4318 - DNA, 281 bp, Zea mays
  misc_feature: Ceres CLONE 299687-F
  misc_feature: Encodes the peptide sequence at SEQ ID NO. 4319
  misc_feature (68)..(68): n is a, c, t, g, unknown, or other
  misc_feature (69)..(69): n is a, c, t, g, unknown, or other
  misc_feature (92)..(92): n is a, c, t, g, unknown, or other
  misc_feature (93)..(93): n is a, c, t, g, unknown, or other
  misc_feature (126)..(126): n is a, c, t, g, unknown, or other
  misc_feature (127)..(127): n is a, c, t, g, unknown, or other
actcgacgatattaatggagctgctttgcacgggcggcagagagccgtagacagagcagtgacggtcnngtacacagatcacgatgctgctnncacactcttcgtcagcctctgcaactgctaccnntcgtgggctagcactagcagcagcagcaccgscgccgcgtccgaccgctcgcccccgggcgcacgctcctgcctccacgcgcgcgggccgagacgcatgcgacgggcgttggcgcgaccgygcggcckaggcgcttctccagagcgggctgcgc

SEQ ID NO: 4319 - protein, 66 aa, Zea mays
  misc_feature: Ceres CLONE 299687-F
  misc_feature (4)..(4): Xaa is any aa, unknown, or other
  misc_feature (15)..(15): Xaa is any aa, unknown, or other
  misc_feature (26)..(26): Xaa is any aa, unknown, or other
  misc_feature (58)..(58): Xaa is any aa, unknown, or other
MLLXHSSSASATATXRGLALAAAAPXPRPTARPRAHAPASTRAGRDACDGRWRDRAAXALLQSGLR

SEQ ID NO: 4320 - DNA, 186 bp, Zea mays
  misc_feature: Ceres CLONE 299716-F
gtgcccgckgtgctagtgacggttgctctagatccgttcatcctggtggttttgtgaggtcgaaagcggctagcrattagaagatgctggacaagctgtgggacgacgtggtggccgggcctcgccgaggtacggcctcgagaagctccgcaagccaccaccgcccgcccgctcgtcatcaacaaa

SEQ ID NO: 4321 - DNA, 222 bp, Zea mays
  misc_feature: Ceres CLONE 299746-F
  misc_feature (64)..(64): n is a, c, t, g, unknown, or other
aaccggcacgtcgtgaagctaaccgggattccgggaagcagagacgtcctgcccgtcgcccgdntccgtcgtcatggccgccgtggaggtgtgcgtgaaggccgccacggggaagcccgacacgctcggcgactgcccgttctcgcagaggtgctgctcacgctggaggagaagaaggtcccctacgaggtgaagctcgtcgacctcgacaacaagcccgaa

SEQ ID NO: 4322 - DNA, 319 bp, Zea mays
  misc_feature: Ceres CLONE 299748-F
  misc_feature: Encodes the peptide sequence at SEQ ID NO. 4323
  misc_feature (114)..(114): n is a, c, t, g, unknown, or other
  misc_feature (115)..(115): n is a, c, t, g, unknown, or other
  misc_feature (118)..(118): n is a, c, t, g, unknown, or other
agattcctttccctttccgttagcaggatagagagggagaggagcagaagatagcagagggccagatsgcagaaggcagtcgcggacaggaggaagaggaagaagaagcggcannggncgaggatgccgtgcctgaacgtgtcgaccaacgtgaacctkgarggggttgacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttcca

SEQ ID NO: 4323 - protein, 65 aa, Zea mays
  misc_feature: Ceres CLONE 299748-F
  misc_feature: SWISSPROT Homolog: EC 5.3.2.1 Phenylpyruvate tautomerase
MPCLNVSTNVNLEGVDTSAILAEASKSVANIIGKPEAYVMVVLKGSVPMAFGGTQEPAAYGELVS

SEQ ID NO: 4324 - DNA, 171 bp, Zea mays
  misc_feature: Ceres CLONE 299754-F
  misc_feature: Encodes the peptide sequence at SEQ ID NO. 4325
aaaacattttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgca

SEQ ID NO: 4325 - protein, 57 aa, Zea mays
  misc_feature: Ceres CLONE 299754-F
KTFYLLYRYSKSTQSPSHGHLSHCRGRLVRFLGSKKPPAAVPPEGRNVHRRPAGARA

SEQ ID NO: 4326 - DNA, 729 bp, Zea mays
  misc_feature: Ceres CLONE 299762-R
  misc_feature: Encodes the peptide sequence at SEQ ID NO. 4327
  misc_feature (1)..(1): n is a, c, t, g, unknown, or other
ncaattgggtaccgggccccccctcgaggtcgacggtatcgatattttttttttttttttttgagcattacttctcttgatggtggtgatgatgatatgatacgataacatgacgacatgccaagtttataaaaacgacatcagcaacgagctgcagacttggggtagatcaaactgaaagccctacgcatacatagatagttgaagacttgagctaaattggattaattagctcgaccagaattcgaaacgaacgagatcgtcccttacacttcttcttctaccttggcctgtttgactggctgctcctgcttcccgctgctcccagtctcacgcgagagatccaccatctcctccatcttgggagtcaggtacgcgctagccttgctcgtcgcctccacgtccatccccgaggcgcgctgctgcgcgtgcgagctcatgccgaccagcagacacgcgcgccccgtcttctggtactccgcccggtcgccgacgcgggcgctgaggtcgcgcagctcctccttgatcgcctcgcacgtggggtcccccggcgccgactgttccacggccttgagccgggactcgaggatccgtgcggcgccggcgttctgcccgccgtcagcggctacccgagcggccgcgatgccctcggtcgccgcgaggcggacgcgctcccgctccacgtccacggacggagcgggcagcgtcgccagctccagcggcctctgc

SEQ ID NO: 4327 - protein, 29 aa, Zea mays
  misc_feature: Ceres CLONE 299762-R
MPSVAARRTRSRSTSTDGAGSVASSSGLC

SEQ ID NO: 4328 - DNA, 237 bp, Zea mays
  misc_feature: Ceres CLONE 299811-F
  misc_feature: Encodes the peptide sequence at SEQ ID NO. 4329
  misc_feature (135)..(135): n is a, c, t, g, unknown, or other
ctgcccagctaagctaagctccctccgtccatcggcatggcgactaccactactaccatcctcctcctcctcctcgtcgcagccacagccgtctcgggkdccgacctctccgtgtaccacaacgtkcacccgcbnccccgtccccgctcgagtccatcatcgcgctcgcccgcgccgacgacgcgcggctcctcttcctctcatccaaggcggcctcgtccggcggcgtcacctccg

SEQ ID NO: 4329 - protein, 67 aa, Zea mays
  misc_feature: Ceres CLONE 299811-F
  misc_feature (22)..(22): Xaa is any aa, unknown, or other
  misc_feature (33)..(33): Xaa is any aa, unknown, or other
MATTTTTILLLLLVAATAVSGXDLSVYHNVHPXPRPRSSPSSRSPAPTTRGSSSSHPRRPRPAASPP

SEQ ID NO: 4330 - DNA, 451 bp, Zea mays
  misc_feature: Ceres CLONE 299823-F
  misc_feature: Encodes the peptide sequence at SEQ ID NO. 4331
  misc_feature (145)..(145): n is a, c, t, g, unknown, or other
  misc_feature (384)..(384): n is a, c, t, g, unknown, or other
  misc_feature (395)..(395): n is a, c, t, g, unknown, or other
gccactcgtagtcctaggcactttcatctgtggcctctgcgttcgagatcgatctgagctggcaccgtcccacttcgccatggcggaggaccggagccccaagcccatccactgcaaagcggcggtgtgcagagccgccggcrgnccactcaccatcgaggagatcgtcgtcgacccgccgaaagcgtacgagatccgcatccgggtcgtctgcacctcactctgccacaccgatatcaccttctggaaagctaaggtggcaccggtgtttccaagaatactagggcatgaggcgtacggggtagtggagagcgtgggggagcacgtggagggcttcgcggcgggggacaccgtggtgccgacgttcctggggcagtgcgagcnctgcgccastnctggagcacagcaacgtgtgcgacgcggtgccgttcgtcatcggccccgggatgcg

SEQ ID NO: 4331 - protein, 124 aa, Zea mays
  misc_feature: Ceres CLONE 299823-F
  misc_feature (36)..(119): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (22)..(22): Xaa is any aa, unknown, or other
  misc_feature (102)..(102): Xaa is any aa, unknown, or other
  misc_feature (105)..(105): Xaa is any aa, unknown, or other
  misc_feature (106)..(106): Xaa is any aa, unknown, or other
MAEDRSPKPIHCKAAVCRAAGXPLTIEEIVVDPPKAYEIRIRVVCTSLCHTDITFWKAKVAPVFPRILGHEAYGVVESVGEHVEGFAAGDTVVPTFLGQCEXCAXXGAQQRVRRGAVRHRPRDA

SEQ ID NO: 4332 - DNA, 510 bp, Zea mays
  misc_feature: Ceres CLONE 299824-F
  misc_feature: Translation starting site: 304
ayaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagatgatgtggttcatcctctgaaggtttctctggaggatttgtacaatggcacatcgaagaagctctctctgtcccgcagtgttctctgctcc

SEQ ID NO: 4333 - DNA, 444 bp, Zea mays
  misc_feature: Ceres CLONE 299883-F
  misc_feature: Translation starting site: 134
gattatctgattctgtgatcgagatcgaggccgatcggcagggtttcttstgcgtgcgctctgctactgccatggcggtactcaccttcttctccaactctctgccggagtcaatggagctascaggaacaggatgctcattccagccattctttcgattcttcagcttattcacctcgcwgcgctaggcgtggacggrtcggcgtcgttcaggttcaccaacgcttgccagcacccggtgtgggtgggcgcgctccacggagccactcgcctccgctcgcaagctcgggcttctacctggcgcggtccgcacgtcccgcctggacgcgccgtcgtcagggacatggtcaggcacgttctgggcgcgcacgggctgcgcggtcgattccgcaaccggccgcttctcctgcgccacggccgactgcggcacgggcgacgtcgcct

SEQ ID NO: 4334 - DNA, 412 bp, Zea mays
  misc_feature: Ceres CLONE 299936-F
  misc_feature (131)..(131): n is a, c, t, g, unknown, or other
  misc_feature (223)..(223): n is a, c, t, g, unknown, or other
  misc_feature (299)..(299): n is a, c, t, g, unknown, or other
  misc_feature (375)..(375): n is a, c, t, g, unknown, or other
  misc_feature (384)..(384): n is a, c, t, g, unknown, or other
  misc_feature (387)..(387): n is a, c, t, g, unknown, or other
  misc_feature (390)..(390): n is a, c, t, g, unknown, or other
ctgaacgcattcctcccatctcccaagacctcctcagacccgagaagcgcmkgcgggccatggacgccaccggcactggagctggagggaaggcgaagaagggagcggccggtcgcaaggccgcgggcganggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggncaacgctgccaaggacaacaagaagacgcgcatcgtcccgcgccacgtgctgctggcgatccgcaacgacgagganctcgggaanctnctnaccggcgtgaccatcgcccacg

SEQ ID NO: 4335 - DNA, 254 bp, Zea mays
  misc_feature: Ceres CLONE 299961-F
  misc_feature (219)..(219): n is a, c, t, g, unknown, or other
aaagataaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcggcggaagcccaacgccaagaactcccaggacgggctcaccccggagcagcgccgcganagggacaagaaagctctggaggagaaggcggccaa

SEQ ID NO: 4336 - DNA, 117 bp, Zea mays; identical to SEQ ID NO: 3619
  misc_feature: Ceres CLONE 299966-F
  misc_feature (68)..(68): n is a, c, t, g, unknown, or other

SEQ ID NO: 4337 - DNA, 150 bp, Zea mays
  misc_feature: Ceres CLONE 299994-F
  misc_feature (2)..(2): n is a, c, t, g, unknown, or other
anacaaaaaccctagccgccgcgccgccccgctccctagtggtgctcctcccccaccactgcagctccgtcccggcggccccaagagttgcggcgaggatgaacgtgaagggcggcasggatttccggtacccccgccggccagcgcgct

SEQ ID NO: 4338 - DNA, 260 bp, Zea mays
  misc_feature: Ceres CLONE 299999-F
  misc_feature: Encodes the peptide sequence at SEQ ID NO. 4339
  misc_feature (103)..(103): n is a, c, t, g, unknown, or other
  misc_feature (163)..(163): n is a, c, t, g, unknown, or other
agaaaaaatcgagaggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagcgcgcggcggcgnaagcccaacgccaagaactcccaggacgggctcaccccggagcagcgccgcgatagggacaagaaagctctggaggagaaggcggccaagaaggcgc

SEQ ID NO: 4339 - protein, 34 aa, Zea mays
  misc_feature: Ceres CLONE 299999-F
  misc_feature (17)..(17): Xaa is any aa, unknown, or other
MTRGNQRDRDRERAAAXAQRQELPGRAHPGAAPR

SEQ ID NO: 4340 - DNA, 413 bp, Zea mays
  misc_feature: Ceres CLONE 300003-F
  misc_feature: Encodes the peptide sequence at SEQ ID NO. 4341
  misc_feature (234)..(234): n is a, c, t, g, unknown, or other
  misc_feature (384)..(384): n is a, c, t, g, unknown, or other
  misc_feature (396)..(396): n is a, c, t, g, unknown, or other
aaacagctgaaasagccaaaacgcagaagctgcactgcatacatcgagctaactatctgcagcgatgtctcgctcctgctgcgtcgccgtgtcggtgcttctcgctgtcgccgcgacvcagcgccaccgcscggcatggctgcacgaggaggccatggccacgggccgctggtcgcagagggtgcaagggtggcgccctccgcgtccacctgggctgccgacaagsgtcgccgncgaggccgatcggcggcatggccacgcagggcgacgaccagagctcgtcgggcggcaatggcagcagcggtgagcacggcaaggaggaggcgataagcagggcaagagctgcctcaccaaggaggartgccacaagaagaagatgatctncggcaagggctncacgctctcggcgcaca

SEQ ID NO: 4341 - protein, 80 aa, Zea mays
  misc_feature: Ceres CLONE 300003-F
  misc_feature (23)..(23): Xaa is any aa, unknown, or other
  misc_feature (54)..(54): Xaa is any aa, unknown, or other
  misc_feature (57)..(57): Xaa is any aa, unknown, or other
MSRSCCVAVSVLLAVAATQRHRXAWLHEEAMATGRWSQRVQGWRPPRPPGLPTXVAXEADRRHGHAGRRPELVGRQWQQR

SEQ ID NO: 4342 - DNA, 445 bp, Zea mays
  misc_feature: Ceres CLONE 300008-F
  misc_feature: Translation starting site: 124
  misc_feature: SWISSPROT Homolog: EC 5.2.1.8 Peptidylprolyl isomerase
  misc_feature (354)..(354): n is a, c, t, g, unknown, or other
  misc_feature (356)..(356): n is a, c, t, g, unknown, or other
  misc_feature (372)..(372): n is a, c, t, g, unknown, or other
aagatcagatcacactcgtagaagaaggaaaaatatccccaaaccctagctcccgatctcgatggcgaaccctcgcgtcttcttcgacatgaccgtcggcggcgcccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaanancgcgctcccggtgttnctccatggccaacgccgggcccaacaccaacggctcccagttcttcatctgcaccgtcgcgaccccttggctc

SEQ ID NO: 4343 - DNA, 110 bp, Zea mays
  misc_feature: Ceres CLONE 300017-F
acacgcacaccgcgacccagtccagagccagtacgtgcgamgccacgcacgctgctggtccgcgtacsagaacgacggtcaggtcggccggtgcttttcagtttggaata

SEQ ID NO: 4344 - DNA, 120 bp, Zea mays
  misc_feature: Ceres CLONE 300096-F
  misc_feature: Encodes the peptide sequence at SEQ ID NO. 4345
  misc_feature (45)..(45): n is a, c, t, g, unknown, or other
  misc_feature (48)..(48): n is a, c, t, g, unknown, or other
aagaaaaatactcccgtgttcttcgaccggcggcggtggtgcgangangggcggtaagggagacgagatgagggggacgaagcggccgctcggcgtggtgacgtcgtgggtgcggcggca

SEQ ID NO: 4345 - protein, 39 aa, Zea mays
  misc_feature: Ceres CLONE 300096-F
  misc_feature (15)..(15): Xaa is any aa, unknown, or other
  misc_feature (16)..(16): Xaa is any aa, unknown, or other
RKILPCSSTGGGGAXXGGKGDEMRGTKRPLGVVTSWVRR

SEQ ID NO: 4346 - DNA, 127 bp, Zea mays
  misc_feature: Ceres CLONE 300111-F
  misc_feature (54)..(54): n is a, c, t, g, unknown, or other
aacaagtcagaaaaaaaaaagawtaagaagaaaggaatccctcctacgcggaanaagagattcgtcgcctcagccgcctctctggctcagatctgcggcggactcgccggcggcctgcgccccgcgg

SEQ ID NO: 4347 - DNA, 117 bp, Zea mays; identical to SEQ ID NO: 2403
  misc_feature: Ceres CLONE 300152-F

SEQ ID NO: 4348 - DNA, 335 bp, Zea mays
  misc_feature: Ceres CLONE 300170-F
  misc_feature: Translation starting site: 78
aacttcctctccctccctcactcggccaaagctgactacagcctacaagcgavttagaagagctcttcccgatagccatggccaagcccccgcttcaaacggctgcgatcatcctcctcgtactcctctcggccgcgtcgtgcctccacaccgtcgatgccgccactttagggttctgttggggcaagtgtagcgttcggtgcgcgggggcgaccgcgggcaggcgcagccgcgtgcatgagctcctgtggcctctgctgcgaggcatgcaactgcgtgccgcacgacatccatgaytgcccctgctaccgcaacatgctcaccgccggccccaa

SEQ ID NO: 4349 - DNA, 410 bp, Zea mays
  misc_feature: Ceres CLONE 300214-F
  misc_feature: Pfam Name: DUF846 Pfam Description: Eukaryotic protein of unknown function (DUF846)
  misc_feature (78)..(78): n is a, c, t, g, unknown, or other
  misc_feature (112)..(112): n is a, c, t, g, unknown, or other
  misc_feature (382)..(382): n is a, c, t, g, unknown, or other
atctctagagaggcacatcccagctccaagcttcgcgccttgttggatcgtggcgtccaagcaacggtggtagcggangaaggcagtggccgcagaaggaagcgcgamgatnccatggaccaacgccaggtgttagcgagaattatgccaatcccataacatgcttcttccatgtgctattcaaggcgggggcgctasttcctacatcctattctcgctctttgtgaagagcttcgttcatcatcttcgtgatcacggtgctcctcgcagcgcttgayttctgggtggtgaagaacgttcakkccwaggatactagtcgggctgcggtggtggaatgagatcgatgatgacggaaacagtgtgtggaagtttgaatgccttnatggggagtctctcgctcggatgaacaa

SEQ ID NO: 4350 - DNA, 125 bp, Zea mays
  misc_feature: Ceres CLONE 300259-F
acacgcacaccgcgacccagtccagagccagtacgtgcgamggcacgcacgctgctggtccgcgtacsaggacgacggtcaggtcggccggtgcttttcagtttggaataatgacggcgacgacg

SEQ ID NO: 4351 - DNA, 418 bp, Zea mays
  misc_feature: Ceres CLONE 300297-F
  misc_feature: Encodes the peptide sequence at SEQ ID NO. 4352
  misc_feature (302)..(302): n is a, c, t, g, unknown, or other
gatctgagatcgacatcgatccaccgaggtttcttgtgcgtgccgccatggccatggcagtagctcaccttcttcctcagctctccgccgamratgggagctagcaggaacagaatggccattctcttgattcttcagctttttctcttgacggcgctaggcgtggatggagcggcgtcgttcatcttcaccaacgcctgcwaagcacgcggtgtgggtgggcgcgctccacggcgccactcgccgccgctcgcgcgttcgggcttctacctggcgccgtccgccacgtccagcatggaccngccgtcgtcggggacatggtccggcacggttgtgggcgcgcacgggctgcgtggccgaccccgccaccgggcgctttctcctgcgccacggccgactgcggcacgggcgacktcgc

SEQ ID NO: 4352 - protein, 108 aa, Zea mays
  misc_feature: Ceres CLONE 300297-F
  misc_feature (37)..(37): Xaa is any aa, unknown, or other
  misc_feature (70)..(70): Xaa is any aa, unknown, or other
MGASRNRMAILLILQLFLLTALGVDGAASFIFTNACXARGVGGRAPRRHSPPLARSGFYLAPSATSSMDXPSSGTWSGTVVGAHGLRGRPRHRALSPAPRPTAARATS

SEQ ID NO: 4353 - DNA, 375 bp, Zea mays
  misc_feature: Ceres CLONE 300306-F
  misc_feature: Encodes the peptide sequence at SEQ ID NO. 4354
  misc_feature (70)..(70): n is a, c, t, g, unknown, or other
  misc_feature (182)..(182): n is a, c, t, g, unknown, or other
  misc_feature (195)..(195): n is a, c, t, g, unknown, or other
acatctcctcacttcacaccactcccgccattgtcctgcgcctttctgcaccgccacacacaccccgckncaatccaatggcgcctcgcaagccgtcctcgcggtcgtggtcctcgccgcgctgctcccgttcgccctctctcgcgggctgcggcttggccaccaccgcgcccagccgcabncgaggccgcacgnacgcaccgctcggaggtggcgcgtggtcctcggctcacgccaccttctacggcggcggcgatgcgtccggcaccatgggcggggcgtgtgggtacggcaacctctacagccaggggtacggcaccaacacggcggcgcttagcacggcgctcttcaacaacggcctcagctgcggcgcct

SEQ ID NO: 4354 - protein, 99 aa, Zea mays
  misc_feature: Ceres CLONE 300306-F
  misc_feature (35)..(35): Xaa is any aa, unknown, or other
  misc_feature (40)..(40): Xaa is any aa, unknown, or other
MAPRKPSSRSWSSPRCSRSPSLAGCGLATTAPSRXRGRTXAPLGGGAWSSAHATFYGGGDASGTMGGACGYGNLYSQGYGTNTAALSTALFNNGLSCGA

SEQ ID NO: 4355 - DNA, 453 bp, Zea mays
  misc_feature: Ceres CLONE 300324-F
catttttygaccgccgccgcccccagtccccgatccgaagctgtgcctcgtaccatttcgatccaatggcgccgacgtcgaagctgtcgacgggcatcaagcgcgcttcsgtcgcacgcgtaccatcgccgtgggctgtgggccatcaaggcaagaacggcggcgcttccccaaggccgacaaggcgcccgccgccgtggaacccaagttctaccctgccgacgacgtcaagccccgckttcccagcacccgcaagcctaagcctaccaagctcaggtcgagcatcacgcctgggacggtgctgatcctcctcgcaggggcgcttcatggggaagagagtgggtgtttctcaagcagctcaagtcccggcctgctcctttatctcctgggcctttcaagctcaaatgggagtaccgatccgccgtgtgaaccagacctatgtcattgctacat

SEQ ID NO: 4356 - DNA, 484 bp, Zea mays
  misc_feature: Ceres CLONE 300374-F
  misc_feature: Encodes the peptide sequence at SEQ ID NO. 4357
aatccaacaagcaaacctgcagtcatctcctccaccaccaccaccaagctcaacaacagccagctcgcgaaaataatgaagagccgcagcatggcatcatcggccgcgctcttggtgctagccctcgcgctagtggcggccaccgcccacaggtagcggaggcaaagaagaagagagcggcggagagcggcgaggcggcggaggcgaagaagatccaggacgacttctgctcgacgctgtgsaggggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcag

SEQ ID NO: 4357 - protein, 160 aa, Zea mays
  misc_feature: Ceres CLONE 300374-F
  misc_feature (80)..(80): Xaa is any aa, unknown, or other
SNKQTCSHLLHHHHQAQQQPARENNEEPQHGIIGRALGASPRASGGHRPQVAEAKKKRAAESGEAAEAKKIQDDFCSTLXRGKKGTDLVVCKESCALSQQSNLVLYGRIQCKGKCTEQKGITAPAMKVCQEECDKAYVVKAAEVTKACSVTCAKEKNPRL

SEQ ID NO: 4358 - DNA, 460 bp, Zea mays
  misc_feature: Ceres CLONE 300404-F
  misc_feature: Encodes the peptide sequence at SEQ ID NO. 4359
accagaagctcactcgctgctcgttgccggctgcccccgcccactccaccgctgatatttgtcatcgtctcgttcctgccctcggccctccccaactccagcaggcagatcagatacatccattcgcggaccggaaggaaaggaaagggttgaaccatgagcgccgtggctgtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctccccgacgacgaagacctcttctacgacgaccagcccgagcagggccccgtcgctgccgcccttaagacagattcggtgctcaaggcgctgaacatgacctccccgaagc

SEQ ID NO: 4359 - protein, 101 aa, Zea mays
  misc_feature: Ceres CLONE 300404-F
MSAVAVSSSLNPDAPLFIPAALLQVEDFSPQWWDLITTTAWFRDHWSRERAHLDEMAEQIDAAGLPDDEDLFYDDQPEQGPVAAALKTDSVLKALNMTSPK

SEQ ID NO: 4360 - DNA, 474 bp, Zea mays
  misc_feature: Ceres CLONE 300422-F
  misc_feature: Encodes the peptide sequence at SEQ ID NO. 4361
ttcgtcttgctccagccgccgtcggatcggatccgatcaaagcaagcagcagcagccggctccgctcccgcagcagccacaccccgtccgtcaccagaggaagaggaagaggaggatgtcggggtccaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtccccctggcaatact

SEQ ID NO: 4361 - protein, 119 aa, Zea mays
  misc_feature: Ceres CLONE 300422-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPLAI

SEQ ID NO: 4362 - DNA, 258 bp, Zea mays
  misc_feature: Ceres CLONE 300440-F
  misc_feature (86)..(86): n is a, c, t, g, unknown, or other
aggacaggcatgctgaactaggcgaggtggactgggcgagcgagcgagatggagtgaacgacggtggagacgagggacggcgcgangtgagcgtgcggctgttcaagcccccgcgtccggaacgggttggagccggakccgagggaggatgtggcggtggtgctggtgcatccctacaccatcctcggcggcgtgcagggcctgctgcgggggattgcggagggcgtcgcgcggcgtgttacaccgccgttcaccttc

SEQ ID NO: 4363 - DNA, 491 bp, Zea mays
  misc_feature: Ceres CLONE 300457-F
  misc_feature: Translation starting site: 79
aaaaagcttcgaagtgttcgtgcgaaggcgaccctccctccttcgctccttccccgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtctcgccactccaatgggcagggccgctggcggttaaatcagccgggttcatcctggatttgctgaagaatgctgagagtaacgctgatgtgaaaggcttggatgtggacaacctctatatttcacacatccaggtgaaccaagcccagaakcagaggcgccgcacctaccgtgctcacggacgcatcaat

SEQ ID NO: 4364 - DNA, 391 bp, Zea mays
  misc_feature: Ceres CLONE 300476-F
  misc_feature (331)..(331): n is a, c, t, g, unknown, or other
atctcgcctgggatctgctagcttgatctctcctagtcctagcccattcgcttctyctgttcgtcgctcttaatttgcttgctcgatccctggcagtggcagctgctgcaatggcttccggtggcgcgtcgtcactggccttggcgcgctgctcctcgtgagctgcgcctcggcggcggtggcgaccaagtacaccgtcggggacgcgtccggctggacgaccaccggcgactacgcacttgggccagcggcaagaagttcaaagtcggcgacagtctcgagttcaaatacgccggcggggcgcacacggtggacgaggtgagcgcggcgnactacgscttgcctcctccagcaacgcgctcagcaccgacagcgccggcgccacgaccgt

SEQ ID NO: 4365 - DNA, 270 bp, Zea mays
  misc_feature: Ceres CLONE 300511-F
  misc_feature: Encodes the peptide sequence at SEQ ID NO. 4366
  misc_feature (105)..(105): n is a, c, t, g, unknown, or other
  misc_feature (155)..(155): n is a, c, t, g, unknown, or other
acaccagaatccgcgaatcacagacgcgtctatctcagcttgctgcactgcactaccctgccctgccatcatatcgtacgtgagcccggccgagcgagagmgggnagaggcatggctgctccgaagctcgcgacgctggcgctggccgtgctcvntggcggcgaccgtggtggctcccccggccgcggtgcgcgcggattgtcgtgctccaccgtgtacagcacgctgatgccgtgcctgccgttcgtccagatgggcggggccatgcgc

SEQ ID NO: 4366 - protein, 53 aa, Zea mays
  misc_feature: Ceres CLONE 300511-F
  misc_feature (15)..(15): Xaa is any aa, unknown, or other
MAAPKLATLALAVLXGGDRGGSPGRGARGLSCSTVYSTLMPCLPFVQMGGAMR

SEQ ID NO: 4367 - DNA, 278 bp, Zea mays
  misc_feature: Ceres CLONE 300548-F
  misc_feature: SWISSPROT Homolog: EC 2.7.4.3 Adenylate kinase
  misc_feature (258)..(258): n is a, c, t, g, unknown, or other
tgaaacctagaaccctcttcccccgcgatggccgcaggagcggcggcggctcgcagcgcgcgcgtccgaacgtgctagtgacggggacgccggggacgggaagacgaccacgtgctcgctccttgccgacgccgcagstccgccacgtcaacatcggcgacctcgtccgcgagaaggagcctccacgacggctgggacgccgacctcgagtgccatgtcatcaaccaggacctggtgtgcgacgagcttgaggacatnatggaaaaaggtggtatact

SEQ ID NO: 4368 - DNA, 113 bp, Zea mays
  misc_feature: Ceres CLONE 300560-F
acgcacaccgcgacccagtccagagccagtacgtgcgamggcacgcacgctgctggttccgcgtacsagacgacggtcaggtcggccggtgcttttcagtttggaataatgac

SEQ ID NO: 4369 - DNA, 377 bp, Zea mays
  misc_feature: Ceres CLONE 300566-F
  misc_feature: Encodes the peptide sequence at SEQ ID NO. 4370
  misc_feature (137)..(137): n is a, c, t, g, unknown, or other
agatcaggaggagcactgttctccccctacgctgcttcgcggagacaccttcgctcgcgcgctccagaagaaatcaccggctccgcttcgscagttgcaaccacgggacgatgtagtgatggtgaggctgtcgccgncgsstaggacgtgaagagcttggccgtcacctggttgggggcctcgaacgccagggccgccggggcgtggccggcgccgtggagcgcggcgttgatcctggcgatgagctcctggccgcagtctcgtcgcgcaccttccagacgcactgcagccgcgcggacgctgctcgtcgccgtcgccgtcgccgccggagaggacgagcctccacccgacgaccttgaaagaggagcctgckcgcg

SEQ ID NO: 4370 - protein, 44 aa, Zea mays
  misc_feature: Ceres CLONE 300566-F
MSSWPQSRRAPSRRTAAARTLLVAVAVAAGEDEPPPDDLERGAC

SEQ ID NO: 4371 - DNA, 427 bp, Zea mays
  misc_feature: Ceres CLONE 300570-F
  misc_feature: Encodes the peptide sequence at SEQ ID NO. 4372
  misc_feature (193)..(193): n is a, c, t, g, unknown, or other
  misc_feature (342)..(342): n is a, c, t, g, unknown, or other
  misc_feature (351)..(351): n is a, c, t, g, unknown, or other
  misc_feature (380)..(380): n is a, c, t, g, unknown, or other
atctcaagccaccatcgaccttcaagtctcgctacgtagcagtgcaataaaaaaagcagccgcaatggcgagcagcaccatggccctctcctccacggccttcgccggcaagscgtgaacgtgccgtcgtcgtccgccttcggsaggcccgcgtgacgatgcgcaagayggcggcgaaggcaagccagcgsgncgtccgggagcccgtggtacgccccgaccgcgtgctgtacctgggcccactgtccggcgagccaccgagctacctkacgggcgagttcccgggcgactacggctgggacaccgcggggctgtcggcggacccgggagacgttcgccaanaaccggganctggaggtgatccactcccgctggccatnctgggcgcgctcggctgcgtcttccccgagctgctcgcccgcaacgg

SEQ ID NO: 4372 - protein, 89 aa, Zea mays
  misc_feature: Ceres CLONE 300570-F
  misc_feature (4)..(4): Xaa is any aa, unknown, or other
  misc_feature (12)..(12): Xaa is any aa, unknown, or other
  misc_feature (62)..(62): Xaa is any aa, unknown, or other
  misc_feature (65)..(65): Xaa is any aa, unknown, or other
  misc_feature (74)..(74): Xaa is any aa, unknown, or other
MRKXAAKASQRXVREPVVRPDRVLYLGPLSGEPPSYLTGEFPGDYGWDTAGLSADPGDVRQXPGXGGDPLPLAXLGALGCVFPELLARN

SEQ ID NO: 4373 - DNA, 329 bp, Zea mays
  misc_feature: Ceres CLONE 300587-F
  misc_feature: Encodes the peptide sequence at SEQ ID NO. 4374
  misc_feature (142)..(142): n is a, c, t, g, unknown, or other
acaaccaagctcgatccatctcactctccgctggtcgctcactcttgcagctccacccttcactcagtcttagtctcttattagctctaggctctagctagccgcgccactccttcgtgtagccatcagccttctcatcgynaccaatggccactgccgaggtccagaccccgaccgtcgtggcggccgaggaagcgcccgtggtggagaccccgccgccggccgtcgtgcccgaggagtctgcccccgccgaggccgaggccgagscgaggytgctgctcctgctgatcccgaggagcttcccgcggccgagcagcaggcagccgccg

SEQ ID NO: 4374 - protein, 61 aa, Zea mays
  misc_feature: Ceres CLONE 300587-F
  misc_feature (41)..(41): Xaa is any aa, unknown, or other
MATAEVQTPTVVAAEEAPVVETPPPAVVPEESAPAEAEAEXRLLLLLIPRSFPRPSSRQPP

SEQ ID NO: 4375 - DNA, 174 bp, Zea mays
  misc_feature: Ceres CLONE 300596-F
  misc_feature (60)..(60): n is a, c, t, g, unknown, or other
acagcatctcaagccaccatcgatctgcaagtytcgctacgtagcagtgcaatacaaaanaagcagccgcaatggcgagcagcaccatggccctctcctccacggccttcgccgggcaagscgtgaacgtgccgtcgtcgtccgccttcggsaggcccgcgtgacgatgcgcaa

SEQ ID NO: 4376 - DNA, 476 bp, Zea mays
  misc_feature: Ceres CLONE 300614-F
  misc_feature: Encodes the peptide sequence at SEQ ID NO. 4377
attgggagctcactcgctggtcgttgcctgctgcggattgcccccaggcgggccccactcattccgctgctgatatttcgtttggttctcctttccgtcttgtccgtcgccgaggccttccgctcgctccccagctccagcaggcagatcagatccatccaaccacgaacaggaaggaaggtaggaggaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggacctcttctacggcgagcaggcccccgccgccgccgcccttaagacagaattc

SEQ ID NO: 4377 - protein, 90 aa, Zea mays
  misc_feature: Ceres CLONE 300614-F
MSAVAVSSSLNPNAPLFIPAALLQVEDFSPQWWDLITTTAWFRDHWSREHAHLDEIAEQLELVALLAYDEDEDLFYGEQAPAAAALKTEF

SEQ ID NO: 4378 - DNA, 136 bp, Zea mays
  misc_feature: Ceres CLONE 300656-F
  misc_feature (67)..(67): n is a, c, t, g, unknown, or other
acgcacaccgcgacccagtccagagccagtacgtgcgamggtcacgcacgctgctggtccgcgtacnagacgacggtcaggtcggccggtgcttttyagtttggaataatgacggcgacgacgacgacagccgccg

SEQ ID NO: 4379 - DNA, 120 bp, Zea mays
  misc_feature: Ceres CLONE 300708-F
acacgcacaccgcgacccagtccagagccagtacgtgcgamgcacgcacgctgctggtccgcgtacsagacgacggtcaggtcggccggtgcttttcagtttggaataatgacggcgacg

SEQ ID NO: 4380 - DNA, 376 bp, Zea mays
  misc_feature: Ceres CLONE 300712-F
  misc_feature: Encodes the peptide sequence at SEQ ID NO. 4381
  misc_feature (45)..(45): n is a, c, t, g, unknown, or other
  misc_feature (191)..(191): n is a, c, t, g, unknown, or other
  misc_feature (270)..(270): n is a, c, t, g, unknown, or other
atcatttcaacctctctccctcggcctcgcsgcggcacagcgcanttttccactgttgggtgtggtggatttcctccgcccccgaacgatcgatcttttgcatggcagcagcggctagctccaaggggcgggcgatcgctgggagcttcgtcagccgcgtcctggccggcaaggcgcctccccgaggaggnccgtgcacgcytcgtcgtacgacaagaacccggagagcaggtgcgcccggcgttcgtgccgacgatgtgatcggcggcncggggagccccgacaagtactggagcccccaccccaagaccggcgtgttcggcccggcggcggtggacaccaaccagctgggcgtcgcgctgacgctgccgccgcg

SEQ ID NO: 4381 - protein, 91 aa, Zea mays
  misc_feature: Ceres CLONE 300712-F
  misc_feature (34)..(34): Xaa is any aa, unknown, or other
  misc_feature (57)..(57): Xaa is any aa, unknown, or other
MAAAASSKGRAIAGSFVSRVLAGKAPPRGGPCTXRRTTRTRRAGAPGVRADDVIGGXGSPDKYWSPHPKTGVFGPAAVDTNQLGVALTLPP

SEQ ID NO: 4382 - DNA, 492 bp, Zea mays
  misc_feature: Ceres CLONE 300791-F
  misc_feature: Translation starting site: 180
cctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgctttgctgaggactgtgaccagccagattatgtcaagctggtgaaggcactctgcgcggasacaatgttcacctggtcactgttcctgcccgctaagacccttggcgagtgggctgggctttgcaagattgactctgagggcaaggcaaggaaggttgtaggctgctcctgtgtcgtcgtccaaggactacggtggaagaatctgagggccttaacatagtgc

SEQ ID NO: 4383 - DNA, 124 bp, Zea mays
  misc_feature: Ceres CLONE 300812-F
acacgcacaccgcgacccagtccagagccagtacgtgcgamrcacgcacgctgctggtccgcgtacgtagacgacggtcaggtcggccggtgcttttcagtttggaataatgacggcgacgacg

SEQ ID NO: 4384 - DNA, 312 bp, Zea mays
  misc_feature: Ceres CLONE 300837-F
  misc_feature: Encodes the peptide sequence at SEQ ID NO. 4385
agtcgcctccttcctgcgccgccgccgccgccgccgctaccaccgcctcgsccgcctgckstccgcgtttccgcacggaagttggtgaaggtttcttgaggctgagaacatggtgctgaagacggaactttgccgcttcacgcaaggaagatttatcctgggaaaggcattagatttatccgtgctgatttctcaggtcttcctttttgccaactcgaaatgcaagckctacttccacaaccgcctgaagcctgcaaagcttacctgggacagcaatgtacaggaagcagcacaagaaggatatccatgctg

SEQ ID NO: 4385 - protein, 67 aa, Zea mays
  misc_feature: Ceres CLONE 300837-F
  misc_feature (3)..(64): Pfam Name: Ribosomal_L24e Pfam Description: Ribosomal protein L24e
  misc_feature (40)..(40): Xaa is any aa, unknown, or other
MVLKTELCRFTQGRFILGKALDLSVLISQVFLFANSKCKXYFHNRLKPAKLTWDSNVQEAAQEGYPC

SEQ ID NO: 4386 - DNA, 250 bp, Zea mays
  misc_feature: Ceres CLONE 300851-F
gtgcccgcggtgctactgacggttgctctagatccgttcatcctggtggttttgtgaggtcgaaagcggcgagcgaattagaagatgctggacaagctgtgggacgacgtggtggccgggcctcgccgaaggacggcctcgagaagctccgcaagccaccaccgcccgcccgctcgtcatcaacaaagacgcggacggcggcagctacaagcggggcgcattcgatgccgtcgaccccgacgacgccggt

SEQ ID NO: 4387 - DNA, 432 bp, Zea mays
  misc_feature: Ceres CLONE 300910-F
  misc_feature (107)..(107): n is a, c, t, g, unknown, or other
  misc_feature (339)..(339): n is a, c, t, g, unknown, or other
  misc_feature (342)..(342): n is a, c, t, g, unknown, or other
atcaatcctcatcgccacccaacccgccgagtccccaagcaagttgagcatccatccatccatggcgggaggcaagtycaccggcaatgcsgcgcgcasaggaagcncgtcgaggcaaccgtcctcaatgckctccagggacgggagcscttcaccagatgckaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaanttncgcccaccgccttcttcctcttcatggacgacttcaggaaggagttcaaggccacccatcctgacaacaagagtgtcgctaccgttgcaa

SEQ ID NO: 4388 - DNA, 226 bp, Zea mays
  misc_feature: Ceres CLONE 300926-F
  misc_feature: SWISSPROT Homolog: EC 2.7.4.3 Adenylate kinase
gawacctagaaccctcttcccccgcgatggccgcaggagcgcggcgctcgcggcgscgcgtccgaacgtgctagtgacggggacgccggggacgggaagacgaccacgtgctcgctccttgccgacgccgcmstccgccacgtcaacatcggcgacctagtccgcgagaagagccttcacgacggctgggacgccgacctcgagtgccatgtcatcaacgaggacc

SEQ ID NO: 4389 - DNA, 170 bp, Zea mays
  misc_feature: Ceres CLONE 300929-F
  misc_feature (34)..(34): n is a, c, t, g, unknown, or other
acaccaagaatcacacaacagcagctcaaaawancaacacacctcaacaagcagagcaaagacccgggattcgccggcgcggtasagaagcrgakatggacgggaggatgttcggtctcgagacccccctgatggtggcgctgcagcaccttctggacgtgcccgacggc

SEQ ID NO: 4390 - DNA, 463 bp, Zea mays
  misc_feature: Ceres CLONE 300955-F
  misc_feature: Encodes the peptide sequence at SEQ ID NO. 4391
  misc_feature (17)..(17): n is a, c, t, g, unknown, or other
  misc_feature (18)..(18): n is a, c, t, g, unknown, or other
  misc_feature (96)..(96): n is a, c, t, g, unknown, or other
  misc_feature (97)..(97): n is a, c, t, g, unknown, or other
ttccacccgcttccccnngccgcacgaaaccctaacgccgccgccgcttcacaggtaagccgccgtcatggtctccggttccggcgtatgcgcganncgtggttggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaattacctccgctttctccgcaagcggatgaacaccaagccatcccatgggcccatccacttccgcgccccgtccaagatcctgtggcgcaccatccgcgggatgattccgcacaagaccaagaggggggaggcggctctggcgaggctcaagacgtacgagggcgtcccgcgccktacgacaagaccaagcgcctggtcatccctgacgctcttaaggtcctgaggct

SEQ ID NO: 4391 - protein, 123 aa, Zea mays
  misc_feature: Ceres CLONE 300955-F
  misc_feature (5)..(117): Pfam Name: Ribosomal_L13 Pfam Description: Ribosomal protein L13
  misc_feature (3)..(3): Xaa is any aa, unknown, or other
  misc_feature (4)..(4): Xaa is any aa, unknown, or other
  misc_feature (108)..(108): Xaa is any aa, unknown, or other
MRXXWLDARHHMLGRLSSIIAKELLNGQKVVVVRCEEICMSGGLVRQKMNYLRFLRKRMNTKPSHGPIHFRAPSKILWRTIRGMIPHKTKRGEAALARLKTYEGVPRXTTRPSAWSSLTLLRS

SEQ ID NO: 4392 - DNA, 720 bp, Zea mays
  misc_feature: Ceres CLONE 300956
  misc_feature: Encodes the peptide sequence at SEQ ID NO. 4393
catcacccaaaacacaagtagggttaggaaggcggcggccagcggcgagaggaggaggggtcggccatgacggggaaggcgaagccgaagaagcacacagcgaaggagatcgccgcgaagatcgacgcggcgacgacgaaccggggtggcggcaaggccgggcaggcggaccggctggggctctgccgcaccccggcgcccgacatcaagtccatgcagatccaccacgaggcgcgccaccccaagctccccttcgagccggagaagctcctcaacctgcactcctccgcccccgctgctgctgctgccgccgccgccgccgccgccgccgctgccgaggccaccacctccaagcccaagcccggcgtccgcggcagcctcaagaagtaagcttgctggcttggttggctcgcccgcctgcatggggcacaattcccttcggtttcaatcccatccgccgacccgatctataatcaatcaaaccgccgccctccggcctggcggctgccgctcggcctgcggtgtactgttagtctgctgctgatttccgttgttatactgctggtacatgtgtcgtgtgatagatgtgtcaactatatatcaatctcgtcgccggcagctctggcatgtttgagtatgtgttgctgctctgtggtgccggcgacgatggctcctagtactgttaatgtgatcgggtctccttgaaaaaaaaaaaaaaaa

SEQ ID NO: 4393 - protein, 107 aa, Zea mays
  misc_feature: Ceres CLONE 300956
MTGKAKPKKHTAKEIAAKIDAATTNRGGGKAGQADRLGLCRTPAPDIKSMQIHHEARHPKLPFEPEKLLNLHSSAPAAAAAAAAAAAAAAEATTSKPKPGVRGSLKK

SEQ ID NO: 4394 - DNA, 447 bp, Zea mays
  misc_feature: Ceres CLONE 300966-F
  misc_feature: Encodes the peptide sequence at SEQ ID NO. 4395
  misc_feature (69)..(69): n is a, c, t, g, unknown, or other
  misc_feature (127)..(127): n is a, c, t, g, unknown, or other
attccatcctagggctcgcgagtygcgtcccccaaagtgaatacagaaacctccagccccaggccaatncctcgaccgcatcgccacccaccccatctccatggctacctccgccctcgctgctctntccgccaccgcgccgccgccggtbaagcgcatcctcctgtcgcgtchccgcctcctcctcctccctctccttcgcctcccgccgcctggccgccggggcaccctccggggttccttggcgagccaatccgggccgtggcgtcgtcggcgtcggcggcccccgcggcggcgccaagaccatcgcggtcggggaccggctccctgacgcgacgctctcctacttcgacacgtcctcccccgacggcgagctgaagacggtgacggtccgcgactcaccgcggggaagaaggtggtgctcttcgccgtgcccggscgttcacg

SEQ ID NO: 4395 - protein, 148 aa, Zea mays
  misc_feature: Ceres CLONE 300966-F
  misc_feature: SWISSPROT Homolog: EC 1.11.1.15 Peroxiredoxin
  misc_feature (8)..(8): Xaa is any aa, unknown, or other
  misc_feature (23)..(23): Xaa is any aa, unknown, or other
  misc_feature (42)..(42): Xaa is any aa, unknown, or other
  misc_feature (50)..(50): Xaa is any aa, unknown, or other
  misc_feature (58)..(58): Xaa is any aa, unknown, or other
  misc_feature (146)..(146): Xaa is any aa, unknown, or other
SILGLASXVPQSEYRNLQPQANXSTASPPTPSPWLPPPSLLXPPPRRRRXSASSCRVXASSSSLSFASRRLAAGAPSGVPWRANPGRGVVGVGGPRGGAKTIAVGDRLPDATLSYFDTSSPDGELKTVTVRDSPRGRRWCSSPCPXVH

SEQ ID NO: 4396 - DNA, 275 bp, Zea mays
  misc_feature: Ceres CLONE 300999-F
  misc_feature (158)..(158): n is a, c, t, g, unknown, or other
  misc_feature (159)..(159): n is a, c, t, g, unknown, or other
aacacaaaaacccagcatcagtcaagctcgctcacacgaccatggccgcggcgatgaccggcagtactcgcgccaggcggctccttcctcgtgcttctctttgtcgtgttggccggtgtcgtcgacgtcgcgtccgctgccaccactgcggcgagtgnnactgttgccactaacagcggtgacagcaacgcgcggccttctgacgatgccggcgtcggcgtccacggggcagctgaatgggcatcatccaggtgcctgctggggctgcttcacgc

SEQ ID NO: 4397 - DNA, 347 bp, Zea mays
  misc_feature: Ceres CLONE 301022-F
  misc_feature: Encodes the peptide sequence at SEQ ID NO. 4398
agctttgaacctggttctcctgtcgctcttcgtgcggcacaccaccagaagagcggccgagcgcgcagagaagagagaaccagccgagcggggcctgcgcttccggaggaggaaggaggatggagaaggctctcaccaagctcggcagcttcacaatctcccgcaagccaagcaggagctctccgccatcggtgacgacatctcccgtttttcgagcacggtggaggakaaggcaaaatgggtgttcgagaaactcaaakggcacaagaagtcgctcccttatctactgcgcgasacaacctccctccaggtctcttccctcgtaacatcatctgctacgagtacga

SEQ ID NO: 4398 - protein, 115 aa, Zea mays
  misc_feature: Ceres CLONE 301022-F
  misc_feature (76)..(76): Xaa is any aa, unknown, or other
  misc_feature (87)..(87): Xaa is any aa, unknown, or other
  misc_feature (98)..(98): Xaa is any aa, unknown, or other
ALNLVLLSLFVRHTTRRAAERAEKREPAERGLRFRRRKEDGEGSHQARQLHNLPQAKQELSAIGDDISRFSSTVEXKAKWVFEKLKXHKKSLPYLLRXTTSLQVSSLVTSSATST

SEQ ID NO: 4399 - DNA, 347 bp, Zea mays; identical to SEQ ID NO: 4397
  misc_feature: Ceres CLONE 301022-F2

SEQ ID NO: 4400 - DNA, 447 bp, Zea mays
  misc_feature: Ceres CLONE 301059-F
  misc_feature (112)..(112): n is a, c, t, g, unknown, or other
  misc_feature (113)..(113): n is a, c, t, g, unknown, or other
  misc_feature (159)..(159): n is a, c, t, g, unknown, or other
  misc_feature (160)..(160): n is a, c, t, g, unknown, or other
  misc_feature (229)..(229): n is a, c, t, g, unknown, or other
  misc_feature (277)..(277): n is a, c, t, g, unknown, or other
  misc_feature (378)..(378): n is a, c, t, g, unknown, or other
aatcacaaactcactacacgatcggctatagcgagctaacagaagctctatcaagtactgtgtaggccatggcggagccctcgtcttcgtcgctgttctcctcgccgcaagnntcggcgctacgacggctaccacgctgaccatccacaacctctgccnncacccggtgtggccgctggtgaccccgagctcgggcttcccctccatctccaccaacaccgcgcggctnggccccaacgcgctgctctccctctccttcccgcccaccttctgggcnggccgcgtcgccgcgcgcaacgggctgcgacgccgccggtccggctgctggacggggaccacgccgcccgccaccgtcgtgcaggtcaccgtccacgacgncgggaactggaccaggcyacctacagcgtgtctctcgtcgacggcttcaacgtgcccatggtggtcagc

SEQ ID NO: 4401 - DNA, 201 bp, Zea mays
  misc_feature: Ceres CLONE 301073-F
gtgcccgcggtgctagtgacggttgctctagatccgttcatcctggtggttttgtgaggtcgaaagcggcgagcgaattagaagatgctggacaagctgtgggacgacgtggtggccgggcctcgccgaaggacggcctcgagaagctccgcaagccaccaccgcccgcccgctcgtcatcaacaaagacgcggacggcgg

SEQ ID NO: 4402 - DNA, 137 bp, Zea mays
  misc_feature: Ceres CLONE 301104-F
acacgcacaccgcgacccagtccagagccagtacgtgcgamgtcacgcacgctgctggtccgcgtacsagacgacggtcaggtcggccggtgcttttcagtttggaataatgacggcgacgacgacgacagccgccg

SEQ ID NO: 4403 - DNA, 277 bp, Zea mays
  misc_feature: Ceres CLONE 301107-F
  misc_feature: Translation starting site: 80
  misc_feature (182)..(182): n is a, c, t, g, unknown, or other
  misc_feature (240)..(240): n is a, c, t, g, unknown, or other
aagagctcgcccacctcgcccccccccatccagctccgaccctagggtttccatccggctcttccggaagcttccgaaaatggccaccgacgagctcgcccacgccgtcgcccccgccccggccggggagaccactccccggcttctcgttcagcatctggccgccgacgcagcgcacgcgngacgtgtggtgcggcgcctcgtggagacgctcgcgggagacaccatcctctgcaagcnctacggtgcggtgccggccgccgacgccgagcccgcg

SEQ ID NO: 4404 - DNA, 464 bp, Zea mays
  misc_feature: Ceres CLONE 301113-F
  misc_feature: Encodes the peptide sequence at SEQ ID NO. 4405
  misc_feature (217)..(217): n is a, c, t, g, unknown, or other
  misc_feature (403)..(403): n is a, c, t, g, unknown, or other
aacactctcctccttcctccaccgccgcctcgcctggcgccgtctgcagctccgcgcctctgctcggaagttggtgaaggtttcttgaagctgagaagatggtgctgaagacagaactctgccgcttcagcgcaaggaagatttatcctgggaaaggcatccgatttatccgtgctgattctcaggttttcctttttgccaactcaaaatgcaagcnctacttccacaaccgcctgaagcctgcaaagcttacctggacagcaatgtacaggaagcagcacaagaaggatatccatgctgaggctgtcaagaagaggcgccgcgccaccaagaagccatactcgaggtccattgtgggtgcttccctagaggtgatccagaagaagagggctgagaagccagnggtccgcgatgctgctagagaagctgctcttcgcgagatcaaggagcgcatcaagaagacc

SEQ ID NO: 4405 - protein, 122 aa, Zea mays
  misc_feature: Ceres CLONE 301113-F
  misc_feature (3)..(73): Pfam Name: Ribosomal_L24e Pfam Description: Ribosomal protein L24e
  misc_feature (40)..(40): Xaa is any aa, unknown, or other
  misc_feature (102)..(102): Xaa is any aa, unknown, or other
MVLKTELCRFSARKIYPGKGIRFIRADSQVFLFANSKCKXYFHNRLKPAKLTWTAMYRKQHKKDIHAEAVKKRRRATKKPYSRSIVGASLEVIQKKRAEKPXVRDAAREAALREIKERIKKT

SEQ ID NO: 4406 - DNA, 476 bp, Zea mays
  misc_feature: Ceres CLONE 301164-F
  misc_feature: Encodes the peptide sequence at SEQ ID NO. 4407
  misc_feature (138)..(138): n is a, c, t, g, unknown, or other
tccactcgccctcccacacagaaaaccctagccgccgccaccgaagcggcctcccaggtaagcaggagcgtccaccccgchgccgtcatgaagcgcaatccccgcgtcacgagctcccgccggaagtgccgcaagcanctttacggccccgtcctccgtccgccgcgttctcatgtccgccgggctgtcgacggagctccgccacaagtacaacgtgcgctccatcccgatccgcaagacgacgaggtgcaggtcgtgcgcggcmctacaagggccgcaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaagcgctcctggaccgcaagcccggggcgcgcgccgacaaggctaagggcaa

SEQ ID NO: 4407 - protein, 101 aa, Zea mays
  misc_feature: Ceres CLONE 301164-F
MSAGLSTELRHKYNVRSIPIRKTTRCRSCAALQGPQGKVVQVYRRRWVIHVERITREKVNGSTVNVGIHPSKVIVTKLKLDKDRKRSWTASPGRAPTRLRA

SEQ ID NO: 4408 - DNA, 485 bp, Zea mays
  misc_feature: Ceres CLONE 301165-F
  misc_feature: Translation starting site: 179
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgagggcctttaacatag

SEQ ID NO: 4409 - DNA, 341 bp, Zea mays
  misc_feature: Ceres CLONE 301198-F
  misc_feature: SWISSPROT Homolog: EC 3.1.27.1 Ribonuclease T(2)
  misc_feature (89)..(89): n is a, c, t, g, unknown, or other
  misc_feature (90)..(90): n is a, c, t, g, unknown, or other
  misc_feature (104)..(104): n is a, c, t, g, unknown, or other
  misc_feature (276)..(276): n is a, c, t, g, unknown, or other
atctcccacctcgatccctgcgctgcaasaacaaagttctactctgtccacccgtccatctagctcccaagaaccaacccgtaccagcnntatccggccggcyntggcggcggcgcgcggctctccctgcccctcgtcctgctggtcgtcctggccgtcgccgggcgcgcggcggcgcaggactacgacttcttctacctcgtgctgcagtggccgggggctcactgcgacaccaagcagagctgctgctaccccaagtccggcaagccggcgggnacttcgggatccacggcctctggccaaccgcgacgacggcacgtacccgcagaactgcagccccg

SEQ ID NO: 4410 - DNA, 145 bp, Zea mays
  misc_feature: Ceres CLONE 301213-F
  misc_feature (68)..(68): n is a, c, t, g, unknown, or other
caaacccgtgagaaatcgaatcgagaagggaagagcacgcgccgtcgccagcaccgcgttccgcyakngccgcctcctccccccgcgcgttgcaatcgctggggtccgccgcctcccgcttcctccacgcgcggggcttcgcgcg

SEQ ID NO: 4411 - DNA, 166 bp, Zea mays
  misc_feature: Ceres CLONE 301223-F
aacagttcggattcagatcgcggccggtgcgaacccacgaaggcacgaacggtagaacccgaccgagcgcggcaraactccgatccctgctgcgagcaaggatggcggcggcatgggcaktgctggcggcggtgctcgtcgcagcgcaggtggcgtctgctgcgcc

SEQ ID NO: 4412 - DNA, 457 bp, Zea mays
  misc_feature: Ceres CLONE 301255-F
  misc_feature: Translation starting site: 90
  misc_feature (140)..(140): n is a, c, t, g, unknown, or other
  misc_feature (348)..(348): n is a, c, t, g, unknown, or other
atccactcgccctcccacacagaaaaccctagccgccgccaccgaagcggcctcccaggtaagcaggagcgttccaccccgccgccgtcatgaagcgcaatccccgcgtcacgagctcccgccggaagtgccgcaagcanctttacggccccgtcctccgtccgccgcgttctcatgtccgccgggctgtcgacggagctccgccacaagtacaacgtgcgctccatcccgatccgcaagacgacgaggtgcaggtcgtgcgcggcacctacaagggccgctaggggaaggtggtgcaggtctaccgccgccgctgggtcatccacgtcgagcggatcacccgcgganaaggtgaacggctccaccgtgaacgtgggcatccacccctccaaggtgatcgtcactaagctgaagctcgacaaggaccgcaagcgctcctggaccgcaagcccggggc

SEQ ID NO: 4413 - DNA, 485 bp, Zea mays
  misc_feature: Ceres CLONE 301329-F
  misc_feature: Translation starting site: 141
  misc_feature (175)..(175): n is a, c, t, g, unknown, or other
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcnagaaccaccccgacaaggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctct

SEQ ID NO: 4414 - DNA, 288 bp, Zea mays
  misc_feature: Ceres CLONE 301344-F
  misc_feature: Encodes the peptide sequence at SEQ ID NO. 4415
  misc_feature (138)..(138): n is a, c, t, g, unknown, or other
  misc_feature (230)..(230): n is a, c, t, g, unknown, or other
  misc_feature (235)..(235): n is a, c, t, g, unknown, or other
  misc_feature (245)..(245): n is a, c, t, g, unknown, or other
actcatacatttcgactctcaactcccaaggtccctttttttttctcgatctggaagcgccgcagtagcagccatggacgtgagcggacaggcggtaaggcgaagaagggcgcggcggggcsaaggccggcgggcgancgaagaagtcggtgtcgcggtcctccagggccgggctkcagttccccgtcagccgcgtcgggcgttacctcaaaaagggccggtacgcgcangttanggcacgggtncccccgtctacctcgccgccgtcctggagtacctcgcggccga

SEQ ID NO: 4415 - protein, 71 aa, Zea mays
  misc_feature: Ceres CLONE 301344-F
  misc_feature (17)..(17): Xaa is any aa, unknown, or other
  misc_feature (22)..(22): Xaa is any aa, unknown, or other
  misc_feature (35)..(35): Xaa is any aa, unknown, or other
  misc_feature (53)..(53): Xaa is any aa, unknown, or other
  misc_feature (54)..(54): Xaa is any aa, unknown, or other
  misc_feature (58)..(58): Xaa is any aa, unknown, or other
MDVSGQAVRRRRARRGXGRRAXEEVGVAVLQGRAXVPRQPRRALPQKGPVRAXXGTGXPVYLAAVLEYLAA

SEQ ID NO: 4416 - DNA, 485 bp, Zea mays
  misc_feature: Ceres CLONE 301378-F
  misc_feature: Translation starting site: 85
acacgcgaatcctcaaatctgcccttgccgccgccaccgcccgatccaggtctgcagactgctccctcctcctctccgctccgaatggcccgcacgaagcagacggcgcgcaagtcgaccggcggcaaggcgccgcggaagcagctggccaccaaggcggcgcgcaagtyggccccggccacgcggcgtgaagaagccgcaccgcttccgccccggcaccgtcgcgctccsagatccgcaagtaccagaagagcacggagctgctcatccgcaagctccccttccagcgcctcgtccgcgagatcgcgcaggacttcaagacggacctgcggttccagtcctcggccgtgggcggcgctgcaggaggccgcgggaggcgtaacctgggtggggctcttcgaggacaccaacctctgcgccatccacgccaagagggtcacatcatgcccaaggacattccagctcgcccgccgcatcaggggcga

SEQ ID NO: 4417 - DNA, 443 bp, Zea mays
  misc_feature: Ceres CLONE 301399-F
  misc_feature: Encodes the peptide sequence at SEQ ID NO. 4418
  misc_feature (357)..(357): n is a, c, t, g, unknown, or other
gagtttccgtgccgtagcaacagmcaagggagagtgggagactagcgcaacaggacagcgcacggaaagcgaggggaggggagacggagagggcgcatcggacggcggcgagatgctggcggtgttcgatcccacggtggccaagtgcccggagtctccgcagccccccggtcgccggggcggccgctggagcaggcggggccgtcgcgggcgcctgaatgaagggcttctccgactcgcacgacggcgccgtcaccgtcagcctgggcccctccgacgcgctggcctactcggcggccaaccagagcccccctcgtgccaaggttgtttggtgctgtgaatgacatcttctgcttnttccaagggcacattragaacattgccaacctgaagcagcattatggcctgagcaagactgcaaatkaggtgactatcctcataga

SEQ ID NO: 4418 - protein, 41 aa, Zea mays
  misc_feature: Ceres CLONE 301399-F
MKGFSDSHDGAVTVSLGPSDALAYSAANQSPPRAKVVWCCE

SEQ ID NO: 4419 - DNA, 436 bp, Zea mays
  misc_feature: Ceres CLONE 301400-F
  misc_feature: Encodes the peptide sequence at SEQ ID NO. 4420
  misc_feature (51)..(51): n is a, c, t, g, unknown, or other
  misc_feature (333)..(333): n is a, c, t, g, unknown, or other
  misc_feature (362)..(362): n is a, c, t, g, unknown, or other
agtgtccgcatttcaaactgggctccataaagttctgtcgcctcgcctgtnacctgtaggtagcagcaggcagcggaggggagagagagagaggggatggattctcaagcgccgcttcgtcctcctctagctttcgcctgcttcatcttcctttgctcatccatctgcgcmaaatgggatgtacgacagggttggtgcggcggcgtcagatggggagagcaggaggatgcggctgcacaccgacgggagccgcggcgacscacgskggcctgggtacctctacacccgagcagttgggagatgcacaccccaattctggagcagcggascganccctggcccaacatcgtcccacagggaancggcggtggcraaggtgttcgggtctaggtccgtggagcgctacgggccgcgcttcaccctgctggaactacca

SEQ ID NO: 4420 - protein, 86 aa, Zea mays
  misc_feature: Ceres CLONE 301400-F
  misc_feature (28)..(28): Xaa is any aa, unknown, or other
  misc_feature (30)..(30): Xaa is any aa, unknown, or other
  misc_feature (51)..(51): Xaa is any aa, unknown, or other
  misc_feature (52)..(52): Xaa is any aa, unknown, or other
  misc_feature (62)..(62): Xaa is any aa, unknown, or other
MYDRVGAAASDGESRRMRLHTDGSRGDXRXPGYLYTRAVGRCTPQFWSSGXXPGPTSSHREXAVAKVFGSRSVERYGPRFTLLELP

SEQ ID NO: 4421 - DNA, 492 bp, Zea mays
  misc_feature: Ceres CLONE 301425-F
  misc_feature: Encodes the peptide sequence at SEQ ID NO. 4422
gaaacctagaaccctcttcccccgcgatggccgcaggagcgcggcgctcgcggcgscgcgtccgaacgtgctagtgacggggacgccggggacgggaagacgaccacgtgctcgctccttgccgacgccgcmstccgccacgtcaacatcggcgacctagtccgcgagaagagccttcacgacggctgggacgccgacctcgagtgccatgtcatcaacgaggacctggtgtgcgacgagcttgaggacatgatggaagaaggtggtatactagtagattaccacggatgtgatttctttccagaacgttggtttgacctcgtagttgtgctccagactgacaactcaattctgcatgatcgcctgacgggcagaggttacatgggttccaagctcgccaacaacatagagtgcgaaatcttccaagtgctcctcgaggaggcgagggagatctacagagaggacatcgtgatgccattgcgaagtgacaac

SEQ ID NO: 4422 - protein, 81 aa, Zea mays
  misc_feature: Ceres CLONE 301425-F
  misc_feature: SWISSPROT Homolog: EC 2.7.4.3 Adenylate kinase
MMEEGGILVDYHGCDFFPERWFDLVVVLQTDNSILHDRLTGRGYMGSKLANNIECEIFQVLLEEAREIYREDIVMPLRSDN

SEQ ID NO: 4423 - DNA, 438 bp, Zea mays
  misc_feature: Ceres CLONE 301469-F
  misc_feature: Pfam Name: UMP1 Pfam Description: Proteasome maturation factor UMP1
  misc_feature (116)..(116): n is a, c, t, g, unknown, or other
  misc_feature (119)..(119): n is a, c, t, g, unknown, or other
aaaagagccagtccctgcgtttccttacttcctggtaaagaaagaagcgavcagggtacttgttgttgagcgcggagagaggagaggcgcagagcatcgacgatggcgagcggcanatnaagagggagatcagcgagacccacgacaccctccgcttcggcctcaatgccggcgtcaaggccgacctcgckccgccgcacccgctccagtycagcatccaatcggaggccaarttctcggcggacaagaagaagtttgggacarawgccatctacggatccgccttgaacatccgcaagatctcgatgcccaaatcctctcaaggttccaaaggccccctsgtgctttgccatcatctctgcttsgatatgaggcactgacaggttccctagatgattttcggtytttaagattatcttaacatgcctcaagattctg

SEQ ID NO: 4424 - DNA, 322 bp, Zea mays
  misc_feature: Ceres CLONE 301490-F
  misc_feature: Encodes the peptide sequence at SEQ ID NO. 4425
  misc_feature (168)..(168): n is a, c, t, g, unknown, or other
atcaccaagttttggattccagcagcggcgcccccaggccaggccccacccgctcagcctcctcagctgcccaaccttctccccatctgctcagcctcagctgtcattcccgcgarscgtctcccggctctatcgatggaccgagtcgccgccctcgtcgtcgcgctnctcgccctcttcttcgccgccggggccacggcgcaggccccggcttcgtcgcccaagcgcactccagcgccagccacccaggacggccttcctcccgccgccgccggccagggcgcctatggcctccccgccctcgcctcccgcgatggcgccg

SEQ ID NO: 4425 - protein, 62 aa, Zea mays
  misc_feature: Ceres CLONE 301490-F
MDRVAALVVALLALFFAAGATAQAPASSPKRTPAPATQDGLPPAAAGQGAYGLPALASRDGA

SEQ ID NO: 4426 - DNA, 110 bp, Zea mays; identical to SEQ ID NO: 3943
  misc_feature: Ceres CLONE 301512-F

SEQ ID NO: 4427 - DNA, 90 bp, Zea mays
  misc_feature: Ceres CLONE 301525-F
gaaaaatactcccgtgttcttcgaccggcggcggtggtgcgamgagggcggtaagtgagacgagatgagggggacgaagcggccgctcgg

SEQ ID NO: 4428 - DNA, 453 bp, Zea mays
  misc_feature: Ceres CLONE 301536-F
  misc_feature: Translation starting site: 65
  misc_feature (381)..(381): n is a, c, t, g, unknown, or other
  misc_feature (383)..(383): n is a, c, t, g, unknown, or other
acagctcaataggagatcaagagtaaagagtgtggggaggggaaggacgcgatatcgggggaggatggtgcttgtgcttgckctgggggatctgcacatcccgcaccgggtgcccgacctgcccgccaaattcaagtccatgctcgtgcccggcaagatccaacacatcatctgcgctggcaacctctgcatcaaggaagttcatgactacctgaaaagcctttgccctgatctccacattaccggagtgaatatgatgagtatgctcgatacccagagactaagacacttacaattggtcagtttaagcttgggctgtgcatggtcatcaggttgttccatggggcgacctggactccctggcgatgctccagcggcasnancgttggacatcctggtgaccgggcacagcatcagttcaaggcatataagcacgagggaggcgtggtgatc

SEQ ID NO: 4429 - DNA, 197 bp, Zea mays
  misc_feature: Ceres CLONE 301554-F
  misc_feature: Encodes the peptide sequence at SEQ ID NO. 4430
aaattctgattttttgttcccttcaccgacggcgaggagtgagggttgacaacgggatggcgcggmstattccgtacgtttcggcggcgamktggtatccatggcgcgaggcaatccccgcctcgccatcatcgacgtcagggatgaggagaggagctaccaggctcacatcgcgggttcgcaccacttcgccagcg

SEQ ID NO: 4430 - protein, 32 aa, Zea mays; identical to SEQ ID NO: 3890
  misc_feature: Ceres CLONE 301554-F
  misc_feature: SWISSPROT Homolog: EC 3.1.3.48 Protein-tyrosine-phosphatase

SEQ ID NO: 4431 - DNA, 124 bp, Zea mays
  misc_feature: Ceres CLONE 301577-F
  misc_feature (42)..(42): n is a, c, t, g, unknown, or other
actcacaagtcacacagccacacttgawccgctgcccgcagnagggagcttgcacgggccaacgcacacataacacaagctcgtcgtcgatggcgcggtgggctgcggtgctagcgctggccgc

SEQ ID NO: 4432 - DNA, 408 bp, Zea mays
  misc_feature: Ceres CLONE 301583-F
  misc_feature: Translation starting site: 52
  misc_feature: Pfam Name: DUF1313 Pfam Description: Protein of unknown function (DUF1313)
  misc_feature (173)..(173): n is a, c, t, g, unknown, or other
  misc_feature (376)..(376): n is a, c, t, g, unknown, or other
acaacagtgcccagtgcccaccgcggcagatcttcgacgcctccgagggcgatggaggaggacggcggctccggcagcgatacatggagttcgtcgcgggassagactagcgctggcgcaggcacaaacgccggcaggaaccgcggcgtgggtgcagggaccagcgtaggcgntggcggcggcacgaagctgcsattgttgctgcaaaakagtttcggcgaggtgcaagggattctggagcacaaccgcgtcctgattcaggagatcagccagaaccaggagacgcgcgacgsgtatcggtctcagccgcaacgtggcgctaatccgggagctcaacactaatatcgcccgcktcgtggacctctacggcgacatntcagggtccttcgcccgckccgtcgccgccaa

SEQ ID NO: 4433 - DNA, 115 bp, Zea mays
  misc_feature: Ceres CLONE 301611-F
acacgcacaccgcgacccagtccagagccagtacgtgcgamggcacgcacgctgctggtccgcgtacbaggacgacggtcaggtcggccggtgcttttcagtttggaataatgac

SEQ ID NO: 4434 - DNA, 660 bp, Zea mays
  misc_feature: Ceres CLONE 301628
  misc_feature: Encodes the peptide sequence at SEQ ID NO. 4435
accacagcgcagaagaacacagcacccgcctgcctcgccgccgcaatggccgccgccgcctccgctgcgagatccttcctccggtccagcggctcatcgtctctccgcagcgcggtggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcagcgctcatgacgtcgcttctcgccgccccggcttgcaagggattcggttggctatcagaagctggtaatgatgacgtgtgacggtctctagatgggaattagcagattattatcccgtcacctcagatcttcagatggatgatttgtcgttactggagatctgcagtgatggtatcttgtctggattatggatacctcgtgaatttaaagtacttggttggcgtctcagttaacatgttttgtgctctgggattgcagtttgtatgaaatttgcagaattgatcctgagatttattttggctggttagctgtcaaaaagactttggtcttgacgactttgcctgatcaagtagatctggaatgaataaacttaatacaaaaaaaaaaaaaaaa

SEQ ID NO: 4435 - protein, 100 aa, Zea mays
  misc_feature: Ceres CLONE 301628
MAAAASAARSFLRSSGSSSLRSAVARAASRAGPGPAPLPRRMPTSAPRVLLRSPVEMSSVCLESLMPMHSATASALMTSLLAAPACKGFGWLSEAGNDDV

SEQ ID NO: 4436 - DNA, 111 bp, Zea mays
  misc_feature: Ceres CLONE 301648-F
gaaaaggaccagaagaaaccagaggcgactccaggttcgtgggcgatgctgcgcgcgggactaggcagctccttgccccggggctccgcggctcggtctgggcacggcgcc

SEQ ID NO: 4437 - DNA, 198 bp, Zea mays
  misc_feature: Ceres CLONE 301667-F
  misc_feature: Encodes the peptide sequence at SEQ ID NO. 4438
  misc_feature (139)..(139): n is a, c, t, g, unknown, or other
actcatacatttcgactctcaactcccaaggtccctttttttttctcgatctggaagcgccgcagtagcagccatggacgtgagcggacaggcagtaaggcgaagaagggcgcggcggggcgcaaggccggcgggcgancgaagaagtcggtgtcgcggtcctccagggccgggctgcagttccccgtcagccgcgtc

SEQ ID NO: 4438 - protein, 66 aa, Zea mays
  misc_feature: Ceres CLONE 301667-F
  misc_feature (47)..(47): Xaa is any aa, unknown, or other
THTFRLSTPKVPFFFSIWKRRSSSHGRERTGSKAKKGAAGRKAGGRXKKSVSRSSRAGLQFPVSRV

SEQ ID NO: 4439 - DNA, 486 bp, Zea mays
  misc_feature: Ceres CLONE 301671-F
  misc_feature: Encodes the peptide sequence at SEQ ID NO. 4440
acaactcacatcgaggtctcagcttcaggaaagggaaggaagcatgttcgggcaccaccacggccacggcgggcaccaccaggccccgccgccgcacgagcagacgctgttcaggatcttctgccgcgccgacgagstactgcctcaccgtgcgtcacgacgccgtcgtcctcgcgcccaccaacccccgcgacgagtaccagcactggtacaaggacatgaggcacagcacgaaggtgaaggacgcggagggccagccagcgttcgcgctcatcaacagggccaccgycttcgccatcaagcactcgctcggccagtcccatcccgtgaagctggtgccctacaacgcggagtacctggacgagtcggtgctgttggacggagagccacgacgtggcaagggcttccgctgcatccgcatggtcaacaacatccacctcaacttcgacgccttccaacggcgacaaggaccacggcggcgtgcac

SEQ ID NO: 4440 - protein, 161 aa, Zea mays
  misc_feature: Ceres CLONE 301671-F
  misc_feature (45)..(45): Xaa is any aa, unknown, or other
  misc_feature (96)..(96): Xaa is any aa, unknown, or other
NSHRGLSFRKGKEACSGTTTATAGTTRPRRRTSRRCSGSSAAPTXYCLTVRHDAVVLAPTNPRDEYQHWYKDMRHSTKVKDAEGQPAFALINRATXFAIKHSLGQSHPVKLVPYNAEYLDESVLLDGEPRRGKGFRCIRMVNNIHLNFDAFQRRQGPRRRA

SEQ ID NO: 4441 - DNA, 198 bp, Zea mays
  misc_feature: Ceres CLONE 301710-F
  misc_feature (124)..(124): n is a, c, t, g, unknown, or other
atgaagtcatgactcatgagtgaccaggtcacgtcacgaggagcggaacacacacactcggggttccgatggcggcggccgcaccaacacacgcgcccgtgtcctcctcagcgtgccgcgcggngattctcctctagcggtgtatccttccccaattttcgctcggcagcggcttcggcccctgggtggcggcgcagg

SEQ ID NO: 4442 - DNA, 133 bp, Zea mays
  misc_feature: Ceres CLONE 301724-F
  misc_feature (66)..(66): n is a, c, t, g, unknown, or other
atcttgctctgaacgcattcctcccatctcccaagacctcctcagacccgagaagcgcmkgcgggnccatggacgccaccggcactggagctggagggaaggcgaagaagggagcggccggtcgcaaggccgc

SEQ ID NO: 4443 - DNA, 472 bp, Zea mays
  misc_feature: Ceres CLONE 301727-F
  misc_feature: Encodes the peptide sequence at SEQ ID NO. 4444
cctagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcagccaacatcaaggtcgagtcctactggccggcgctcttcgccaagctcctggagaagcgcaacgtcgaggacctcatcctctccgttggatctggtggcggastgctccagttgctgctgccgcccctgctggtggtgctgcggccgcggctgccccggctgtcgaggagaagaaggaagaggccaatgaggagtctgatgacgacatgggcttcagctgtttcgactgaggagacccctcgcccccagccattagcaaatttcacttgtgcctgtccaagactatct

SEQ ID NO: 4444 - protein, 129 aa, Zea mays
  misc_feature: Ceres CLONE 301727-F
  misc_feature (68)..(68): Xaa is any aa, unknown, or other
MASGELACTYAALILSDDGIAITAEKIATIVKAANIKVESYWPALFAKLLEKRNVEDLILSVGSGGGXLQLLLPPLLVVLRPRLPRLSRRRRKRPMRSLMTTWASAVSTEETPRPQPLANFTCACPRLS

SEQ ID NO: 4445 - DNA, 118 bp, Zea mays
  misc_feature: Ceres CLONE 301733-F
acacgcacaccgcgacccagtccagagccagtacgtgcgamggcacgcacgctgctggtccgcgtacsagacgacggtcaggtcggccggtgcttttcagtttggaataatgacggcg

SEQ ID NO: 4446 - DNA, 449 bp, Zea mays
  misc_feature: Ceres CLONE 301739-F
atttttccactttcgagcgcagaaacgagagggcaggagcagccgcagtcccggcgatcccgcgccggtcgccctcatacttcctcgtcactgccttcgtttctctttccaacaatcaagatgagccgtggcgtacgcgggtggtggtcaaagttctctgggttacctctttggaagcggtgagccccccaaaccagcagtggcaccagctgtaagtgctccacctgctgctgcagtcttccacctcttgaagaaaccacctgctgcaaasctgatggcaccagtcagattgctgctggggttaccagccaaaccaataactaccacagggccgacggtcagaacaccggcaacttccttacggaccgcccttcgaccaaggtccacgctgctcctggcgggtggctcttccctgggatactgtttggtggcaactgatgccgctcacc

SEQ ID NO: 4447 - DNA, 191 bp, Zea mays
  misc_feature: Ceres CLONE 301786-F
  misc_feature: Encodes the peptide sequence at SEQ ID NO. 4448
  misc_feature (63)..(63): n is a, c, t, g, unknown, or other
  misc_feature (64)..(64): n is a, c, t, g, unknown, or other
aacagaccgacaacgccctaggcaagcagcaagcgcacacgtaaacgtacacctacctcggcnngcaaaagggaaaacgctgatcggagcaacgaagcccgcagccatgccgacagasgacggccacggcacgctcctcgccacgcggcgctcttcctgcccctgctgctgctcctgctcggcctccacgc

SEQ ID NO: 4448 - protein, 28 aa, Zea mays
  misc_feature: Ceres CLONE 301786-F
  misc_feature (4)..(4): Xaa is any aa, unknown, or other
MPTXDGHGTLLATRRSSCPCCCSCSAST

SEQ ID NO: 4449 - DNA, 114 bp, Zea mays
  misc_feature: Ceres CLONE 301791-F
acacgcacaccgcgacccagtccagagccagtacgtgcgamrtcacgcacgctgctggtccgcgtacsagacgacggtcaggtcggccggtgcttttcagtttggaataatgac

SEQ ID NO: 4450 - DNA, 417 bp, Zea mays
  misc_feature: Ceres CLONE 301821-F
  misc_feature: Translation starting site: 76
aagcaagtaagcaacccaaaccctccctcccctcccacgcgattcttgcctcccacgccgccgccggatcccgcgatggccgaccctcggctgtaccccacggagtccgggtccgacgaccggcgcgatgccgcctatcccggctccgagcgccgcctctacaacccgtaccaggacctcaacctcccctatcggcagctctacgatcttcccacctccccggagttcctcttccaggaggaggccgtcgcgcascggttcctggggcgagaacctcacctactacaccggcgtgggatacctcggcggcgstggccggggccgcgctggggctccgcgacgccgcccggggccccgagcmtggggagcccgccaagatccgggccaaccgcgtcctcaactcctgcggcasttccg

SEQ ID NO: 4451 - DNA, 188 bp, Zea mays
  misc_feature: Ceres CLONE 301879-F
  misc_feature (77)..(77): n is a, c, t, g, unknown, or other
gtgcccgcggtgctagtgacggttgctctagatccgttcatcctggtggttttgtgaggtcgaaagcggcgagcganattagaagatgctggacaagctgtgggacgacgtggtggccgggcctcgccgaagacggcctcgagaagctccgcaaggccaccaccgcccgcccgctcgtcatcaacaaa

SEQ ID NO: 4452 - DNA, 240 bp, Zea mays
  misc_feature: Ceres CLONE 301882-F
  misc_feature: Translation starting site: 71
  misc_feature (97)..(97): n is a, c, t, g, unknown, or other
  misc_feature (99)..(99): n is a, c, t, g, unknown, or other
aaaccctagccgcactgcgctcatttctgcatccccctcccgccgcgccgcctcaccgccgccggagaagatgggtcgcgtgatccgcgcgcastanangggtgcggggtccgtgttcaagtcccacacccaccaccgcaaggccccgccgcttccgctccctcgacttcggcgagcgcaacgggtacctcaagggcgtcgtcaccgagtcatccacgaccccggccgtggcgcgccgct

SEQ ID NO: 4453 - DNA, 198 bp, Zea mays
  misc_feature: Ceres CLONE 301891-F
gtgcccgckgtgctagtgacggttgctctagatccgttcatcctggtggttttgtgaggtcgaaagcggcgagcgaattagaagatgctggacaagctgtgggacgacgtggtggccgggcctcgccsaagacggcctcgagaagctccgcaagccaccaccgcccgcccgctcgtcatcaacaaagacgcggacggc

SEQ ID NO: 4454 - DNA, 113 bp, Zea mays; identical to SEQ ID NO: 3914
  misc_feature: Ceres CLONE 301897-F

SEQ ID NO: 4455 - DNA, 180 bp, Zea mays
  misc_feature: Ceres CLONE 301939-F
  misc_feature: Encodes the peptide sequence at SEQ ID NO. 4456
  misc_feature (19)..(19): n is a, c, t, g, unknown, or other
gcggtastaaacgcgagcnctgcgaacaacgatggcgacgatgtctcttgccgcggcgtcacccctcgcctccattccccgcggcatcgstcaggctccttgcgcggcattcctgtccatccgcttaggtggcgcgacggcgacgcggttcgctggactggcggtggcctcgcagccagc

SEQ ID NO: 4456 - protein, 49 aa, Zea mays
  misc_feature: Ceres CLONE 301939-F
  misc_feature (20)..(20): Xaa is any aa, unknown, or other
MATMSLAAASPLASIPRGIXQAPCAAFLSIRLGGATATRFAGLAVASQP

SEQ ID NO: 4457 - DNA, 362 bp, Zea mays
  misc_feature: Ceres CLONE 301955-F
  misc_feature: Translation starting site: 113
acagtcgcctccttcctgcgccgccgccgccgccgccgctaccaccgcctcgsgccgcctgcbbtccgcgtttccgcacggaagttggtgaaggtttcttgaggctgagaacatggtgctgaagacggaactttgccgcttcacgcaaggaaagatttatcctgggaaaggcattagatttatccgtgctgattctcaggtcttcctttttgccaactcgaaatgcaagckgctacttccacaaccgcctgaaggcctgcaaagcttacctggacagcaatgtacaggaagcagcacaagaaggatatccatgctgargcggtaaagaagaggcgccgcgccaccaaggaagccatactcca

SEQ ID NO: 4458 - DNA, 346 bp, Zea mays
  misc_feature: Ceres CLONE 301978-F
  misc_feature (195)..(195): n is a, c, t, g, unknown, or other
agcatctcaagccaccatcgaccttcaagtctcgctacgtagcagtgcaataaaaaaagcagccgcaatggcgagcagcaccatggccctctcctccacggccttcgccggcaagscgtgaacgtgccgtcgtcgtccgccttcgsaggcccgcgtgacgatgcgcaagayggcggcgaaggcaagccagcksgncgtccgggagcccgtggtacgccccgaccgcgtgctgtacctgggcccactgtccggcgagccaccgagctacctkacggggcgagttcccgggcgactacggctkggacaccgcggggcttgtcggcggacccggagacgttcgccaaga

SEQ ID NO: 4459 - DNA, 362 bp, Zea mays
  misc_feature: Ceres CLONE 301980-F
  misc_feature: Encodes the peptide sequence at SEQ ID NO. 4460
  misc_feature (289)..(289): n is a, c, t, g, unknown, or other
aaaaaagacggagacggaggagacgcgcaaggaacaggagcgtaaggaggaggaggcggaggcggaggcggaggcgggggaaaggaagacccaggagccgccgcagcaaggccagggcctcagcctctcactcgccaacggsagtgcaggtctggaatgttgccgatgtcgaacgtgtccgctaatccttcacagcttacaattttctatggcggatcagtatgtgtgtatgactcagtgccaccggaaaaggctcaagcaatcatgcttatagctgcagctgcaggknaavggcaktatccaaaagcagtgctgcccctactgttaagcctccaatggtgcmtgcagccactgttgcccca

SEQ ID NO: 4460 - protein, 68 aa, Zea mays
  misc_feature: Ceres CLONE 301980-F
  misc_feature (45)..(45): Xaa is any aa, unknown, or other
  misc_feature (46)..(46): Xaa is any aa, unknown, or other
  misc_feature (47)..(47): Xaa is any aa, unknown, or other
  misc_feature (63)..(63): Xaa is any aa, unknown, or other
MLPMSNVSANPSQLTIFYGGSVCVYDSVPPEKAQAIMLIAAAAGXXXYPKAVLPLLLSLQWCXQPLLP

SEQ ID NO: 4461 - DNA, 286 bp, Zea mays
  misc_feature: Ceres CLONE 301993-F
  misc_feature: Translation starting site: 110
  misc_feature (199)..(199): n is a, c, t, g, unknown, or other
  misc_feature (208)..(208): n is a, c, t, g, unknown, or other
gagatcgacatcgatccaccgaggtttcttgtgcgtgccgccatggccatggcagtagctcaccttcttcctcagctctccgccgamrattggagctagcaggaacagaatggccattctbttgattcttcagctttttctcttgacggcgctaggcgtggatggagcggcgtcgttcatcttcaccaacgcctgcaancacgcggtntgggtgggcgcgctccacggcgccactcgccgccgctcgckcggtcgggcttctacctggcgccgtccgccacgtcca

SEQ ID NO: 4462 - DNA, 195 bp, Zea mays
  misc_feature: Ceres CLONE 302026-F
  misc_feature: Encodes the peptide sequence at SEQ ID NO. 4463
  misc_feature (103)..(103): n is a, c, t, g, unknown, or other
aaaaaacacagcaagccagcagagcagaaagcagccgcagccccagcccccacaagacgaggcaacaatggcgctagaagcagccaccgccccccgcgcacknytcgccgcgtgccttcgtcctgctggtcctcggcggcggcaccggcccgtcgtcggtgctgcgcggcgccggggccaggccggcgggcagtg

SEQ ID NO: 4463 - protein, 65 aa, Zea mays
  misc_feature: Ceres CLONE 302026-F
  misc_feature (35)..(35): Xaa is any aa, unknown, or other
KKHSKPAEQKAAAAPAPTRRGNNGARSSHRPPRTXRRVPSSCWSSAAAPARRRCCAAPGPGRRAV

SEQ ID NO: 4464 - DNA, 482 bp, Zea mays
  misc_feature: Ceres CLONE 302039-F
  misc_feature: Translation starting site: 85
accttagccgcgcgacgcccaccagcagctgccccttgctgtcgccgcctctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctccagttcaaggtgccggactggttcctcaacaggaagaaggattacaaggatggaaggttctcacaggtcgtgtccaacgccctcgacatgaagctcagggacgacctcgagaggctcaagaagatcaggaaccaccgtggtctgcgtcactactggggcctccgtgttcgtggcc

SEQ ID NO: 4465 - DNA, 211 bp, Zea mays
  misc_feature: Ceres CLONE 302045-F
  misc_feature: Encodes the peptide sequence at SEQ ID NO. 4466
  misc_feature (107)..(107): n is a, c, t, g, unknown, or other
  misc_feature (110)..(110): n is a, c, t, g, unknown, or other
atcaaaccctcacagcgaaggacacaaaaacacaggtagggttaggcgacgcggcggcgagagcgcgagagtaggaggaggcgtcggccatgacggggaaggcgamnaangaagcacacggcgaaggagatcgccgcgaagatcgacgcggcgacgacgaaccggggcggcggcaaggtcgggcaggcggatcggctagggcaggacaagg

SEQ ID NO: 4466 - protein, 40 aa, Zea mays
  misc_feature: Ceres CLONE 302045-F
  misc_feature (6)..(6): Xaa is any aa, unknown, or other
  misc_feature (7)..(7): Xaa is any aa, unknown, or other
MTGKAXXEAHGEGDRREDRRGDDEPGRRQGRAGGSARAGQ

SEQ ID NO: 4467 - DNA, 136 bp, Zea mays
  misc_feature: Ceres CLONE 302053-F
atcacaattcacagcgctcaagttctcgcgcccacagccaaatttttctccactcaatcgcggcataagctgcactgcascatggacgccagcggascggtgagcaaggcgaagaagggggcggcttggkcgcaag

SEQ ID NO: 4468 - DNA, 468 bp, Zea mays
  misc_feature: Ceres CLONE 302106-F
  misc_feature: Translation starting site: 333
  misc_feature: SWISSPROT Homolog: EC 1.1.1.195 Cinnamyl-alcohol dehydrogenase
  misc_feature: SWISSPROT Homolog: EC 1.1.1.2 Alcohol dehydrogenase (NADP(+))
  misc_feature (60)..(60): n is a, c, t, g, unknown, or other
  misc_feature (61)..(61): n is a, c, t, g, unknown, or other
  misc_feature (171)..(171): n is a, c, t, g, unknown, or other
  misc_feature (173)..(173): n is a, c, t, g, unknown, or other
atcattgtcgcgtcctcgtccccgttccatttcattatccccccggagctggtgcgcgwnncggagctggtgcagggtcaccttcccctcggcctcaagagctctgcgttgccgcggccaagggcgtccgtggagaagcgggacaggtggcggcgatggaakagcaakgynynaggcggcgctcggatgggcggccagggacgactccggcgtctctccccctacagcttctccagaagggttcctaaagacgacgatgtcacgatcaaggtgctctactgcgggatctgccacaccgacctgcacgtcatcaagaacgactggcgaaacgcatgtacccagttgtcccggggcacgagatcgtgggcgtggtgaccggcgtcggcggcggcgtcacgcggttcaaggccggcgacacggtcggcgtgggctacttcgtggggtcctgccgctcctgcgacastgcgg

SEQ ID NO: 4469 - DNA, 348 bp, Zea mays
  misc_feature: Ceres CLONE 302136-F
  misc_feature: Encodes the peptide sequence at SEQ ID NO. 4470
  misc_feature (113)..(113): n is a, c, t, g, unknown, or other
  misc_feature (174)..(174): n is a, c, t, g, unknown, or other
agttcctcagacgcaaagaagatcgagtctgcagcccacaccatagtgcgagcagattgcgtccaataggcgcaaagggagatgggggtggccgctggacgagcgcggccatngtggctgcggcggcggcggcggcggcggtgctgctgctgctcgcgggcggcgcgcacsganctgctacgacgactgcttcaaggactgcatggccaggttcaagtccatgagagactactgcagctacgcgttgcgagaaggtctgcgatccggacgccacgctccagcgccccctcgccgttgtggggccagcagcagcgkttggccgaccaccacccgtttgacaagaagcat

SEQ ID NO: 4470 - protein, 48 aa, Zea mays
  misc_feature: Ceres CLONE 302136-F
  misc_feature (38)..(38): Xaa is any aa, unknown, or other
MARFKSMRDYCSYALREGLRSGRHAPAPPRRCGASSSXWPTTTRLTRS

SEQ ID NO: 4471 - DNA, 486 bp, Zea mays
  misc_feature: Ceres CLONE 302146-F
  misc_feature: Translation starting site: 93
  misc_feature (78)..(78): n is a, c, t, g, unknown, or other
  misc_feature (270)..(270): n is a, c, t, g, unknown, or other
aacaacagccctacaacttactgcttgctctagctagctagctgctcccggcccatatccactacacaagtaggctdncagcagcagcagcaatggcctcggtgacgagttcccggccgtggcctcgtcctgctgctcgccgccagcgccttcctggccagcgaggtggcggcgtgcggcggctgccgaaaccaactcctcctcctccatcgccaccaccgccgtcgcccaycagcacgccgtscctccgccaccgtccagctccggcgncaagtgccccaagaacgcgctgaaactgggcgtgtgcgcaacgtgctgggcctcgtcaaggtgtccatcggcaaggtgcccaccgactcgtgctgcccgctgctggacggcctcgcgacctggaggccgccgtctgcctctgcaccgcgctcaaggccaacgtgctcggcatcaacctcgacgtccccgtcaagctcaccctgctcctcaactact

SEQ ID NO: 4472 - DNA, 405 bp, Zea mays
  misc_feature: Ceres CLONE 302152-F
  misc_feature (313)..(313): n is a, c, t, g, unknown, or other
  misc_feature (394)..(394): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcggggcgaggaagaagtcggtgacgaggtccgtgaaggccgggctccagttccccgtcggccgcatcgggcgctacctcaagaagggccgctacgcgcagcgtcggcagcggtgcccccgtctacctcgcggccgtcctggagtacctcgccgctgaggtcctggagctcgccggcaacgctnccaaggacaacaagaagacgcgcatcgtcccgcgccacgtkctgctggcgatccggcaacgacgaggagctcgggaagctnctgaccggcgt

SEQ ID NO: 4473 - DNA, 263 bp, Zea mays
  misc_feature: Ceres CLONE 302164-F
  misc_feature: Encodes the peptide sequence at SEQ ID NO. 4474
  misc_feature (236)..(236): n is a, c, t, g, unknown, or other
acggtataaatctaattttctcacagtttggcgatcgcgatcgggaccttccctcagccacaggccgacagcccacgccttcgaacggccggggatccggtacctccgctccgcccccgactccctctcgccggacggttgcagatccagtcaggccgatccgtctcggacccggtggtagcagtggaggaatccgctgccggtccatcgatcgggagagatgcggcagcagcggnggcggggtcggggccgggaggagggag

SEQ ID NO: 4474 - protein, 87 aa, Zea mays
  misc_feature: Ceres CLONE 302164-F
GINLIFSQFGDRDRDLPSATGRQPTPSNGRGSGTSAPPPTPSRRTVADPVRPIRLGPGGSSGGIRCRSIDRERCGSSGGGVGAGRRE

SEQ ID NO: 4475 - DNA, 255 bp, Zea mays
  misc_feature: Ceres CLONE 302194-F
  misc_feature (37)..(37): n is a, c, t, g, unknown, or other
agtagcctgttaggctgctgttgctattaatcagttnggagagagggagatggccatgaggaacatcggagtcgcagtggacttctcgtcgtgcagcaaascgctttgcggtgggcgtcgacgaaccttgccaagaacggcgacaggctcatactcatccacgtgaacagctcctgccagaacgagcggggcgccgttcatctctgggagcagagtggttccccattgatccctcttgccgagttttcaracgtc

SEQ ID NO: 4476 - DNA, 100 bp, Zea mays
  misc_feature: Ceres CLONE 302218-F
acgcacaccgcgacccagtccagagccagtacgtgcgamggcacgcacgctgctggtccgcgtacsagacgacggtcaggtcggccggtgcttttcagtt

SEQ ID NO: 4477 - DNA, 116 bp, Zea mays
  misc_feature: Ceres CLONE 302231-F
acacgcacaccgcgacccagtccagagccagtacgtgcgamggcacgcacgctgctggtccgcgtacsagacgacggtcaggtcggccggtgcttttcagtttggaataatgacgg

SEQ ID NO: 4478 - DNA, 172 bp, Zea mays
  misc_feature: Ceres CLONE 302271-F
gaaaccgaacttgacaacttgtagatccgtgggcctcgtgacgggcgctttccccatctccacatcgccgccccgcgcastaccgcatcggcgacggcgatgagacacgggacgaggctgctctgcgcactagcsttgacgctgctatgcgtggccacccacttccagggtg

SEQ ID NO: 4479 - DNA, 383 bp, Zea mays
  misc_feature: Ceres CLONE 302274-F
  misc_feature (19)..(19): n is a, c, t, g, unknown, or other
  misc_feature (249)..(249): n is a, c, t, g, unknown, or other
ccacacagcaagccagcdnagcagaaagcagccgcagccccagcccccacaagacgaggcaacaatggcgctagaagcagccaccgccccccgcgcactcctcgccgcgtgccttcgtcctgctggtcctcggcggcggcaccggcccgtcgtcggtgctgcgcggcgccggggcsaggccggcgggcagtgcctgcgcagctgaaccgcctcctggstgccgcgcgtacctggtgcccggcgcgccgnaccccagcgcggactgctgcagcgcgctgagscgttgtcgcacgagtgcgcctgcagcaccatgggcatcatcaacagcctgcccggccggtgccacctcgcccaagccaactgctccgcttgaagcagggacc

SEQ ID NO: 4480 - DNA, 480 bp, Zea mays
  misc_feature: Ceres CLONE 302280-F
  misc_feature: Translation starting site: 261
  misc_feature: Pfam Name: Bowman-Birk_leg Pfam Description: Bowman-Birk serine protease inhibitor family
  misc_feature (366)..(366): n is a, c, t, g, unknown, or other
accgagcagcaacaagccaacaactaaaggcaggcgcggcacaccgsacaccgtaccggcctagacacttggagaaaggagaagcagcgcrscattgggcaccagtcccgtcatccctgcgacgatgctcgtcgtcgctctccttgtcgctagtagtactgtctgcttcggcgccaccgccaccgacaccgacaccgacggcgccattcgtctccccagcagctctggtgctgttggtcgaccgtgggagtgctgtgactatgtcmcaaggagccgtttatcaggccgccccggtggcgctgcaacgacgtggtggacaagtgctccgccgactgccaagagtgcgaggagtcgccggccggagtnctttcgtctgccgtgactggatcttcagcctgctcgagcccccggtctgcacacccaggccgtgggactgctgcgacttcgccgtctgcacaagggactacatcccctactgcc

SEQ ID NO: 4481 - DNA, 442 bp, Zea mays
  misc_feature: Ceres CLONE 302306-F
  misc_feature: Translation starting site: 82
  misc_feature (128)..(128): n is a, c, t, g, unknown, or other
  misc_feature (199)..(199): n is a, c, t, g, unknown, or other
  misc_feature (239)..(239): n is a, c, t, g, unknown, or other
  misc_feature (280)..(280): n is a, c, t, g, unknown, or other
atcacaattcacagcgctcaagttctcgcgcccacagccaaatttttctccactcaatcgcggcataagctgcactgcmscatggacgccagcggascggtagcaaggcgaagaagggggckgctkgncgcaaggytggcggccccaggaagawgtcggtgttcgcggtccgtcaaggccgggctgcagttaccccgtnggccggatcgggcgctacctcaagaaggggcggtasvcancgtggrcaccggcgmccccgtctatctcgccgccgtgcttnagtacctcgccgccgagtgctggagctggccgggaacgcggcgaaggacaacaagaagacgcgcatcgtcccgcgacacttgctcctgggcgattcgtaacgacgttagctcggcaagctgctgtctggcgtcaccatcgcgcacggcggtttcctccccaa

SEQ ID NO: 4482 - DNA, 494 bp, Zea mays
  misc_feature: Ceres CLONE 302316-F
  misc_feature: Encodes the peptide sequence at SEQ ID NO. 4483
gggggaccaggctgggagagcccccccgtcagccccctcctcctcctggtctcctctcttctatccgagctcggcattcagggctactacacctgcttacatccatcgttcatgcatggtgcatacaatggtatgcgcatatgcactgcattgttcgttcaaaataaataagtagaccatgcaactgctacatacacagtggaaaggtttttgatcgagaggcaacgcaattgcaatggtgatcaggatacaagcagggtgtgctcgaggtcgatcgtgcatcatggccgcatgcatgcatgggagatgcagcaggcgttggcgtcgtctgtcgccacagcttggatagcggaaccaaaaataagggtcatgtggctagcagcttctgtttattttcactttcttcgttcatcgcatgctcttgttgttcactgttgtactatctagtagttctctttatctggtgcttccaatctaactagaataagttgcgc

SEQ ID NO: 4483 - protein, 60 aa, Zea mays; identical to SEQ ID NO: 2293
  misc_feature: Ceres CLONE 302316-F

SEQ ID NO: 4484 - DNA, 137 bp, Zea mays
  misc_feature: Ceres CLONE 302341-F
  misc_feature (80)..(80): n is a, c, t, g, unknown, or other
  misc_feature (81)..(81): n is a, c, t, g, unknown, or other
acttcctccaatctcccactcattactcagcttaggaaggtccagggcctccagctccgatccaccacgctacgctagcnntatgccggactcctcctcctccgccggcacagggtcatggccccctcgagctcggc

SEQ ID NO: 4485 - DNA, 231 bp, Zea mays
  misc_feature: Ceres CLONE 302349-F
atatcttctcgcccagatccacaagtttcctgggtagaggaggcactagatactgtgccagatcggggtctggtagtggcagttgggtgattacgacggatgggatgggcctcctcgacaagctgtgggacgacaccgtscgggcccgcgcccggacaccggcctcggcscctccgcaagcagcccgcgcgccccgccgccgtttaagatcagtgatccggccggggacgc

SEQ ID NO: 4486 - DNA, 255 bp, Zea mays
  misc_feature: Ceres CLONE 302353-F
  misc_feature (106)..(106): n is a, c, t, g, unknown, or other
  misc_feature (166)..(166): n is a, c, t, g, unknown, or other
  misc_feature (168)..(168): n is a, c, t, g, unknown, or other
aaaagataaaatcgagaggacgccagggccgattctctgcgtgacttggggcgtcgtcgcgagttttctccggccgagggcggcgcgaccggacaaccagcgtgancgaccggcgacatgactcgcggcaaccagcgtgaccgcgaccgtgagckcgcggcggcsnanagcccaacgccaagaactcccaggacgggctcaccccggagcagcgccgcgagagggacaagaaagctctggaggagaaggcggcca

SEQ ID NO: 4487 - DNA, 130 bp, Zea mays
  misc_feature: Ceres CLONE 302375-F
  misc_feature (44)..(44): n is a, c, t, g, unknown, or other
ayacgcacaccgcgacccagtccagagccagtacgtgcgamgcnacgcacgctgctggtccgcgtacsagacgacggtcaggtcggccggtgcttttcagtttggaataatgacggcgacgacgacgaca

SEQ ID NO: 4488 - DNA, 311 bp, Zea mays
  misc_feature: Ceres CLONE 302379-F
  misc_feature: Encodes the peptide sequence at SEQ ID NO. 4489
acaagtcagaaaaaaaaagaataagaagaaaggaatccctcctacgcggaasaagagattcgtcgcctcagccgcctctctgctcagatctgcggcggactcgccggcggcctgcgccccgcggcgcgccgatccaagatgccttcgtgcgtgcagggatgctgctgctgctcgtccctgcgccttctcccccgcgacgacgcgctctcgtccccctccgccttgcgcgcaccgcctgaagccttggtcttggcgtgcccaatcccccacctcgtcctcctaacgctttgtccccgcccgctccccaccct

SEQ ID NO: 4489 - protein, 57 aa, Zea mays
  misc_feature: Ceres CLONE 302379-F
MPSCVQGCCCCSSLRLLPRDDALSSPSALRAPPEALVLACPIPHLVLLTLCPRPLPT

SEQ ID NO: 4490 - DNA, 507 bp, Zea mays
  misc_feature: Ceres CLONE 302407-F
  misc_feature: Encodes the peptide sequence at SEQ ID NO. 4491
ataggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtcaagaagcttatcaaggagaagaaggatgatgctggaatttctgaatatattgatatggagaaagagcttcaagaggagccatgcccagcaaggtagcatgaaaaggccgcttgcaacagaagatttgttttggggaatttagatttttgtaaccttgaaaggtgagaaggttaattatggcaatggtagggactgtccgagcaaccatattaataataatgaacaatatgtaaaawttcagtggcttcaaagttgtccattaccctttatcttgatttattgcaggtttgtactactacagatttt

SEQ ID NO: 4491 - protein, 54 aa, Zea mays; identical to SEQ ID NO: 2048
  misc_feature: Ceres CLONE 302407-F

SEQ ID NO: 4492 - DNA, 93 bp, Zea mays
  misc_feature: Ceres CLONE 302411-F
catttccttcctcctgatctctcacggakttcctctccatggcgacgcccgctctccgagcccccgcgccgaagcgccctcgattccgcgccg

SEQ ID NO: 4493 - DNA, 338 bp, Zea mays
  misc_feature: Ceres CLONE 302453-F
  misc_feature: Translation starting site: 60
  misc_feature (190)..(190): n is a, c, t, g, unknown, or other
aagccaccatcgaccttcaagtctcgctacgtagcagtgcaataaaaaaagcagccgcaatggcgagcagcaccatggccctctcctccacggccttcgccggcaaggscgtgaacgtgccgtcgtcgtccgccttcggsagggcccgcgtgacgatgcgcaagacggcggcgaaggcaagccaacgsgngcgtccgggagcccgtggtacgccccgaccgcgtgctgtacctgggcccactgtccggcgagccaccgagctacctgacgggcgagttcccgggcgactacggctgggacaccgcggggctgtcggcggacccggagacgttcgccaa

SEQ ID NO: 4494 - DNA, 385 bp, Zea mays
  misc_feature: Ceres CLONE 302469-F
  misc_feature: Translation starting site: 82
aagcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacgsgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaa

SEQ ID NO: 4495 - DNA, 184 bp, Zea mays
  misc_feature: Ceres CLONE 302510-F
  misc_feature (108)..(108): n is a, c, t, g, unknown, or other
  misc_feature (119)..(119): n is a, c, t, g, unknown, or other
ccaacgacgcagctagcgcgcatctcccgatcagctgcactgcaccttcgtcgaacgtcgatcgtactcgtacaccatgaaggcagtcgtcgcggcgasatgcttctnctggtgctggntggccgcggcgacggtggcgagcgcagaccaccgtgtacgacggccaccaccaccacgccaccgc

SEQ ID NO: 4496 - DNA, 239 bp, Zea mays
  misc_feature: Ceres CLONE 302528-F
  misc_feature: Encodes the peptide sequence at SEQ ID NO. 4497
aktcgcctccttcctgcgccgccgccgccgccgccgccgccgctaccaccgcctcgsgccgcctgcggtccgcgtttccgcacggaagttagtgaaggtttcttgaggctgagaacatggtgctgaagacggaactttgccgcttcacgcaaggaaagatttatcctgggaaaggcattagatttatccgtgctgattctcaggtcttcctttttgccaactcgaaatgcaagcgctac

SEQ ID NO: 4497 - protein, 41 aa, Zea mays
  misc_feature: Ceres CLONE 302528-F
  misc_feature (3)..(41): Pfam Name: Ribosomal_L24e Pfam Description: Ribosomal protein L24e
MVLKTELCRFTQGKIYPGKGIRFIRADSQVFLFANSKCKRY

SEQ ID NO: 4498 - DNA, 112 bp, Zea mays
  misc_feature: Ceres CLONE 302549-F
acacgcacaccgcgacccagtccagagccagtacgtgcgamgcacgcacgctgctggtccgcgtacbagaacgacggtcaggtcggccggtgcttttcagtttggaataatg

SEQ ID NO: 4499 - DNA, 111 bp, Zea mays
  misc_feature: Ceres CLONE 302556-F
acacgcacaccgcgacccagtccagagccagtacgtgcgamrcacgcacgctgctggtccgcgtacsagacgacggtcaggtcggccggtgcttttcagtttggaataatg

SEQ ID NO: 4500 - DNA, 365 bp, Zea mays
  misc_feature: Ceres CLONE 302580-F
  misc_feature: Translation starting site: 94
aacatccctccattgtyctaccaaaaatcgcagcgccgcccgcaccaatctcgaagtgttcgaaagtttccagacccccaaaaggcgamggcgatgagttccaccggagcggcggccgcgggaaggcgavagcgaccaagtcggtgtcgcggtcctccaaggctgggcttcagttccccgtcggtcgcatcgscggtacctcaaggccgggaaatatgccgagcgcgtcggsccggggcccccgtgtacctctccgctgttctcgagtatctcgccgccgaggtgctcgagctggccgggaacgctgctcgggacaacaagaagaaccgtatcgtgccgcgccacatccagctggcggtgcggaa

SEQ ID NO: 4501 - DNA, 113 bp, Zea mays
  misc_feature: Ceres CLONE 302594-F
  misc_feature (42)..(42): n is a, c, t, g, unknown, or other
acacgcacaccgcgacccagtccagagccagtacgtgcgavncacgcacgctgctggtccgcgtacsagacgacggtcaggtcggccggtgcttttcagtttggaataatgac

SEQ ID NO: 4502 - DNA, 1064 bp, Zea mays
  misc_feature: Ceres CLONE 302604
  misc_feature: Encodes the peptide sequence at SEQ ID NO. 4503
ctaaacttacgctgtgcttttgggagagttgagctcatggagcaggacaagagagccgaggtgctgtgcctgcacggcttccgcacaagcgggagttttttgaagaaacagatcagcaaatggcacccttccatatttcagcagtttgagatggtcttccctgatggcctcttcccagctggtggaaagtcagagatagagggcatatttccaccaccatacttcgagtggttccagttcaataaggaattcactgaatacacaaatctggacgagtgcatttcatatctatgtgattacatggtgaaaaatgggccttttgatggcctgctcggattctcccagggcgcaacactttcggcccttttgataggctaccaagcacagggcaagttgctgagcgatcatccaccaattaagttcatggtctcaatatctgggagcaagttcagagacccaatcatctgtgatgtcgcttacaaagacccgatcaaggtgaaatcagtgcacttcattggagaaaaggactggctcaaggtaccttccgaggagctggcttctgcctttgatgagcctctcatcataaggcatcctcagggtcacactgtccctaggcttgacgacgtgtctgtgaaacagctttctgaatggagctcacgcgtcctggaagacctcaagagtgcagatgttcctgaggccttagattcaggcaaaccatctgataaggaggctgctggtgcggaattcacagaaaacctggtgaaagcttgaggcatgcccacttcagccttgttcggttattcctatcttacatggattggatgggattgaaaaattttaagaaagattttgatttgctatggatttaaacccatccaatcttgtccaatccatatggattggcaccgaaacgaataaacccttccatggcatggctgcatctggaacttgtaccgtttttactatgatctgagtagtgcgtggaacttgtttgattgcgtatgtattgcatttggcaaagcaataaatcgttatttagagctacaacaaaaaaaaaaaaaaaa

SEQ ID NO: 4503 - protein, 244 aa, Zea mays
  misc_feature: Ceres CLONE 302604
  misc_feature (5)..(214): Pfam Name: FSH1 Pfam Description: Serine hydrolase (FSH1)
  misc_feature: SWISSPROT Homolog: EC 1.5.1.3 Dihydrofolate reductase
MEQDKRAEVLCLHGFRTSGSFLKKQISKWHPSIFQQFEMVFPDGLFPAGGKSEIEGIFPPPYFEWFQFNKEFTEYTNLDECISYLCDYMVKNGPFDGLLGFSQGATLSALLIGYQAQGKLLSDHPPIKFMVSISGSKFRDPIICDVAYKDPIKVKSVHFIGEKDWLKVPSEELASAFDEPLIIRHPQGHTVPRLDDVSVKQLSEWSSRVLEDLKSADVPEALDSGKPSDKEAAGAEFTENLVKA

SEQ ID NO: 4504 - DNA, 368 bp, Zea mays
  misc_feature: Ceres CLONE 302616-F
  misc_feature: Translation starting site: 146
  misc_feature (207)..(207): n is a, c, t, g, unknown, or other
  misc_feature (301)..(301): n is a, c, t, g, unknown, or other
  misc_feature (318)..(318): n is a, c, t, g, unknown, or other
atataataggctagacgcccaactcgaacctgagtacctgagaaatggcggccgtctcctccacctccaccgcctcctcctacttctcctcgcagccgcagctscgatctccaccgccgaccctgccgccagcaaaagtaggttgatgcggcascacggcggasagcagcttcgtgatgatggaggcgtcctctgccagcksacgancggcggggtggccaggacgaagagcctcacggaggacgacctggaggagctcaagggctgcctcgacctcggcttcggattcgcgtacagsagnatacccgagctctgcgngacstgcccgcgctcgaactctgctactccatgacccgggagttcctcga

SEQ ID NO: 4505 - DNA, 468 bp, Zea mays
  misc_feature: Ceres CLONE 302621-F
  misc_feature: Translation starting site: 160
  misc_feature (42)..(42): n is a, c, t, g, unknown, or other
  misc_feature (457)..(457): n is a, c, t, g, unknown, or other
aacaaccaggtcgttcagccgcagattagcaggccgcctgcnctcctcctttcccctcagcctcccctcctctccggtgtacgtctccgccgagatggccgccccgctccggcgastcccctcccttggtcgcgcgcttctcacgccggcgccggccggatgctctccgcggaggcctctgatgccctcgttgagatcaagcccggggagatcgggatggtctccggcatccctgaggagcatctccgccgtaagttctaatttattcaccagctaggactgcatcccagcaaggttcaggcaaagtcgggaggtggaaaattaattttttgtcaacccaaaagtgggagaacccgttgatggggatggacatctactgggggatccatatgctaatgttcggtgaagcagggacttacgtttgacagtgcagattcagcaaaggcgttttgccganaaaacatggat

SEQ ID NO: 4506 - DNA, 266 bp, Zea mays
  misc_feature: Ceres CLONE 302625-F
  misc_feature: Encodes the peptide sequence at SEQ ID NO. 4507
  misc_feature (242)..(242): n is a, c, t, g, unknown, or other
atcaccaagttttggattccagcagcggcgcccccaggccaggccccacccgctcagcctcctcagctgcccaaccttctccccatctgctcagcctcagctgtcattcccgcgavcgtctcccggctctatcgatggaccgagtcgccgccctcgtcgtcgcgctcctcgccctcttcttcgccgccggggccacggcgcaggccccggcytcgtcgcccaagcgcactccagcgccabcncacccaggacggccttcctcccgc

SEQ ID NO: 4507 - protein, 44 aa, Zea mays
  misc_feature: Ceres CLONE 302625-F
  misc_feature (36)..(36): Xaa is any aa, unknown, or other
MDRVAALVVALLALFFAAGATAQAPASSPKRTPAPXHPGRPSSR

SEQ ID NO: 4508 - DNA, 527 bp, Zea mays
  misc_feature: Ceres CLONE 302660-F
  misc_feature: Encodes the peptide sequence at SEQ ID NO. 4509
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtcgtgcgtccgctcgtggggcggcgcgctctcgtccatcacccacctcgtgtacgtctcgtcgagcgagggcgcgcttcccgggcggcga

SEQ ID NO: 4509 - protein, 147 aa, Zea mays
  misc_feature: Ceres CLONE 302660-F
  misc_feature (10)..(145): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTRWRRRRPCRASARGAARSRPSPTSCTSRRARARFPGG

SEQ ID NO: 4510 - DNA, 112 bp, Zea mays
  misc_feature: Ceres CLONE 302710-F
  misc_feature (42)..(42): n is a, c, t, g, unknown, or other
aacacgcacaccgcgacccagtccagagccagtacgtgcganrcacgcacgctgctggtccgcgtacsagacgacggtcaggtcggccggtgcttttcagtttggaataatg

SEQ ID NO: 4511 - DNA, 376 bp, Zea mays
  misc_feature: Ceres CLONE 302757-F
  misc_feature: Encodes the peptide sequence at SEQ ID NO. 4512
accagaagcgaaggcgaggcggaggagcggaggtaggagatctcgagcaagccggasgagaaggagatgaagacgttcgacccgtggccggtcttcttccgccgggagtggaagcgcaactggcccttcctcacgggtttcgccatcaccggattcatcatcacgaagatgacggccaacttcaccgaggaggatctcaagaactccaagttcgtccaggaacacaagaagaagcactgacgaaccaggagttgtcagaaacgcatgtttggccagccagttctgttatgcttttgaatgaaaaatttagacccttctttctcgtttccttaatcgaaatgcttgcactctatgttccatttgtaatgtaataaga

SEQ ID NO: 4512 - protein, 57 aa, Zea mays
  misc_feature: Ceres CLONE 302757-F
MKTFDPWPVFFRREWKRNWPFLTGFAITGFIITKMTANFTEEDLKNSKFVQEHKKKH

SEQ ID NO: 4513 - DNA, 96 bp, Zea mays
  misc_feature: Ceres CLONE 302781-F
gaaaaggaccagaagaaaccagaggcgactccaggttcgtgggcgatgctgcgcgcgggactaggcagctccttgccccggggctccgcggctcgg

SEQ ID NO: 4514 - DNA, 471 bp, Zea mays
  misc_feature: Ceres CLONE 302831-F
  misc_feature: Translation starting site: 205
  misc_feature (82)..(82): n is a, c, t, g, unknown, or other
  misc_feature (342)..(342): n is a, c, t, g, unknown, or other
  misc_feature (380)..(380): n is a, c, t, g, unknown, or other
  misc_feature (449)..(449): n is a, c, t, g, unknown, or other
atccatcaatcctcatcgccacccaacccgccgagtccccaagcaagttgagcatccatccatccatggcgggaggcaagtncaccggcaatgcgcgcgcmsaggaagckcgtcgaggcaaccgtcctcaagckctccagggacgggagsctttcaccagatgcgtaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaanttgcgcccaccgccttcttcctcttcatggacgacttnaggaaggagttcaaggccacccatcctgacaacaagagtgtcgctaccgttgcaaaggaaggagggganaggtggaagtcatgacagacga

SEQ ID NO: 4515 - DNA, 496 bp, Zea mays
  misc_feature: Ceres CLONE 302868-F
  misc_feature: Encodes the peptide sequence at SEQ ID NO. 4516
  misc_feature (254)..(254): n is a, c, t, g, unknown, or other
accgacggcatttgcatctgagttcctgattgttgtattccagtttcttctgtgagttttgtgggatcgcgaggwagaactagaaggatgtcgtgctgcggaggcaactgcgggtgckgcgccggctgcaagtgcggcacggctgcggaagggtgcaagatgtacccggacttggctgagcaggtgaccaccactacccagactctcatcatgggtgttgcaccgtccaagggcgggttcgaggcggccgcgtnagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttgtgttttgttcgagtcagtcagacagtcagccgcgtgccatgggccatggcatagcatgcattcgcctcgctctatctggctccatcgcc

SEQ ID NO: 4516 - protein, 76 aa, Zea mays
  misc_feature: Ceres CLONE 302868-F
  misc_feature (1)..(75): Pfam Name: Metallothio_2 Pfam Description: Metallothionein
  misc_feature (11)..(11): Xaa is any aa, unknown, or other
  misc_feature (56)..(56): Xaa is any aa, unknown, or other
MSCCGGNCGCXAGCKCGTAAEGCKMYPDLAEQVTTTTQTLIMGVAPSKGGFEAAAXAENGGCKCGANCTCDPCTCK

SEQ ID NO: 4517 - DNA, 503 bp, Zea mays
  misc_feature: Ceres CLONE 302920-F
  misc_feature: Encodes the peptide sequence at SEQ ID NO. 4518
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgassagatggcgacggaggcgtccctgtcgtgcgtccgctcgtggggcggcgcgctctcgtccatcacccacctcgtgtacgtctcgtcgagcg

SEQ ID NO: 4518 - protein, 77 aa, Zea mays; identical to SEQ ID NO: 3155
  misc_feature: Ceres CLONE 302920-F
  misc_feature: SWISSPROT Homolog: EC 2.3.1.74 Naringenin-chalcone synthase

SEQ ID NO: 4519 - DNA, 297 bp, Zea mays
  misc_feature: Ceres CLONE 302944-F
  misc_feature: Encodes the peptide sequence at SEQ ID NO. 4520
aagaacagctgtcgatccaattgtyacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggggttaacggcgagtccgcsaagttacacggaggccacggtgacggaggtggtgtccacgggcgagaacgagtacgacgagtacaaggaggagaagcagcataagcacaagcagcacctcggcga

SEQ ID NO: 4520 - protein, 60 aa, Zea mays
  misc_feature: Ceres CLONE 302944-F
MAEEKHHHHHLFHHKKDEEQEEQLAGGVNGESAKLHGGHGDGGGVHGRERVRRVQGGEAA

SEQ ID NO: 4521 - DNA, 195 bp, Zea mays
  misc_feature: Ceres CLONE 302960-F
  misc_feature: Encodes the peptide sequence at SEQ ID NO. 4522
  misc_feature (133)..(133): n is a, c, t, g, unknown, or other
aaaccaaagatccatccaaactctgcaccccagaaagctagtacgatctcggggggacatgaagcgcctgcagtgcttcaagcagagcagcggcgtcgcaatggtggcgggccggggaagcgccttgagcggncggctgtcgctgggcgagtacaagaaggcagtgtcgtggtccaagtacctcgtagcgccgcc

SEQ ID NO: 4522 - protein, 45 aa, Zea mays
  misc_feature: Ceres CLONE 302960-F
MKRLQCFKQSSGVAMVAGRGSALSGRLSLGEYKKAVSWSKYLVAP

SEQ ID NO: 4523 - DNA, 246 bp, Zea mays
  misc_feature: Ceres CLONE 302968-F
  misc_feature: Encodes the peptide sequence at SEQ ID NO. 4524
agactcttccccaacggaattcctcattcacatccctacgcacgaacggaaacgccccatgctgcgctcgcrtctcgcatggactccaccactgctgctgctaccgcggccgsctgsgccggcgccggtgctgctggtgacgaacgacgacggaatcgacgcgccggggctccgcttccttgtcgaccgtctcgtcgccgcaggataccgcgtactcgtctgcgcgcccgacacagacaaatcggg

SEQ ID NO: 4524 - protein, 62 aa, Zea mays
  misc_feature: Ceres CLONE 302968-F
  misc_feature: SWISSPROT Homolog: EC 3.1.3.5 5'-nucleotidase
  misc_feature (5)..(5): Xaa is any aa, unknown, or other
  misc_feature (19)..(19): Xaa is any aa, unknown, or other
  misc_feature (20)..(20): Xaa is any aa, unknown, or other
MLRSXLAWTPPLLLLPRPXXPAPVLLVTNDDGIDAPGLRFLVDRLVAAGYRVLVCAPDTDKS

SEQ ID NO: 4525 - DNA, 417 bp, Zea mays
  misc_feature: Ceres CLONE 302970-F
  misc_feature: Encodes the peptide sequence at SEQ ID NO. 4526
awattccaaacccatttcgtcaagcaacaacaccggctaaaaattaaaagaggcagcgcgtacgagttggtcgccaccgtcacgtactcacgctcacgttggaggttagactccgcccccgtgctgctcttcgccttgcctttctccgccggagaccccgccgcctcagctgccgcagaggaggaggcaaccatggcggggaggtacgacgcaatccgttcgaggaggatgacgtcaacccctttgcgggaggaagtgtacctcctgcttctaattctcggatgtcagcacttcctcatgaaccagctggcttctacaatgatcgtgggtgcaacagtgggacatacctcttgattcaacggaaggacctaagtaaaaaggagaaagaactgcaggcaaaggaagctgagctaaaca

SEQ ID NO: 4526 - protein, 45 aa, Zea mays
  misc_feature: Ceres CLONE 302970-F
MSALPHEPAGFYNDRGCNSGTYLLIQRKDLSKKEKELQAKEAELN

SEQ ID NO: 4527 - DNA, 441 bp, Zea mays
  misc_feature: Ceres CLONE 302978-F
  misc_feature: Translation starting site: 304
  misc_feature: SWISSPROT Homolog: EC 5.2.1.8 Peptidylprolyl isomerase
  misc_feature (354)..(354): n is a, c, t, g, unknown, or other
ccgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgcatcgagggcatgaacggcaaggagctggacggccgcaacatcaccgtcaacgaggcccantcccgcggcggccgtggaggcggcggcgggtgggtacggtggtggccgtggaggcggcggctacggcggtggcggcggcggctacgg

SEQ ID NO: 4528 - DNA, 271 bp, Zea mays
  misc_feature: Ceres CLONE 302998-F
  misc_feature: Encodes the peptide sequence at SEQ ID NO. 4529
  misc_feature (226)..(226): n is a, c, t, g, unknown, or other
aacgtggagactcgttggtctacaacgtaaacgataaagggggcggcasagcaagcatgacgaggtcgcgagctgtagtgacgttagtgctcctgctggccgtcgccacggcgagctgcaggctgtcgctcgccgccgacgagaccatcgcggccatcttgggccgaccctgcggggttcatcgccagggccggcaacctcttcaggtcggacggcagcgctggcnccgcgaacctcaccgcggccgaggcgaagaacctgagggccgcca

SEQ ID NO: 4529 - protein, 71 aa, Zea mays
  misc_feature: Ceres CLONE 302998-F
  misc_feature (57)..(57): Xaa is any aa, unknown, or other
MTRSRAVVTLVLLLAVATASCRLSLAADETIAAILGRPCGVHRQGRQPLQVGRQRWXREPHRGRGEEPEGR

SEQ ID NO: 4530 - DNA, 502 bp, Zea mays
  misc_feature: Ceres CLONE 303015-F
accaagtaccaactgcccgagacaagaacaactccaattcccatctctcactacggcaacactttgcgagctgagccatcaaagctcggggcggatggcggggcggcggcagatcaagaaggagtgggtgcaggcggcggcggacscggcgtcgtcaccgccaacacctaccgcatgaacttcgactacctcgcaaacccgcagacttcgggttcacgaacgtgcaggtggcgtgctgcggccagggcccgtacaacgggatcgggctgtgcacggcggcgtcgaacgtgtgcgacaaccgcgacgtgttcgcgttctgggacgcgttccaccccacggagagggcaaaccgcatcatcgtcgcccagttcatgcacggcgacacggactacatgcaccccatgaacctcagcaccatcctcgccacggaccaggagggcctctagactatagcttgatcagccggacacgattatacgtacatgcgtgatgtgtctcacgt

SEQ ID NO: 4531 - DNA, 491 bp, Zea mays
  misc_feature: Ceres CLONE 303021-F
  misc_feature: Translation starting site: 344
  misc_feature (49)..(49): n is a, c, t, g, unknown, or other
  misc_feature (196)..(196): n is a, c, t, g, unknown, or other
  misc_feature (197)..(197): n is a, c, t, g, unknown, or other
aatttttggttccaaatcgaataacccaatgcygccgtagccgtctgcntcctcgctttcctttcgtccgtacgccgccggctcgcaccgccgacagtcctcagtccagaactccagatcgagcctctctcttcccagatcgggtcctaggctacagcagccgccgcatccgtcaccttcacaccgcgtgcgtkknnctctctcccccctccccctctccgtgcgacgactgggtgggctaccgcgccttacgcaaggtgccgagaacttcgccaaaatctgcgccggagaagagcgcccaccagatcaggagctgagaaggcgcgctggtcggtggatgacgatggcgggtggcgggggactgaaccggtcttcatcgagggggcagctgcgccgcaagagctgcttgacgatctctgcagccggttccttctgaatgtkcccaaggaggaactggagtcgttcgagcggatcctgttcctgctggagca

SEQ ID NO: 4532 - DNA, 495 bp, Zea mays
  misc_feature: Ceres CLONE 303023-F
  misc_feature: Encodes the peptide sequence at SEQ ID NO. 4533
aatcacaggcaacaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcgcttcgaggcggccaccgagggcggcggctgcgactgcaacacctgcaactgcggcaccagctgcggctgctcctgctgcagctgcaactgagccggcccgcccgcccggcgattggcgcacgagagtcgagaggacgacgacgacgaggcgtataaatataatagcagcgtctaaataagatcctgtcaactgcacccgcctcgtcaggcgctccgacgccatcatcgccttcctctgcggccgccaagcctagagtggt

SEQ ID NO: 4533 - protein, 109 aa, Zea mays
  misc_feature: Ceres CLONE 303023-F
  misc_feature (1)..(68): Pfam Name: Metallothio_2 Pfam Description: Metallothionein
MSCSSGKCNCGSSCSCGSSCNCMSPDVETAAASSIKTMVLAAPTTKASAGASRRPPRAAAATATPATAAPAAAAPAAAATEPARPPGDWRTRVERTTTTRRINIIAASK

SEQ ID NO: 4534 - DNA, 386 bp, Zea mays
  misc_feature: Ceres CLONE 303055-F
  misc_feature: Encodes the peptide sequence at SEQ ID NO. 4535
aaggaattagaacggccgaagcggcacacaattcgcgcmrgcgtagaaactagaaagtccagtccccaaactccccagcggggcgaagcagaggaggaagagtagccgccgccatgtctgggggaatcgcccgcggccgcctcgccgagtagcgcaaggcctggcgcaagaaccacccgcacggtttcgtcgcgamcggagtcgctgcccgacggacggtgaacctgatgatctggcagtgcaccatccccggcaagcaagggactgactgggaaggtggatacttccctctcacccttcattttagtgaggattaccctagcaagcctcccaagtgcaagttccctcagggttttcttccacccaaaatgttgtatccttctggg

SEQ ID NO: 4535 - protein, 53 aa, Zea mays
  misc_feature: Ceres CLONE 303055-F
  misc_feature: SWISSPROT Homolog: EC 6.3.2.19 Ubiquitin--protein ligase
MIWQCTIPGKQGTDWEGGYFPLTLHFSEDYPSKPPKCKFPQGFLPPKMLYPSG

SEQ ID NO: 4536 - DNA, 222 bp, Zea mays
  misc_feature: Ceres CLONE 303066-F
  misc_feature: Encodes the peptide sequence at SEQ ID NO. 4537
  misc_feature (122)..(122): n is a, c, t, g, unknown, or other
  misc_feature (124)..(124): n is a, c, t, g, unknown, or other
acagctgaamsagccaaaacgcagaagctgcactgcatacatcgagctaactatctgcagcgatgtctcgctcctgctgcgtcgccgtgtcggtgcttctcgctgtcgccgcgacascakcncnaccgcscggcatggctgcacgaggaggccatggccacgggccgctggtcgcagagggtgcaagggtggcgccctccgcgtccacctgggctgccaaca

SEQ ID NO: 4537 - protein, 53 aa, Zea mays
  misc_feature: Ceres CLONE 303066-F
  misc_feature (19)..(19): Xaa is any aa, unknown, or other
  misc_feature (20)..(20): Xaa is any aa, unknown, or other
  misc_feature (21)..(21): Xaa is any aa, unknown, or other
  misc_feature (23)..(23): Xaa is any aa, unknown, or other
MSRSCCVAVSVLLAVAATXXXPXGMAARGGHGHGPLVAEGARVAPSASTWAAN

SEQ ID NO: 4538 - DNA, 128 bp, Zea mays
  misc_feature: Ceres CLONE 303080-F
  misc_feature (60)..(60): n is a, c, t, g, unknown, or other
  misc_feature (61)..(61): n is a, c, t, g, unknown, or other
atcacagctagctagcatacagacgaataatctcttcttcacctcactaacabcagctannaactctttctctcctgcaataatggccgctcgctcctcctcctcccagccgcagctgtcgcggcggc

SEQ ID NO: 4539 - DNA, 397 bp, Zea mays
  misc_feature: Ceres CLONE 303098-F
  misc_feature: Encodes the peptide sequence at SEQ ID NO. 4540
  misc_feature (335)..(335): n is a, c, t, g, unknown, or other
  misc_feature (337)..(337): n is a, c, t, g, unknown, or other
atttcatttaccacaccctgctctcgctcttgttgtgacggtcgattcgcttgtacaagctagcaaccttgagatccagccaagatccagccatgagggagattctccacatccagggtggacagtgcggcaaccagatcggttccaagttctgggaggtcgtctgckacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtcgcaccgggccgtacnangatcttccgccccgacaacttcgtcttcggccagtcttgcgcgggggaacaactgggcca

SEQ ID NO: 4540 - protein, 101 aa, Zea mays
  misc_feature: Ceres CLONE 303098-F
  misc_feature (26)..(26): Xaa is any aa, unknown, or other
  misc_feature (82)..(82): Xaa is any aa, unknown, or other
MREILHIQGGQCGNQIGSKFWEVVCXEHGIDPTGRYVGTSDLQLERVNVYYNEASCGRFVPRAVLMDLEPGTMDSVAPGRTXIFRPDNFVFGQSCAGEQLG

SEQ ID NO: 4541 - DNA, 234 bp, Zea mays
  misc_feature: Ceres CLONE 303099-F
  misc_feature (228)..(228): n is a, c, t, g, unknown, or other
aggcgcgcgtgccgctctctcgctcgctcctccggttaatcccccatcgccaggagcccaggactcgcagccagcccttcacattattcgcgcgcgcgaatcggccgtagcgtgtgggtggcgtcgcgtgcggtctcttggtgccggtgcgggccgcgtgacggtgtgtgagtgtgtgacgcccacgcggaggaggtcgttctgttggttggttggtccgcggccatnatggcg

SEQ ID NO: 4542 - DNA, 250 bp, Zea mays
  misc_feature: Ceres CLONE 303125-F
  misc_feature: Encodes the peptide sequence at SEQ ID NO. 4543
  misc_feature (15)..(15): n is a, c, t, g, unknown, or other
  misc_feature (117)..(117): n is a, c, t, g, unknown, or other
  misc_feature (210)..(210): n is a, c, t, g, unknown, or other
accagctcgatcgcncggcagaagaggataagaggaagcgagtkctgggactgtgcgtgagttgggaagaaggagggggtggcaatggcgttgcggaatggtggtggtggcggactntcccgcggcggttgtgctggtggctgcggccgtggcggcgctgctgggcgcsggggtggcggcgaccaagttcgacgacgtggtgcagcccanctgggccaacgaccacgttgtgttacgacggcgacctcct

SEQ ID NO: 4543 - protein, 51 aa, Zea mays
  misc_feature: Ceres CLONE 303125-F
  misc_feature (7)..(7): Xaa is any aa, unknown, or other
  misc_feature (38)..(38): Xaa is any aa, unknown, or other
MVVVADXPAAVVLVAAAVAALLGAGVAATKFDDVVQPXWANDHVVLRRRPP

SEQ ID NO: 4544 - DNA, 321 bp, Zea mays
  misc_feature: Ceres CLONE 303150-F
  misc_feature: Translation starting site: 133
  misc_feature (154)..(154): n is a, c, t, g, unknown, or other
  misc_feature (213)..(213): n is a, c, t, g, unknown, or other
  misc_feature (226)..(226): n is a, c, t, g, unknown, or other
  misc_feature (270)..(270): n is a, c, t, g, unknown, or other
atgccattcgagcagcatcgtcacccagagccaagctgcaacagctagtagcggccggcagcatcgcgtagtagagtgtgctcagagcagcgcgcgcatggkacccttgggcccaccgtgagcttcagtatcatggtcatggccaagctcagcntckccgcccagcagcagccggagatgakagggagaggaaggagggcggcadtgggtgcngcttccggatgcngctgcactacccgcgctacaagaaggcgggactacgaggccatncccgadtrgcgcgtcgactgcctgctccgcgagtacggcctccccgccgac

SEQ ID NO: 4545 - DNA, 376 bp, Zea mays
  misc_feature: Ceres CLONE 303168-F
  misc_feature: Encodes the peptide sequence at SEQ ID NO. 4546
  misc_feature (137)..(137): n is a, c, t, g, unknown, or other
gtagtcctaggcactttcatctgtggcctctgcgttcgagatcgatctgagctggcaccgtcccacttcgccatggcggaggaccggagccccaagcccatccactgcaaagcggcggtgtgcagagccgccggcrngccactcaccatcgaggagatcgtcgtcgacccgccgaaagcgtacgagatccgcatccgggtcgtctgcacctcactctgccacaccgatatcaccttctggaaagctaaggtggcaccggtgtttccaagaatactagggcatgaggcgtacggggtagtggagagcgtgggggagcacgtggagggcttcgcggcgggggacaccgtggtgccgacgtttttggggcagtgcgagc

SEQ ID NO: 4546 - protein, 101 aa, Zea mays
  misc_feature: Ceres CLONE 303168-F
  misc_feature (36)..(100): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (22)..(22): Xaa is any aa, unknown, or other
MAEDRSPKPIHCKAAVCRAAGXPLTIEEIVVDPPKAYEIRIRVVCTSLCHTDITFWKAKVAPVFPRILGHEAYGVVESVGEHVEGFAAGDTVVPTFLGQCE

SEQ ID NO: 4547 - DNA, 177 bp, Zea mays
  misc_feature: Ceres CLONE 303181-F
  misc_feature (20)..(20): n is a, c, t, g, unknown, or other
  misc_feature (58)..(58): n is a, c, t, g, unknown, or other
atcacaccgcttcgtaagcnttcgttgaacgttgataacggccacacactccacagdngcccagactacaccgctcttctcccgattcccgaactccacgccacagatctctcgcttttytctcttcttttctctccgtactcttacccccgcagtcgctagctatggcggaggacg

SEQ ID NO: 4548 - DNA, 433 bp, Zea mays
  misc_feature: Ceres CLONE 303190-F
  misc_feature: Translation starting site: 66
  misc_feature (266)..(266): n is a, c, t, g, unknown, or other
  misc_feature (387)..(387): n is a, c, t, g, unknown, or other
aatctcaagccaccatcgaccttcaagtctcgctacgtagcagtgcaataaaaaaagcagccgcaatggcgagcagcaccatggccctctcctccacggccttcgccggccaaggccgtgaacgtgccgtcgtcgtccgccttcggsaggcccgcgtgacgatgcgcaagacggcggggaaggccaagcyggcgggtcgtccgggagcccgtggtacggccccgaccgcgtgctgtacctgggcccactgtccggcgagccgcsanctacctgacgggcgagttcccgggcgactacggctgggacaccggcggggctgtcggcggacccggagacgttcgccaagaaccgggagctggaggtgattccactcccgcttgggccatnctggggcgcgctcggctgcgtcttcccggagctgctcgcccgcaac

SEQ ID NO: 4549 - DNA, 455 bp, Zea mays
  misc_feature: Ceres CLONE 303199-F
  misc_feature: Encodes the peptide sequence at SEQ ID NO. 4550
gtccaaaaccctagccctcgcgccgccgcctcctccgccacccagcgctcgagctcctcgcgtcctgcgagcgcgctccgcaacgtcaccatgaagttcaacatcgcgaacccttccaccgggtgccaaaagaagctggaaatcgatgacgaccagaagctgcgtgccttttatgaccgaagatatcccaggaggagttcaagggttatgtcttcaagatcatgggtggatgtgataagcaaggcttcccaatgaagcaaggagttttgacttctggtcgtgttcgtcttctgctccatagaggcactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgag

SEQ ID NO: 4550 - protein, 78 aa, Zea mays
  misc_feature: Ceres CLONE 303199-F
  misc_feature (1)..(77): Pfam Name: Ribosomal_S6e Pfam Description: Ribosomal protein S6e
MGGCDKQGFPMKQGVLTSGRVRLLLHRGTPCFRGYGRRNGERRRKSVRGCIVSQDLSVINLVIVKKGENDLPGLTDTE

SEQ ID NO: 4551 - DNA, 227 bp, Zea mays
  misc_feature: Ceres CLONE 303209-F
  misc_feature: Encodes the peptide sequence at SEQ ID NO. 4552
awaccaccgcaccgacaccgactccgagccccgccgcgccggctaccttcgctcctctcttcgcccctgccggcgtcgaggccgaagcgaaggcgagcatgcatcacgaccccaaccccttcgacgagggcagcgcgaggacaaccccttctcaaatggaggagccggasccaagcagcagtacggcttccggccgactgagcccgtcgggttcggcggcgctacag

SEQ ID NO: 4552 - protein, 74 aa, Zea mays
  misc_feature: Ceres CLONE 303209-F
  misc_feature (56)..(56): Xaa is any aa, unknown, or other
HRTDTDSEPRRAGYLRSSLRPCRRRGRSEGEHASRPQPLRRGQREDNPFSNGGAGXKQQYGFRPTEPVGFGGAT

SEQ ID NO: 4553 - DNA, 394 bp, Zea mays
  misc_feature: Ceres CLONE 303213-F
  misc_feature: Encodes the peptide sequence at SEQ ID NO. 4554
  misc_feature (143)..(143): n is a, c, t, g, unknown, or other
  misc_feature (144)..(144): n is a, c, t, g, unknown, or other
aaaacactctcctccttcctccaccgccgccaacgtcgcctggcggccgtctgcagctccgcgcctctgctcggaagttggtgaaggtttcttgaagctgagaagatggtgctgaagacagaactctgccgcttcagcgcaannaagatttatcctgggaaaggcatccgatttatccgtgctgattctcaggttttcctttttgccaactcaaaatgcaagckctacttccacaaccgcctgaagcctgcaaagcttacctggacagcaatktacaggaagcagcacaagaaggwtatccatgctgaggctgttcaagaagaggcgccgcgccaccaagaagccattactcgaggtccattgtgggtgcttccctagaggtgatccagaagaa

SEQ ID NO: 4554 - protein, 90 aa, Zea mays
  misc_feature: Ceres CLONE 303213-F
  misc_feature (3)..(73): Pfam Name: Ribosomal_L24e Pfam Description: Ribosomal protein L24e
  misc_feature (13)..(13): Xaa is any aa, unknown, or other
  misc_feature (40)..(40): Xaa is any aa, unknown, or other
  misc_feature (56)..(56): Xaa is any aa, unknown, or other
  misc_feature (64)..(64): Xaa is any aa, unknown, or other
MVLKTELCRFSAXKIYPGKGIRFIRADSQVFLFANSKCKXYFHNRLKPAKLTWTAXYRKQHKKXIHAEAVQEEAPRHQEAITRGPLWVLP

SEQ ID NO: 4555 - DNA, 401 bp, Zea mays
  misc_feature: Ceres CLONE 303238-F
  misc_feature: Encodes the peptide sequence at SEQ ID NO. 4556
gtacaacagtgcccagtgcccaccgcggcagatcttcgacgcctccgagggcgatggaggaggacggcggctccggcagcgatasatggagttcgtcgcgggasgagactagcgctggcgcaggcacaaacgccggcaggaaccgcggcgtgggtgcagggaccagcgtaggcgtggcggcggcacgaagctgcsrattgttgctgcaaaakagtttcggcgaggtgcaagggattctggagcacaaccgcgtcctgattcaggagatcagccagaaccaggagacgcgcgacgsgacgggtctcagccgcaacgtggcgctaatccgggagctcaacactaatatcgcccgcgtcgtggacctctacggcgacatktcagggtccttcgcccgcgccgtc

SEQ ID NO: 4556 - protein, 116 aa, Zea mays
  misc_feature: Ceres CLONE 303238-F
  misc_feature (40)..(116): Pfam Name: DUF1313 Pfam Description: Protein of unknown function (DUF1313)
  misc_feature (11)..(11): Xaa is any aa, unknown, or other
  misc_feature (17)..(17): Xaa is any aa, unknown, or other
  misc_feature (48)..(48): Xaa is any aa, unknown, or other
  misc_feature (53)..(53): Xaa is any aa, unknown, or other
  misc_feature (81)..(81): Xaa is any aa, unknown, or other
  misc_feature (108)..(108): Xaa is any aa, unknown, or other
MEEDGGSGSDXWSSSRXETSAGAGTNAGRNRGVGAGTSVGVAAARSCXLLLQXSFGEVQGILEHNRVLIQEISQNQETRDXTGLSRNVALIRELNTNIARVVDLYGDXSGSFARAV

SEQ ID NO: 4557 - DNA, 482 bp, Zea mays
  misc_feature: Ceres CLONE 303282-F
  misc_feature (420)..(420): n is a, c, t, g, unknown, or other
  misc_feature (445)..(445): n is a, c, t, g, unknown, or other
aaaaccctcctaccccattccgccgcccgccccgcgaccccgaggaggaggcaagatgaagacgatcctggcgtcggagmmtggacatcccggagcgtcacagtgacggtggcggccaagctggtgacggtggagggcccccgcggtaagctcacccggaacttcaagcacctcaacctcgacttccagctgcaggagggcggccgcaagctcaaggtggacgcatggttcggcacccgcscaccatggccgccatccgcaccgccatctcccacgtccagaacctcatcaagggggtcacmaaggggctaccgctacaagatgaggtttgtctacgcccatttccccatcaaacgcgtccatcaccaactccaacaccgccatcgagataaggaacttcctcggcgataagaaggtcanaaaggtggacatgcttaacggcgtnaccatcctccgctccgagaaggtcaaggacgagctta

SEQ ID NO: 4558 - DNA, 190 bp, Zea mays
  misc_feature: Ceres CLONE 303290-F
  misc_feature (133)..(133): n is a, c, t, g, unknown, or other
gtgcccgckgtgctactgctagtgacggttgctctagatccgttcatcctggtggttttgtgaggtcgaaagcggcgagcgaattagaagatgctggacaagctgtgggacgacgtggtggccgggcctcgcnagacggcctcgagaagctccgcaagccaccaccgcccgcccgctcgtcatcaacaaa

SEQ ID NO: 4559 - DNA, 503 bp, Zea mays
  misc_feature: Ceres CLONE 303306-F
  misc_feature: Translation starting site: 100
ctctagccaaaaccctagcagccgcccggtgctccctctctgcaggtggcggcgcgctcccctcgcctcccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggasacaatgttcacctggtcactgttcctgccgctaagacccttggcgagtgggctgggctttgcaagattgactctgagggcaagcaaggaaggttgtaggctgctcctgtgtcgtcgtcaaggactacggtgaagaatctgagggccttaacatagtgcaggagtat

SEQ ID NO: 4560 - DNA, 256 bp, Zea mays
  misc_feature: Ceres CLONE 303322-F
  misc_feature: Encodes the peptide sequence at SEQ ID NO. 4561
  misc_feature (35)..(35): n is a, c, t, g, unknown, or other
  misc_feature (143)..(143): n is a, c, t, g, unknown, or other
agaaaagggcggataaactgcttgaactggaagcnaccctagtccaaaccaccgcaccgacaccgactccgagccccgccgcgccgsgctacctccgctcctctcttcgcccctgccggcgtcgaggccgaagcgaaggcgangcatgcatcacgaccccaaccccttcgacgagggcagcgccgaggacaaccccttctcaaatggaggagccggastcaagcagcagtacggcttccggccgactgagcccgtc

SEQ ID NO: 4561 - protein, 37 aa, Zea mays
  misc_feature: Ceres CLONE 303322-F
  misc_feature (25)..(25): Xaa is any aa, unknown, or other
MHHDPNPFDEGSAEDNPFSNGGAGXKQQYGFRPTEPV

SEQ ID NO: 4562 - DNA, 485 bp, Zea mays
  misc_feature: Ceres CLONE 303330-F
  misc_feature: Encodes the peptide sequence at SEQ ID NO. 4563
  misc_feature (209)..(209): n is a, c, t, g, unknown, or other
  misc_feature (247)..(247): n is a, c, t, g, unknown, or other
tctactcccatttctctgcacgcagctcagtctcgtccatccagtgctgtagaattttctttggtctgttggcaaggcagccatgaaaccccctcagctgccggcagggagggggcctcctgggctcacgaggtcaagcaggccctccgtgagaaactccggcgctcctacggcgccgacctgcctccgccacaccggagctaggccgnccggcgaaccaagccgtggcgccgagtgccgcgcttgncggccgaggaccccataaggagagtcatgttcttggctccctggggtcacacataagaacacaaaccgaccgaccgagatctgggcatgcaakctkagcatggccatgtcttggtcagtcagatctgcaaacaaccgaactataaaawagaactggagcctgtcttgtaaatcatggagcttgctgctgcttgcacccatgaaaaacattaacgcattgagagctggttaactagcta

SEQ ID NO: 4563 - protein, 67 aa, Zea mays
  misc_feature: Ceres CLONE 303330-F
STPISLHAAQSRPSSAVEFSLVCWQGSHETPSAAGREGASWAHEVKQALREKLRRSYGADLPPPHRS

SEQ ID NO: 4564 - DNA, 95 bp, Zea mays
  misc_feature: Ceres CLONE 303331-F
acacactcgactctcctctctcgcatccgcrcctttcgagctctactccaccccctcgatctcgaagcgcmagcagcagtcaggcggccatggac

SEQ ID NO: 4565 - DNA, 469 bp, Zea mays
  misc_feature: Ceres CLONE 303344-F
  misc_feature: Translation starting site: 68
  misc_feature (65)..(65): n is a, c, t, g, unknown, or other
  misc_feature (232)..(232): n is a, c, t, g, unknown, or other
atcttgctctgaacgcattcctcccatctcccaagacctcctcagacccgagaagcgcmtgcggnccatggacgccaccggcactggagctggagggaaggcgaagaagggagcggccggtcgcaaggccgacgggcgagggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacgssgcgtgttgcccaacatcaacccggtcctgctgcccaagaagacggcg

SEQ ID NO: 4566 - DNA, 194 bp, Zea mays
  misc_feature: Ceres CLONE 303372-F
  misc_feature: Encodes the peptide sequence at SEQ ID NO. 4567
  misc_feature (165)..(165): n is a, c, t, g, unknown, or other
aatataaaatcgagaggacgccagggccgattctctgcgtgacttggggcgtcgtcgcgagttttctccggccgagggcggcgcgaccggacaaccagcgtgascggaccggcgacatgactcgcggcaaccagcgtgaccgcgaccgtgagcgcgcggcggcgnaagcccaacgccaagaactcccaggacgg

SEQ ID NO: 4567 - protein, 64 aa, Zea mays
  misc_feature: Ceres CLONE 303372-F
  misc_feature (34)..(34): Xaa is any aa, unknown, or other
  misc_feature (55)..(55): Xaa is any aa, unknown, or other
YKIERTPGPILCVTWGVVASFLRPRAARPDNQRXRTGDMTRGNQRDRDRERAAAXAQRQELPGR

SEQ ID NO: 4568 - DNA, 258 bp, Zea mays
  misc_feature: Ceres CLONE 303375-F
  misc_feature: Encodes the peptide sequence at SEQ ID NO. 4569
  misc_feature (35)..(35): n is a, c, t, g, unknown, or other
  misc_feature (229)..(229): n is a, c, t, g, unknown, or other
atggccaagtgcattgccaccatgctcgcygtcgnkkccatgctcacgtcggtgcagccatcggtggcggcgagcaacccggcagacgcsacgcgctccggttcccggccgcccggkcagcaggccgcgtaaccccgtgttcccggggtaysagaccgaggccgtcgccgccggtgtccagcggctcgtcctccccggtggtgccgtcacccatgcycggcctgccgtngtcgtcgggtccagtgtcaccggcgccct

SEQ ID NO: 4569 - protein, 85 aa, Zea mays
  misc_feature: Ceres CLONE 303375-F
  misc_feature (10)..(10): Xaa is any aa, unknown, or other
  misc_feature (12)..(12): Xaa is any aa, unknown, or other
  misc_feature (30)..(30): Xaa is any aa, unknown, or other
  misc_feature (39)..(39): Xaa is any aa, unknown, or other
  misc_feature (50)..(50): Xaa is any aa, unknown, or other
  misc_feature (72)..(72): Xaa is any aa, unknown, or other
  misc_feature (76)..(76): Xaa is any aa, unknown, or other
GQVHCHHARXRXHAHVGAAIGGGEQPGRRXALRFPAARXAGRVTPCSRGXRPRPSPPVSSGSSSPVVPSPMXGLPXSSGPVSPAP

SEQ ID NO: 4570 - DNA, 381 bp, Zea mays
  misc_feature: Ceres CLONE 303422-F
  misc_feature: Encodes the peptide sequence at SEQ ID NO. 4571
  misc_feature (300)..(300): n is a, c, t, g, unknown, or other
actagaaaaatggccatggcagccgccaccgcgaatgccatcttgctcttggctctcttcttcgccggcgctcacgcgaatgtcccatgcatactccccgtatgcaagacggtgggtggcgggabggttcttcgacgtgcagttctgcctggcggcactcggctccgatggccggagcgtcgaccactgcctcgactaccaggtctactccgccattgccgctgacctcctcgcggccaacctcaccgctacggcgccaagatcaacggcctgctccggaagagcggcggctccgcacanggccacgacgcgctgtctccggtcctgtcaagcgttgtacggcgacattggaacggaggcagactggctgcgcggctgccg

SEQ ID NO: 4571 - protein, 100 aa, Zea mays
  misc_feature: Ceres CLONE 303422-F
  misc_feature (16)..(16): Xaa is any aa, unknown, or other
  misc_feature (74)..(74): Xaa is any aa, unknown, or other
MSHAYSPYARRWVAGXFFDVQFCLAALGSDGRSVDHCLDYQVYSAIAADLLAANLTATAPRSTACSGRAAAPHXATTRCLRSCQALYGDIGTEADWLRGC

SEQ ID NO: 4572 - DNA, 411 bp, Zea mays
  misc_feature: Ceres CLONE 303441-F
  misc_feature (336)..(336): n is a, c, t, g, unknown, or other
atcaatcctcatcgccacccaacccgccgagtccccaagcaagttgagcatccatccatccatggcgggaggcaagtycaccggcaatgcscgcgcmsaggaagcgcgtcgaggcaaccgtcctcaagckctccagggacgggagscttcaccagatgckaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaakcgcaanttcgcccaccgccttctttcctcttcatggacgacttcaggaaggagttcaaggccacccatcctgacaacaaga

SEQ ID NO: 4573 - DNA, 192 bp, Zea mays
  misc_feature: Ceres CLONE 303442-F
  misc_feature: Encodes the peptide sequence at SEQ ID NO. 4574
  misc_feature (103)..(103): n is a, c, t, g, unknown, or other
atctccctgtttaatcaatccttcaagcgcaakgcgctcctcctcgtcgtccggtcgtgakaagggatggcgggccgtggcaaggctatcggcgctggcgccnaagaaggcawcgtcgaggagctccaaggccggactccagttccccgtcggcaggattgctaggttcctcaaggcgggcaattacgctga

SEQ ID NO: 4574 - protein, 63 aa, Zea mays
  misc_feature: Ceres CLONE 303442-F
  misc_feature (11)..(11): Xaa is any aa, unknown, or other
  misc_feature (20)..(20): Xaa is any aa, unknown, or other
  misc_feature (38)..(38): Xaa is any aa, unknown, or other
SPCLINPSSAXRSSSSSGRXKGWRAVARLSALAPKKAXSRSSKAGLQFPVGRIARFLKAGNYA

SEQ ID NO: 4575 - DNA, 262 bp, Zea mays
  misc_feature: Ceres CLONE 303461-F
agagacgcaggagcgcggaggaaaaggaggcccagaccaccgacggggaaaaaaacatcacgaacaccgttctccatagcgggagtagtgaggaacgaaagagagggggcggcctagggcttcgattccgcagccatggacgccgctgacgtgtggggccgctcatcgtcctcgtcttcttcgtccgccgccgccgcgagcctgcaggcggccttacgatctgtacatggggatcgacgacgcggacgccggcttggacgag

SEQ ID NO: 4576 - DNA, 132 bp, Zea mays
  misc_feature: Ceres CLONE 303468-F
acacgcacaccgcgacccagtccagagccagtacgtgcgamrcacgcacgctgctggtccgcgtacsagaacgacggtcaggtcggccggtgcttttcagtttggaataatgacggcgacgacgacgacagc

SEQ ID NO: 4577 - DNA, 402 bp, Zea mays
  misc_feature: Ceres CLONE 303527-F
  misc_feature: Encodes the peptide sequence at SEQ ID NO. 4578
  misc_feature (247)..(247): n is a, c, t, g, unknown, or other
  misc_feature (335)..(335): n is a, c, t, g, unknown, or other
  misc_feature (341)..(341): n is a, c, t, g, unknown, or other
aatccaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgcccacaggtagcggaggcaaagaagaagagagcggcggagagcggcgaggcggcggaggcgaagaagatccaggacgacttctgctcgacgctgtgsagggcaanaaggggacggacctggtcgtgtgcaaaggagtcctgcgcgctctcccagcagtccaacctggtgctgtacggcaggatccagtgcaanggcaantgcaccgagcagaagggcatcacggcgccggccattaaggtcttccaggaggagttcgaca

SEQ ID NO: 4578 - protein, 133 aa, Zea mays
  misc_feature: Ceres CLONE 303527-F
  misc_feature (79)..(79): Xaa is any aa, unknown, or other
  misc_feature (82)..(82): Xaa is any aa, unknown, or other
  misc_feature (111)..(111): Xaa is any aa, unknown, or other
  misc_feature (113)..(113): Xaa is any aa, unknown, or other
SNKQTCSHLLHHHQTQQQPARENNEEPQHGIIGRALGASPRASGGHRPQVAEAKKKRAAESGEAAEAKKIQDDFCSTLXRAXRGRTWSCAKESCALSQQSNLVLYGRIQCXGXCTEQKGITAPAIKVFQEEFD

SEQ ID NO: 4579 - DNA, 130 bp, Zea mays
  misc_feature: Ceres CLONE 303532-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttyagtttggaataatgacggcgacgacgacgaca

SEQ ID NO: 4580 - DNA, 396 bp, Zea mays
  misc_feature: Ceres CLONE 303548-F
  misc_feature (140)..(140): n is a, c, t, g, unknown, or other
  misc_feature (231)..(231): n is a, c, t, g, unknown, or other
  misc_feature (232)..(232): n is a, c, t, g, unknown, or other
  misc_feature (394)..(394): n is a, c, t, g, unknown, or other
atcttgctctgaacgcattcctcccatctcccaagacctcctcagacccgagaagcgcmbtgcggccatggacgccaccggcactggagctggagggaaggcgaagaagggagcggccggtcgcaaggccgcgggcgagngaagaagtcggtgacgaggtccgtgaaggccgggctccagttccccgtcggccgcatcgggcgctacctcaagaagggccgctacgcgcanngtcggcagcggtgcccccgtctacctcgcggccgtcctgggagtacctcgccgctgaggtcctggagctcgccggcaacgctgccaaggacaacaagaagacgcgcatcgtcccgcgccacgtgctgctggcgatccgcaacgacgaggagctcgggaactnct

SEQ ID NO: 4581 - DNA, 389 bp, Zea mays
  misc_feature: Ceres CLONE 303553-F
  misc_feature: Translation starting site: 257
  misc_feature (101)..(101): n is a, c, t, g, unknown, or other
  misc_feature (103)..(103): n is a, c, t, g, unknown, or other
agatcgattcgcgaaagakacgaccgccgccgcatcggaccgtgcccgagccccccttctcctcgctgactcggctcccctcctccgccgtcgccggasangncaagtggggaccacagaagcattagctgggtgaacccactcaaagggggcagggaattgtgtgctagtttgaattggctgctacaaagcttcaggccctttggaaccacccggctggccccaaaaccattcatttctgggcgccaacattcaaatggggcatcagcattgccaacatagccgacttttgctaaaccacctgaaaagatatcttaccctcagcaagttgcttttcatgcactggactcattkggtcaaggtacagctttggttatcacaccgagaaa

SEQ ID NO: 4582 - DNA, 251 bp, Zea mays
  misc_feature: Ceres CLONE 303558-F
acagtcgcctccttcctgcgccgccgccgccgccgccgccgccgctaccaccgcctcgsccgcctgcgstccgcgtttccgcacggaagttggtgaaggtttcttgaggctgagaacatggtgctgaagacggaactttgccgcttcasscaagaagatttatcctgggaaaggcattagatttatccgtgctgattctcaggtcttccttttggccaactcggaaatgcaagcgctacttccacaaccgc

SEQ ID NO: 4583 - DNA, 114 bp, Zea mays
  misc_feature: Ceres CLONE 303561-F
acacgcacaccgcgacccagtccagagccagtacgtgcgamrcaacgcacgctgctggtccgcgtacsagacgacggtcaggtcggccggtgcttttcagtttggaataatgac

SEQ ID NO: 4584 - DNA, 993 bp, Zea mays
  misc_feature: Ceres CLONE 303582
  misc_feature: Encodes the peptide sequence at SEQ ID NO. 4585
gccagccacctctccctcgctctcactcaggtcccccgcaacacgacgagaggcagcaggaccggaaggcgccatggccaccacccgcgacgtctccgccgcctccgcggccgccatgttccacgtgtaccagcccatgccgatgccatccacggcggcggcccccgcgaaggcgggcaagaaggagggcggcaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccgccaggccgagccctccatcgtggccgccacgggctccggcaccaccccggccgtcttcgtctcctcctccgcgccgtccacgtcctcctcctcccactcccactcccactcccactaccagcaccagcagcagcagcaggccaccgtcgtcgtcctgggcaagcgcccgcgcgaggaaggcggcgacgccgcggcggcgtccgtgccggcgttctgggcggcggcgccgcggacgacggcggcagcggacgccagctggggcttctcgccgctggaggcccagcaggcggcggcggggtacgtgcccatggcacaggcgcagcagcagcagcagcaccaccaccacctcaacctgctcgccgcgctctccggtgccgcgaggcgcgccgaggcggcggaggagacccgatgactgctagcctagtagctacatgcatccgccactcgcgcgcatgcattggtcctttgttgtccgtgtgctcgctcttggcagcgtaaacgttcttgatttttgtttgtgtgtgtgcccttgtgatcttggctcgttagctagagtaatccagacttgttttgacacacgggtgatgataatgcatgcgcaaggatcgatccatggcatctgagaaattaacgttcagatgtgcaatcaaaaaaaaaaaaaaaaaa

SEQ ID NO: 4585 - protein, 221 aa, Zea mays
  misc_feature: Ceres CLONE 303582
  misc_feature (24)..(214): Pfam Name: TCP Pfam Description: TCP family transcription factor
MATTRDVSAASAAAMFHVYQPMPMPSTAAAPAKAGKKEGGKDRHSKVNGRGRRVRMPIVCAARVFQLTRELGLKSDGQTIEWLLRQAEPSIVAATGSGTTPAVFVSSSAPSTSSSSHSHSHSHYQHQQQQQATVVVLGKRPREEGGDAAAASVPAFWAAAPRTTAAADASWGFSPLEAQQAAAGYVPMAQAQQQQQHHHHLNLLAALSGAARRAEAAEETR

SEQ ID NO: 4586 - DNA, 336 bp, Zea mays
  misc_feature: Ceres CLONE 303622-F
  misc_feature: Translation starting site: 66
  misc_feature (111)..(111): n is a, c, t, g, unknown, or other
  misc_feature (112)..(112): n is a, c, t, g, unknown, or other
awaccctagtgcttcccaccgatccacttcagccgccgccgcgcgtasaagcaggagcagcaaggatgccggctggccacgggctgcgctcgckgacgscgacctgttcgnncccttccgcaagaagggctacatcccgctcaccacctacctccgcacctacaagatcggcgactacgtsastcaaggtgaacggcgccgtccacaaggggatgccgcacaagtttctaccacggccgcaccggtcgcgtctggaacgtcaccaagcgcgccatcgsttcgagataaacaagcaggtgaatggtcgcatcatcaggaagcgtatccatgtccgcg

SEQ ID NO: 4587 - DNA, 432 bp, Zea mays
  misc_feature: Ceres CLONE 303626-F
  misc_feature: Translation starting site: 68
  misc_feature (43)..(43): n is a, c, t, g, unknown, or other
  misc_feature (107)..(107): n is a, c, t, g, unknown, or other
  misc_feature (352)..(352): n is a, c, t, g, unknown, or other
ctagcgccgcaccctcccgcccacctccgtcgccgcccaaccncagtaagkaggaaggagcaggaagatgccggcggggcacgggctgcggtcgcggacccgccatnttcgcgcggcccttccgcaagaaggggtacatcccactcaccacgtacctgcgcacctacaagatcggcgactacgtcgasgtccaaaggttaacggcgccgtgcacaagggcatgccgcacaagttctaccacggccgcaccgggagcgtctggaacgtcaccaagcgcgccatcggstcgagatcaacaagcaggttaatggccgcatcatcaggaagcggatccatgtccgcgtggagcatntgcagccctcccgttgcacgaggagttccgcttgagaaagccaagaatgaccagctcaaggcggatccaaggcccgcggt

SEQ ID NO: 4588 - DNA, 444 bp, Zea mays
  misc_feature: Ceres CLONE 303628-F
  misc_feature: Translation starting site: 111
  misc_feature (423)..(423): n is a, c, t, g, unknown, or other
atcgtcacaacgcgtcctcgaataaaaatccagacgaaacccaaaatccccaccgaacgcaacctaaaatctccccatccctcctcgatccagccccgcgtagaagagccatggccgattccgcaaccaacgacgcccccctggtcgccagcaaccagcccacggaggaggaggtgacggtggagagggccgcggcgacggaggasaggaggaggagaggctgcggtacctcgagttcgtgcagcaggcggcggcgcaggcgctggtgctggcggccgcggcgtacstacscaagcagggcgccggcccgctccgccccggggtcgatcaggtcgagggcacgttgaaggccgtcgtcggcccgtctacgaccgtttccacgccgtcccgctcgacctcctcaagttcatcgaccgcaagttngtgagtccgttgagagataga

SEQ ID NO: 4589 - DNA, 112 bp, Zea mays
  misc_feature: Ceres CLONE 303629-F
  misc_feature (42)..(42): n is a, c, t, g, unknown, or other
acacgcacaccgcgacccagtccagagccagtacgtgcgavncacgcacgctgctggtccgcgtacsagaacgacggtcaggtcggccggtgcttttcagtttggaataatt

SEQ ID NO: 4590 - DNA, 441 bp, Zea mays
  misc_feature: Ceres CLONE 303638-F
  misc_feature: Encodes the peptide sequence at SEQ ID NO. 4591
accactccaccgggcaggcatccagcgacggaccgggcaggcagagaaaagcagaccagacgagacgtcgtgcgtcgcgtcctccctgccgttccccttcttcagttctcccgctgctgctgccgctgccaccctccgtccgcgtccagatcccgccaccccaatcgatctgccggcctccagcatggcggcgggggcgggggcgagggcgaaggcagcgggasccctggcgctggcgctcgtgctcgcgctasgggccaactccgagggcgacgcgctctcggcstgcgcscagcctcagggaccccggcggcgtgctgcagagctgggaccccacgctcgtcaacccctgcacctggttccacgtcacctgcgaccgcgacaaccgcgtcacccgcctagatcttggtaatttgaacttatctggtcatctggtgcctg

SEQ ID NO: 4591 - protein, 146 aa, Zea mays
  misc_feature: Ceres CLONE 303638-F
  misc_feature: SWISSPROT Homolog: EC 2.7.11.1 Non-specific serine/threonine protein kinase
  misc_feature (74)..(74): Xaa is any aa, unknown, or other
  misc_feature (84)..(84): Xaa is any aa, unknown, or other
  misc_feature (95)..(95): Xaa is any aa, unknown, or other
  misc_feature (97)..(97): Xaa is any aa, unknown, or other
HSTGQASSDGPGRQRKADQTRRRASRPPCRSPSSVLPLLLPLPPSVRVQIPPPQSICRPPAWRRGRGRGRRQRXPWRWRSCSRXGPTPRATRSRXAXSLRDPGGVLQSWDPTLVNPCTWFHVTCDRDNRVTRLDLGNLNLSGHLVP

SEQ ID NO: 4592 - DNA, 511 bp, Zea mays
  misc_feature: Ceres CLONE 303656-F
  misc_feature: Encodes the peptide sequence at SEQ ID NO. 4593
aaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgtaa

SEQ ID NO: 4593 - protein, 140 aa, Zea mays
  misc_feature: Ceres CLONE 303656-F
  misc_feature (25)..(120): Pfam Name: Ribosomal_L7Ae Pfam Description: Ribosomal protein L7Ae/L30e/S12e/Gadd45 family
MADQEAPVAVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIDSEGKARKVVGCSCVVVKDYGEESEGLNIVQEYVKSH

SEQ ID NO: 4594 - DNA, 122 bp, Zea mays
  misc_feature: Ceres CLONE 303691-F
  misc_feature: Encodes the peptide sequence at SEQ ID NO. 4595
atctatcctgatccaaatccgccctactcgcttcatatatcctcccgcgagaaaataattcattccgcaccgcatctdggaatgtctcgtcttgctcgcytccgtccgtcgccgcaccctgc

SEQ ID NO: 4595 - protein, 40 aa, Zea mays
  misc_feature: Ceres CLONE 303691-F
  misc_feature (34)..(34): Xaa is any aa, unknown, or other
IYPDPNPPYSLHISSREKIIHSAPHLGMSRLARXRPSPHP

SEQ ID NO: 4596 - DNA, 426 bp, Zea mays
  misc_feature: Ceres CLONE 303697-F
  misc_feature: Translation starting site: 68
  misc_feature (65)..(65): n is a, c, t, g, unknown, or other
  misc_feature (422)..(422): n is a, c, t, g, unknown, or other
atcttgctctgaacgcattcctcccatctcccaagacctcctcagacccgagaagcgcmkgcggnccatggacgccaccggactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgscagcgttcggcagcggtgcccccgtctacctcgcggccgtcctggagtacctcgccgctgaggtcctggagctcgccggcaacgcttccaaggacaacaakaagacgcgcatcgtcccgcgccacgtgctgctggcgatccgcaacgackaggagctcggggaagctgctgaccggcgtgaccatcgcccacgssgncgtt

SEQ ID NO: 4597 - DNA, 362 bp, Zea mays
  misc_feature: Ceres CLONE 303705-F
  misc_feature: Translation starting site: 68
  misc_feature: SWISSPROT Homolog: EC 5.5.1.6 Chalcone isomerase
  misc_feature (29)..(29): n is a, c, t, g, unknown, or other
  misc_feature (30)..(30): n is a, c, t, g, unknown, or other
acaaccgtagcctgtagcttcwatccgtnngctgctcccggttccatcgcgcggtgcggaatttaacatggccgtgcggagtggtggtcgacggcgtctcttcccgccggtggcccgcccgccgcgctccgccggctcgcacttcctcggcggcgcaggcgtgcgaggcctcgagatcggaggcaacttcatcaagttcacggccatcggcgtgtacctggaggacgcggccgtgccgccttggccaagaagtggggcggcaagacggccgacgagctcgcctccgacgccgccttcttccgcgacgtcgtcacgggcgacttcgagaagttcacgagggtgacgatgatcctcccgctgac

SEQ ID NO: 4598 - DNA, 386 bp, Zea mays
  misc_feature: Ceres CLONE 303724-F
  misc_feature: Encodes the peptide sequence at SEQ ID NO. 4599
  misc_feature (139)..(139): n is a, c, t, g, unknown, or other
  misc_feature (230)..(230): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggcgagngaagaagtcggtgacgaggtccgtgaaggccgggctccagttccccgtcggccgcatcgggcgctacctcaagaagggccgctacgcgcancgtcggcagcggtgcccccgtctacytcgcggccgtcctggagtacctcgccgctgaggtcctggagctcgccggcaacgctgccaaggacaacaagaagacgcgcatcgttcccgcgccacgtgctgctggcgatccgcaacgacgaggagctcg

SEQ ID NO: 4599 - protein, 94 aa, Zea mays
  misc_feature: Ceres CLONE 303724-F
  misc_feature (20)..(20): Xaa is any aa, unknown, or other
  misc_feature (46)..(46): Xaa is any aa, unknown, or other
  misc_feature (76)..(76): Xaa is any aa, unknown, or other
  misc_feature (85)..(85): Xaa is any aa, unknown, or other
LALNAFLPSPKTSSDPRSAXGHGRHRHWSWREGEEGSGRSQGRGRXKKSVTRSVKAGLQFPVGRIGRYLKKGRYAXRRQRCPRLXRGRPGVPRR

SEQ ID NO: 4600 - DNA, 140 bp, Zea mays
  misc_feature: Ceres CLONE 303736-F
  misc_feature (12)..(12): n is a, c, t, g, unknown, or other
acacgcacaccncgacccagtccagagccagtacgtgcgavgcacgcacgctgctggtccgcgtacgcagacgacggtcaggtcggccggtgcttttcagtttggaataatgacggcgacgacgacgacagccgccggcg

SEQ ID NO: 4601 - DNA, 126 bp, Zea mays
  misc_feature: Ceres CLONE 303753-F
  misc_feature (66)..(66): n is a, c, t, g, unknown, or other
acgcacaccgcgacccagtccagagccagtacgtgcgamgtcacgcacgctgctggtccgcgtacnagacgacggtcaggtcggccggtgcttttcagtttggaataatgacggcgacgacgacga

SEQ ID NO: 4602 - DNA, 387 bp, Zea mays
  misc_feature: Ceres CLONE 303756-F
  misc_feature: Encodes the peptide sequence at SEQ ID NO. 4603
  misc_feature (362)..(362): n is a, c, t, g, unknown, or other
agcaaaccctagcgccacccacccacccacccactcgcttcagccgcctccgccgcgstacaaagcaggtggagacaggatgccggctggccacggctgcgctcgcggacgscgacctcttcgcgcccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcgsytcggaggtcaacaagcaggtcaatgggcgcatcatcaggaagcgtatccatgtccgtgtggagcatntgcagccgtcccgctgcacagaaga

SEQ ID NO: 4603 - protein, 102 aa, Zea mays
  misc_feature: Ceres CLONE 303756-F
  misc_feature (2)..(99): Pfam Name: Ribosomal_L21e Pfam Description: Ribosomal protein L21e
  misc_feature (72)..(72): Xaa is any aa, unknown, or other
  misc_feature (95)..(95): Xaa is any aa, unknown, or other
MPAGHGCARGRRPLRAPFRKKGYIPLTTYLRTYKIGDYVDVKVNGAVHKGMPHKFYHGRTGRVWNVTKRAIXSEVNKQVNGRIIRKRIHVRVEHXQPSRCTE

SEQ ID NO: 4604 - DNA, 244 bp, Zea mays
  misc_feature: Ceres CLONE 303789-F
  misc_feature: Encodes the peptide sequence at SEQ ID NO. 4605
agcgaccctagtccaaaccaccgcaccgacaccgactccgagccccgccgcgccgcgcttacctccgctcctctcttcgcccctgccggcgtcgaggccgaagcgaaggcgagcatgcatcacgaccccaaccccttcgacgagggcagcgcgaggacaaccccttctcaaatggaggagccggasgtcaagcagcagtacggcttccggccgactgagcccgtcgggttcggcggcgctacag

SEQ ID NO: 4605 - protein, 43 aa, Zea mays
  misc_feature: Ceres CLONE 303789-F
  misc_feature (24)..(24): Xaa is any aa, unknown, or other
MHHDPNPFDEGSARTTPSQMEEPXVKQQYGFRPTEPVGFGGAT

SEQ ID NO: 4606 - DNA, 117 bp, Zea mays; identical to SEQ ID NO: 2403
  misc_feature: Ceres CLONE 303791-F

SEQ ID NO: 4607 - DNA, 450 bp, Zea mays
  misc_feature: Ceres CLONE 303805-F
  misc_feature: Translation starting site: 252
  misc_feature: SWISSPROT Homolog: EC 3.6.3.14 H(+)-transporting two-sector ATPase
  misc_feature (169)..(169): n is a, c, t, g, unknown, or other
  misc_feature (363)..(363): n is a, c, t, g, unknown, or other
  misc_feature (367)..(367): n is a, c, t, g, unknown, or other
  misc_feature (368)..(368): n is a, c, t, g, unknown, or other
akattttyagatcagaaccaaactcggctcgagagagatcgcatacgcctgcctgcycacccacctccccttttccttcctcttcgccccagcgacgcgtccgcccggagaccgagcgaggcaggcaactaaccaccgagaggcagggacaggaacaggaagccggavnagatgtcgtcggtgttcagcggcgatgagacggcccccttcttcggcttcctcggcgccgcsccgccctcgtcttctcatgcatgggcgccgcgtacgggaccgcgaagagcggcgtcggcgtggcgtcgatgggtgtgatgcggccggagctcgtcatgaagtccatcgtgcccgtgggtcatggctggtgtnctcnntatctacgggctcatcatcgccgtcatcattagcacggggatcaaccccaaggccaagccctactaccttctttgatggcta

SEQ ID NO: 4608 - DNA, 325 bp, Zea mays
  misc_feature: Ceres CLONE 303826-F
  misc_feature: Encodes the peptide sequence at SEQ ID NO. 4609
  misc_feature (253)..(253): n is a, c, t, g, unknown, or other
  misc_feature (254)..(254): n is a, c, t, g, unknown, or other
cggcatcacccccaatttcttctactccaccgaaacataaatccgtagcctggtcttctgcttcgcraaagatcttgcggaaggtggcagacgcatagatgagggtgagagcatttggcggtasgcttgacgagcgacgagtaaaccctaatgctttgatcgcggcggcgtcgtttgagacactcccgaatcgatccgcctacatgcctatgaatcctcctcccccgccgcctcctgggtcggcgtcttcgannctgtggggccagctacttccctctccctttccacctgcagcagcaccagccgcagccgcagatgccgccgc

SEQ ID NO: 4609 - protein, 75 aa, Zea mays
  misc_feature: Ceres CLONE 303826-F
  misc_feature (9)..(9): Xaa is any aa, unknown, or other
  misc_feature (52)..(52): Xaa is any aa, unknown, or other
MRVRAFGGXLDERRVNPNALIAAASFETLPNRSAYMPMNPPPPPPPGSASSXLWGQLLPSPFPPAAAPAAAADAA

SEQ ID NO: 4610 - DNA, 243 bp, Zea mays
  misc_feature: Ceres CLONE 303856-F
  misc_feature: Translation starting site: 117
  misc_feature (99)..(99): n is a, c, t, g, unknown, or other
  misc_feature (100)..(100): n is a, c, t, g, unknown, or other
  misc_feature (165)..(165): n is a, c, t, g, unknown, or other
  misc_feature (166)..(166): n is a, c, t, g, unknown, or other
ctgtgtctcgtaggtggacatattctccgcgtgacttcaggtgtcgtcgccgagttgtctccggccgagggcggcggcgcgaccggtaaccagcgtcanngagtgtgacaggcgacatgactcgcggcaaccagcgtgaccgcgatcgtgagcgcgcggcggcgnnaagcccaacgkcaaggggccccaggacgggctcaccccggagcagcgccgtgagagggacaagaaagcgctggagga

SEQ ID NO: 4611 - DNA, 117 bp, Zea mays
  misc_feature: Ceres CLONE 303915-F
  misc_feature (42)..(42): n is a, c, t, g, unknown, or other
acacgcacaccgcgacccagtccagagccagtacgtgcgavncaacgcacgctgctggtccgcgtacbagacgacggtcaggtcggccggtgcttttcagtttggaataatgacggc

SEQ ID NO: 4612 - DNA, 195 bp, Zea mays
  misc_feature: Ceres CLONE 303934-F
aactggttagttattacgtgccgtcccaactcacccgcggctccgtaccatccgtcgccgccggccaccgcgatggccgcctccgccccggccgtgacgtctcgcccgggccgcawtccctatcccgctctctgcgcgtccgcggaccgccaggtctcctcgctccccctggcttctcctgctccggcccaacgc

SEQ ID NO: 4613 - DNA, 378 bp, Zea mays
  misc_feature: Ceres CLONE 303947-F
  misc_feature: Translation starting site: 67
  misc_feature (228)..(228): n is a, c, t, g, unknown, or other
  misc_feature (311)..(311): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgckggcgaggaagaagtcggtgacgaggtccgtgaaggccgggctccagttccccgtcggccgcatcgggcgctacctcaagaagggccgctacgscangtcggcagcggtgcccccgtctacytcgcggccgtcctggagtacctcgccgctgaggtcctggagctcgccgggcaacgctnccaaggacaacaagaagacgcgcatcgtcccgcgccacgtgctgctggcgatccgcaacgacgagga

SEQ ID NO: 4614 - DNA, 128 bp, Zea mays
  misc_feature: Ceres CLONE 303953-F
  misc_feature (81)..(81): n is a, c, t, g, unknown, or other
atattctccgcgtgacttcaggtgtcgtcgccgagttgtctccggccgagggcggcggcgcgaccggttaaccagcgtcancgagtgtgacaggcgacatgactcgcggcaaccagcgtgaccgcgat

SEQ ID NO: 4615 - DNA, 485 bp, Zea mays
  misc_feature: Ceres CLONE 303958-F
  misc_feature: Encodes the peptide sequence at SEQ ID NO. 4616
awaaccttagccgcgcgacgcccaccagcagctgccccttgctgtcgccgcctctctccgcgcgaccgatctaccgccgccgccaccatgtcgctgatcgccggcgaggacttccaacatattctgcgtctgctgaacaccaatgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggattacaaggatggaaggttctcacaggtcgtgtccaacgccctcgacatgaagctcagggacgacctcgagaggctcaagaagatcaggaaccaccgtggtctgcgtcactactggggcctccgtgttcgtgg

SEQ ID NO: 4616 - protein, 132 aa, Zea mays; identical to SEQ ID NO: 579
  misc_feature: Ceres CLONE 303958-F
  misc_feature (14)..(132): Pfam Name: Ribosomal_S13 Pfam Description: Ribosomal protein S13/S18

SEQ ID NO: 4617 - DNA, 348 bp, Zea mays
  misc_feature: Ceres CLONE 303996-F
  misc_feature: Encodes the peptide sequence at SEQ ID NO. 4618
  misc_feature (74)..(74): n is a, c, t, g, unknown, or other
  misc_feature (75)..(75): n is a, c, t, g, unknown, or other
  misc_feature (123)..(123): n is a, c, t, g, unknown, or other
  misc_feature (295)..(295): n is a, c, t, g, unknown, or other
acgcaacaaagcatcttgagtgttcgacagcgagccatggagaagacgtccgagaacgccatcccgccggcggnnccccgctgatgctgttcgggtcgtgggcgagctcgtacacgcaccgcncaggctggcgctgcggctcaagggcctggagtacgactamrgtggaggaggacctggggaacaagagcgacgagctgctgcgccacaaccccgtccacaagaaggtgcccgtgctcgtccacggcggccgcgcgctcccgggagtccggtcatttatcctccagtaccttgnacgacgcctggccggagacccgcccgctgctccccgccgacgccttcgaccgc

SEQ ID NO: 4618 - protein, 88 aa, Zea mays
  misc_feature: Ceres CLONE 303996-F
  misc_feature: SWISSPROT Homolog: EC 2.5.1.18 Glutathione transferase
  misc_feature (14)..(14): Xaa is any aa, unknown, or other
  misc_feature (27)..(27): Xaa is any aa, unknown, or other
  misc_feature (71)..(71): Xaa is any aa, unknown, or other
MLFGSWASSYTHRXGWRCGSRAWSTTXVEEDLGNKSDELLRHNPVHKKVPVLVHGGRALPGVRSFILQYLXRRLAGDPPAAPRRRLRP

SEQ ID NO: 4619 - DNA, 185 bp, Zea mays
  misc_feature: Ceres CLONE 304007-F
  misc_feature (140)..(140): n is a, c, t, g, unknown, or other
agtcgcctccttcctgcgccgccgccgccgccgccgctaccaccgcctcgsccgcctgcktccgcgtttccgcacggaagttggtgaaggtttcttgaggctgagaacatggtgctgaagacggaactttgccgcttcanscaaggaagatttatcctgggaaaggcattagatttatccgtgct

SEQ ID NO: 4620 - DNA, 137 bp, Zea mays
  misc_feature: Ceres CLONE 304013-F
  misc_feature (102)..(102): n is a, c, t, g, unknown, or other
aggaagaaaggaacccaccaaagcttcaaaaaaagaaaaagagctgcacactggtcactggaaaacgaaggcaaaccctaatcgctactccaccgcagctgncactacaccgatcgggctccgatggacttcgcgga

SEQ ID NO: 4621 - DNA, 112 bp, Zea mays
  misc_feature: Ceres CLONE 304062-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatg

SEQ ID NO: 4622 - DNA, 175 bp, Zea mays
  misc_feature: Ceres CLONE 304063-F
atctcactcccagtcgccgccgcacatacaaatacgcgacgggaacggccagggccgaaccctaaaaccatcgccctgcccccgcctccgcctccgcctccgcctccgctgcatcccatggcggccgtgcagcgcctcctccgggcagtcgccccggtggctcggcagcggcggc

SEQ ID NO: 4623 - DNA, 115 bp, Zea mays
  misc_feature: Ceres CLONE 304087-F
acacgcacaccgcgacccagtccagagccagtacgtgcgamrcacgcacgctgctggtccgcgtacbagacgacggtcaggtcggccggtgcttttcagtttggaataatgacgg

SEQ ID NO: 4624 - DNA, 373 bp, Zea mays
  misc_feature: Ceres CLONE 304089-F
  misc_feature: Encodes the peptide sequence at SEQ ID NO. 4625
atcactgccaaatcccccagaaagtcaactcctccccaattccacgctgccaccaactcccgtcctccgcgccaagcaccaaagctccgatggcccgcacgaagcagacggcgcgcaagtcaacgggcggcaaggcgccccgcaagcagctggcgaccaaggcggcgcgcaagtctgcgccggccaccgssgcgttgaagaagccccaccgcttccgccccggcaccgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcagga

SEQ ID NO: 4625 - protein, 94 aa, Zea mays
  misc_feature: Ceres CLONE 304089-F
  misc_feature (34)..(34): Xaa is any aa, unknown, or other
MARTKQTARKSTGGKAPRKQLATKAARKSAPATXALKKPHRFRPGTVALREIRKYQKSTELLIRKLPFQRLVREIAQDFKTDLRFQSSAVSALQ

SEQ ID NO: 4626 - DNA, 148 bp, Zea mays
  misc_feature: Ceres CLONE 304102-F
  misc_feature (60)..(60): n is a, c, t, g, unknown, or other
  misc_feature (61)..(61): n is a, c, t, g, unknown, or other
atcacagctagctagcatacagacgaataatctcttcttcacctcactracascagctannaactctttctctcctgcaataatggccgctcgctcctcctcctcccagccgcagctgtcgtggcggcggcggtcctggcagcggcgc

SEQ ID NO: 4627 - DNA, 501 bp, Zea mays
  misc_feature: Ceres CLONE 304116-F
  misc_feature: Translation starting site: 79
acacagacacatacacacatccgtcaaagaaacaagtgcacacaaataaatacctcgctcgctagattgccaagaacaatggcctttaggtcatccatcctcctcgccacggtggcgctggctacgctattcgtgatcggttcgtgcaccaccccgctcaccttccaggtcggcaagggctccaagccgccacttgatcctcacccccaacgttgccaccatctctgacgtggagatcaaggagcacggtggcgacgacttctcctttacgctcaaggagggtccgactggcacctggacgcttgacaccaagaccccgctcaagtaccccctctgcattcgcttcgccgttaagtctggtggctaccgcatcgccgacgacgtcatccccgccaatttcaaggccggcaccacctacaagaccaccctcagcatctgattagcctcttatgacgaataatattttgagagagctcatctggaccatgttccagcgagcta

SEQ ID NO: 4628 - DNA, 290 bp, Zea mays
  misc_feature: Ceres CLONE 304149-F
  misc_feature: Encodes the peptide sequence at SEQ ID NO. 4629
aaagaacagctgtcgatccaattgtyacttgctctccctccaacaagctaattaaggccggtcgtcatccctcttctagctcgttttattatccatggcggaggagaagcaccaccaccaccacctgttccaccataagaaggacgaggagcaggaggagcagctcgccggcgggggttacggcgagtccgcsaagtacacggaggccacggtgacggaggtggtgtccacgggcgagaacgagtacgacgagtacaaggaggagaagcagcataagcacaagcagcacc

SEQ ID NO: 4629 - protein, 65 aa, Zea mays
  misc_feature: Ceres CLONE 304149-F
MAEEKHHHHHLFHHKKDEEQEEQLAGGGYGESAKYTEATVTEVVSTGENEYDEYKEEKQHKHKQH

SEQ ID NO: 4630 - DNA, 237 bp, Zea mays
  misc_feature: Ceres CLONE 304150-F
  misc_feature: Encodes the peptide sequence at SEQ ID NO. 4631
  misc_feature (166)..(166): n is a, c, t, g, unknown, or other
  misc_feature (168)..(168): n is a, c, t, g, unknown, or other
aaagaaaaaatcgagaggacgccagggccgattctctgcgtgacttggggcgtcgtcgcgagttttctccggccgagggcggcgcgaccggacaaccagcgtgascgaccggcgacatgactcgcggcaaccagcgtgaccgcgaccgtgagcgcgcggcggcgtnanagcccaacgccaagaactcccaggacgggctcaccccggagcagcgccgcgagagggacaagaaagctc

SEQ ID NO: 4631 - protein, 40 aa, Zea mays
  misc_feature: Ceres CLONE 304150-F
  misc_feature (17)..(17): Xaa is any aa, unknown, or other
  misc_feature (18)..(18): Xaa is any aa, unknown, or other
MTRGNQRDRDRERAAAXXPNAKNSQDGLTPEQRRERDKKA

SEQ ID NO: 4632 - DNA, 277 bp, Zea mays
  misc_feature: Ceres CLONE 304167-F
  misc_feature: Encodes the peptide sequence at SEQ ID NO. 4633
aaaaacattttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgcasccggttttgtgggcgtggcggccagctcgccgccacgygccggatctcgcaaagaaggtgtccgagagcatcaagcaggcccaggagacgtgcgcagatgaccc

SEQ ID NO: 4633 - protein, 74 aa, Zea mays
  misc_feature: Ceres CLONE 304167-F
  misc_feature (40)..(40): Xaa is any aa, unknown, or other
  misc_feature (53)..(53): Xaa is any aa, unknown, or other
MAISVTAVAALSAFSAQRSLPQPYRQRVVTFIVVRPVRAXPVLWAWRPARRHXPDLAKKVSESIKQAQETCADD

SEQ ID NO: 4634 - DNA, 206 bp, Zea mays
  misc_feature: Ceres CLONE 304177-F
  misc_feature: Encodes the peptide sequence at SEQ ID NO. 4635
  misc_feature (37)..(37): n is a, c, t, g, unknown, or other
aagcacaagcacaaccaaaagcaaagaagagacgaangtcgatcgatctcagcaactaagcaggtaggtaggcatggyggccgagaaggagggcgcggtggtgaccaagggccacgacgaggggatgaaggcggcggcggcgctgctggaggagttcgggctcccgccggggctgctgcgctggaggacgtgacggaggtggggtt

SEQ ID NO: 4635 - protein, 39 aa, Zea mays
  misc_feature: Ceres CLONE 304177-F
  misc_feature (2)..(2): Xaa is any aa, unknown, or other
MXAEKEGAVVTKGHDEGMKAAAALLEEFGLPPGLLRWRT

SEQ ID NO: 4636 - DNA, 124 bp, Zea mays
  misc_feature: Ceres CLONE 304197-F
  misc_feature (43)..(43): n is a, c, t, g, unknown, or other
acacgcacaccgcgacccagtccagagccagtacgtgcgamgncaacgcacgctgctggtccgcgtacsagacgacggtcaggtcggccggtgcttttcagtttggaataatgacggcgacgac

SEQ ID NO: 4637 - DNA, 373 bp, Zea mays
  misc_feature: Ceres CLONE 304243-F
  misc_feature: Encodes the peptide sequence at SEQ ID NO. 4638
cytctagccaaaaccctagcagcygcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtggcttsctgaggactgtgaccagccagattatgtcaagctggtgaaggcactctgcgcggasacaatgttcacctggkacactgttcctgccgctaagacccttcg

SEQ ID NO: 4638 - protein, 64 aa, Zea mays
  misc_feature: Ceres CLONE 304243-F
  misc_feature (32)..(32): Xaa is any aa, unknown, or other
  misc_feature (50)..(50): Xaa is any aa, unknown, or other
  misc_feature (56)..(56): Xaa is any aa, unknown, or other
MKKSSAHDGLVKGLRELPRPSRSTPLSFAWLXEDCDQPDYVKLVKALCAXTMFTWXTVPAAKTL

SEQ ID NO: 4639 - DNA, 420 bp, Zea mays
  misc_feature: Ceres CLONE 304249-F
  misc_feature (192)..(192): n is a, c, t, g, unknown, or other
  misc_feature (335)..(335): n is a, c, t, g, unknown, or other
  misc_feature (363)..(363): n is a, c, t, g, unknown, or other
  misc_feature (376)..(376): n is a, c, t, g, unknown, or other
gtttttaatcaatccttcaagcgcaaskgcctcctcctcgtcgtccggtcgtgagaagggatggcgggccgtggcaaggctatcggcgctggcgccgaaagaaggcaacgtcgaggagctccaaggccggactccagttccccgtcggcaggattgcyaggttcctcaaggcgggcaagtacgcggrgcgtncggcgccggcgcccccgtgtacctcgccgccgtcctcgagtacctcgcggctgaggttctcgaacttcccgggkaacgccgcgaggacaacaagaagacccgcattgtgccgcgccacatccagcttgctgtgcgcaacgacnaggaccttgaccaaactgttgggtggtnccaccatcgcgancggaggtgttwatgcctaacatccatcagcatctgctccccaag

SEQ ID NO: 4640 - DNA, 476 bp, Zea mays
  misc_feature: Ceres CLONE 304263-F
  misc_feature: Encodes the peptide sequence at SEQ ID NO. 4641
gcatcgtctcctcgtttaaacgggcgaactcaagattgcaacagggtcgtccgccgccaccaattgctagcgcaatcctagccctagcccagcgcccctccctgcgtcgtgctcggtagcgatggcgtcgttttctgaagcgcccccggggaacccaactgctggcgagaagatcttcaagaccaagtgcgcgcagtgccacaccgtcgacaagggcgccggccacaagcaaggtcctaatttgaatggtctgtttgggaggcagtctggtacaacacctggctactcttactcttcggctaacaagaacatggctgtgatttgggaggagaacactttgtatgactacttgcttaatcccaagaagtacattcctggaaccaagatggtattccctggactgaaaaagccacaggaacgtgctgatctcattgcatacctgaagaatgccactgtctgatgaggattgctgctgt

SEQ ID NO: 4641 - protein, 112 aa, Zea mays
  misc_feature: Ceres CLONE 304263-F
  misc_feature (12)..(111): Pfam Name: Cytochrom_C Pfam Description: Cytochrome c
MASFSEAPPGNPTAGEKIFKTKCAQCHTVDKGAGHKQGPNLNGLFGRQSGTTPGYSYSSANKNMAVIWEENTLYDYLLNPKKYIPGTKMVFPGLKKPQERADLIAYLKNATV

SEQ ID NO: 4642 - DNA, 279 bp, Zea mays
  misc_feature: Ceres CLONE 304284-F
  misc_feature: Encodes the peptide sequence at SEQ ID NO. 4643
acaacaccagaatccgcgaatcacagacgcgtctatctcagcttgctgcactgcactaccctgccctgccatcatatcgtacgtgagcccggccgagcgagasmgggagaggcatggctgctccgaagctcgcgacgctggcgctggccgtgctcctggcggcgaccgtggtggctcccccggccgcggtgcgcgcgggattgtcgtgctccaccgtgtacagcacgctgatgccgtgcctgccgttcgtccagatgggcggggcatgcgcccagccgt

SEQ ID NO: 4643 - protein, 55 aa, Zea mays
  misc_feature: Ceres CLONE 304284-F
MAAPKLATLALAVLLAATVVAPPAAVRAGLSCSTVYSTLMPCLPFVQMGGACAQP

SEQ ID NO: 4644 - DNA, 191 bp, Zea mays
  misc_feature: Ceres CLONE 304297-F
  misc_feature: Encodes the peptide sequence at SEQ ID NO. 4645
ctgattttttgttcccttcaccgacggcgaggagtgagggttgacaacgggatggcgcggasyattccgtacgtttcggcggcgaactggtatccatggcgcgaggcaatccccgcctcgccatcatcgacgtcagggatgaggagaggagctaccacgctcacatcgcgggttcgcaccacttcgccagc

SEQ ID NO: 4645 - protein, 32 aa, Zea mays
  misc_feature: Ceres CLONE 304297-F
  misc_feature: SWISSPROT Homolog: EC 3.1.3.48 Protein-tyrosine-phosphatase
MARGNPRLAIIDVRDEERSYHAHIAGSHHFAS

SEQ ID NO: 4646 - DNA, 397 bp, Zea mays
  misc_feature: Ceres CLONE 304301-F
  misc_feature: Encodes the peptide sequence at SEQ ID NO. 4647
  misc_feature (262)..(262): n is a, c, t, g, unknown, or other
atttctcctccacgccgccccctccgcatttcccgtgctcctcttgttccggcatggcggasagacgcagccacaaggggaaggcggcgctasccaagcacgagtccctgatggagaagctcgccgacaagctccacgtcggcggcggcaaggccgactcctcctcctcctcggactccgacagtgacgagcggccccgcccctcggcaccgcctgccgacgagctcaagcagtcctccttctccgacgccgccgccacgsnggctcgaggccaaagccaaggtgttccgccttttcggccgcgagcagcccatccacaaggccctcggtggcggcaagctgctgatgtgttcttgtggaggwaacaagaacatctctgctggaatayttggtggtg

SEQ ID NO: 4647 - protein, 114 aa, Zea mays
  misc_feature: Ceres CLONE 304301-F
  misc_feature (3)..(3): Xaa is any aa, unknown, or other
  misc_feature (14)..(14): Xaa is any aa, unknown, or other
  misc_feature (70)..(70): Xaa is any aa, unknown, or other
  misc_feature (104)..(104): Xaa is any aa, unknown, or other
  misc_feature (112)..(112): Xaa is any aa, unknown, or other
MAXRRSHKGKAALXKHESLMEKLADKLHVGGGKADSSSSSDSDSDERPRPSAPPADELKQSSFSDAAATXARGQSQGVPPFRPRAAHPQGPRWRQAADVFLWRXQEHLCWNXWW

SEQ ID NO: 4648 - DNA, 448 bp, Zea mays
  misc_feature: Ceres CLONE 304318-F
  misc_feature: Encodes the peptide sequence at SEQ ID NO. 4649
  misc_feature (306)..(306): n is a, c, t, g, unknown, or other
aacaccctgtgcgcgcgggctctcttcgtcgtgcggcaactgcgcgaccgccgacgcccgacggcatgagtgcaccaggtcttcgtcgaccccttcgcaaggcctcggttccatccttcgccggasccgcccgtcaacaggacttgatctactactcactagcggtgtagaggcgaagagaagaacttgaccatgagcagcataggcacaggttacgatttgtctgtcacgactttctccccagatggtcgtgtcttccaggtcgagtatgccaccaaggccgtcgacaacagcgggactgttgtngggatcaagtgcaaagatggcattgtcctgggtgtcgagaagctggtaacctcaaagatgatgctggaaggatcaaaccgaagatccattcggtgcaccgtcactctggctgggttgttgctggtttagcagcagatggcag

SEQ ID NO: 4649 - protein, 80 aa, Zea mays
  misc_feature: Ceres CLONE 304318-F
  misc_feature: SWISSPROT Homolog: EC 3.4.25.1 Proteasome endopeptidase complex
MSSIGTGYDLSVTTFSPDGRVFQVEYATKAVDNSGTVVGIKCKDGIVLGVEKLVTSKMMLEGSNRRSIRCTVTLAGLLLV

SEQ ID NO: 4650 - DNA, 487 bp, Zea mays
  misc_feature: Ceres CLONE 304410-F
  misc_feature: Encodes the peptide sequence at SEQ ID NO. 4651
  misc_feature (198)..(198): n is a, c, t, g, unknown, or other
  misc_feature (199)..(199): n is a, c, t, g, unknown, or other
awacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcaktnntgtyatgcaggactacgtcgtcgacggcttcatgaagaacaccaactgtgacgacccggagctcaaggagaagctcaccagactctgcaagacgacgaccgtkaggactcggtacgtggtgatgtcggatgakatcctcaagaactacccggagctggcgcaggaggggctgccgacgatgaatcagcgtctggacatctcgaacgcggcggtgacsagatggcgacggrkgcgtccctgtcgtgcgtccgctcgttgggcggcgcgctctcgtccatcacccacctc

SEQ ID NO: 4651 - protein, 94 aa, Zea mays
  misc_feature: Ceres CLONE 304410-F
  misc_feature: SWISSPROT Homolog: EC 2.3.1.74 Naringenin-chalcone synthase
  misc_feature (43)..(43): Xaa is any aa, unknown, or other
  misc_feature (76)..(76): Xaa is any aa, unknown, or other
MQDYVVDGFMKNTNCDDPELKEKLTRLCKTTTVRTRYVVMSDXILKNYPELAQEGLPTMNQRLDISNAAVTRWRRXRPCRASARWAARSRPSPT

SEQ ID NO: 4652 - DNA, 455 bp, Zea mays
  misc_feature: Ceres CLONE 304470-F
  misc_feature: Encodes the peptide sequence at SEQ ID NO. 4653
  misc_feature (433)..(433): n is a, c, t, g, unknown, or other
aggatttgcaacccatttctctcctcgactcccacaacacggtccgtacggtaaagagagagaaggtgggagtggaatcgacaggggaaaaccaagcctgcgtttcagagacaactcaggcggcgcgatggcgatggcggcgctgcgacgcgaggggaggcgcctcctcctctcccccaccgtccccaacccgtcttcggcggccgcttccgctgcggtgacgsgatcctccgccakkgtcgcaaccggagatggctccacttggtgcacgttctatttcaactcaagttgtgaggaaccggatgaagagtatcaaaaacatccagaagatcacaaaggctatgaagatggttgcagcatcaaagcttcgggctgttcagacgaggactgawaattcacgcggcttgtggcagccgttcaccgccctttcttngggacgctcctagtgttgatgt

SEQ ID NO: 4653 - protein, 64 aa, Zea mays
  misc_feature: Ceres CLONE 304470-F
  misc_feature: SWISSPROT Homolog: EC 3.6.3.14 H(+)-transporting two-sector ATPase
  misc_feature (47)..(47): Xaa is any aa, unknown, or other
  misc_feature (61)..(61): Xaa is any aa, unknown, or other
MAPLGARSISTQVVRNRMKSIKNIQKITKAMKMVAASKLRAVQTRTXNSRGLWQPFTALSXGRS

SEQ ID NO: 4654 - DNA, 182 bp, Zea mays
  misc_feature: Ceres CLONE 304537-F
  misc_feature (177)..(177): n is a, c, t, g, unknown, or other
ctttgaagtgcgcacgcatgccctgaagccttcgggtccgtgacgatgtcgaggagagccgcagcagcgcttgcbtcgcktgcctcgccgtgctggcggcggcactggcggacggcgcgctgctcccgtggttcggcgaagggaggcgcgggggcgacgaggccgcggcggcgcggncgtct

SEQ ID NO: 4655 - DNA, 418 bp, Zea mays
  misc_feature: Ceres CLONE 304608-F
  misc_feature: Encodes the peptide sequence at SEQ ID NO. 4656
aatcgaaaaaggacactacgagaagaggaggttcatttccgcgtcgtctccgccagcagccccacccaccacatggcagccatgcgggtggggcccacgccgccggcccgcggaccagatgcaggtggaccagccgctccccgctgcggccgcacacggcccgcggacgccaagcatgctggttctatgattgaagggaatgatccagtcacgggtcatataatctcaacaaccattggagggaagaatggagagcctaaaaagactatcagctacatggcagagagagttgtgggaactggatcattcggaatcgtcttccaggcaaaatgtctggagactggtgagactgttgctatcaagaaggttttgcaggacaagcgctacaagaacagggagctgcaaatyatgcgatcca

SEQ ID NO: 4656 - protein, 115 aa, Zea mays
  misc_feature: Ceres CLONE 304608-F
  misc_feature: SWISSPROT Homolog: EC 2.7.11.1 Non-specific serine/threonine protein kinase
MAAMRVGPTPPARGPDAGGPAAPRCGRTRPADAKHAGSMIEGNDPVTGHIISTTIGGKNGEPKKTISYMAERVVGTGSFGIVFQAKCLETGETVAIKKVLQDKRYKNRELQIMRS

SEQ ID NO: 4657 - DNA, 769 bp, Zea mays
  misc_feature: Ceres CLONE 304630-R
  misc_feature: Pfam Name: UPF0005 Pfam Description: Uncharacterised protein family UPF0005
ttcccctttgtccttttttttctgtatttttacgccttgttgttgatccgttttgcccccaattgggtacgaggccccccctcgaggtcgacggtatcgataagcttttttttttttttttttctcgacccaaggtaacaccgtacgtagtatcgttataaattggagtatccatgaccattacctagtttgtgatacacacaaatgcaccgtgagaacaagatccgagtgaaagcttgacgagctcacctattggctgccctcatcagttgatgcacaaacaggaacaggttgatgacgtcgaggttagagtgaaacagcagcccatacgtattcttcgtacgtgtagcgcttgatgacattgtccgtgtcatagatgatgtgtccaccgaagattagcgatgccaaccgaccgaatacccagcactgacatcttacctggtgggcaaaaagacctggattagcgaataccccttgagccccctgtattttagtagataccaccgggagcaacgaagttcacactcctcgctccccccccccgcatgcccctataccgccgtagcttcgccctgttgaacaacacccaactgaccgtaacaccggtacctccataaacaacatttgttttcctagtgcacccggatatgtttattccccacagccccattttgaattgctgccctgcctaagtacgcccgcggcacggagggccggatgtgtaaacgcggatcggttatctagggggcccagtttttttcgtccctca

SEQ ID NO: 4658 - DNA, 233 bp, Zea mays
  misc_feature: Ceres CLONE 304702-F
  misc_feature: Encodes the peptide sequence at SEQ ID NO. 4659
  misc_feature (75)..(75): n is a, c, t, g, unknown, or other
  misc_feature (118)..(118): n is a, c, t, g, unknown, or other
  misc_feature (179)..(179): n is a, c, t, g, unknown, or other
  misc_feature (181)..(181): n is a, c, t, g, unknown, or other
aaaaaaacaaagaaagaaaaawtcgagaggacgccagggccgattctctgcgtgayttggggcgtcgtcgcgagnttttctccggccgagggcggcgcgaccggacaaccagcgtgancgaccggcgacatgactcgcggcaaccagcgtgaccgcgaccgtgagcgcgcgtcggsggnanargcccaacgccaagaactcccaggacgggctcaccccggagcagcgccgcg

SEQ ID NO: 4659 - protein, 38 aa, Zea mays
  misc_feature: Ceres CLONE 304702-F
  misc_feature (8)..(8): Xaa is any aa, unknown, or other
  misc_feature (19)..(19): Xaa is any aa, unknown, or other
  misc_feature (25)..(25): Xaa is any aa, unknown, or other
KKTKKEKXERTPGPILCVXWGVVAXFSPAEGGATGQPA

SEQ ID NO: 4660 - DNA, 447 bp, Zea mays
  misc_feature: Ceres CLONE 304705-F
  misc_feature: Encodes the peptide sequence at SEQ ID NO. 4661
  misc_feature (169)..(169): n is a, c, t, g, unknown, or other
  misc_feature (318)..(318): n is a, c, t, g, unknown, or other
  misc_feature (346)..(346): n is a, c, t, g, unknown, or other
aaaaaaaatttcgaaacgagaggtgtctgcctgtcacttgcgaagaaatcgcgaggggaagcgtgacacctgacgagctgagcaggcaggcggtaktggccgagcgaaascatcctcgatctcgtatcgtagctgccgccgctcagagcaatggagagggcggtgccanttcggaaktbgcacaccaacacggccgaccttctctcctggtcggccacgggcctgacgcatctgcctcgccggccgcgtcctcccgccccagcctcaagccggccgcggggattacgccggcgatgttcggcgcgccggttcaccgancaggaggccgaggatctgagcaagagtnaaaggaaattttsctctggctcaaagttgaaagatatggggtgggagtgggatttttsctgagaagagtgaaaatggtgatccagaggcttcaaatcctgc

SEQ ID NO: 4661 - protein, 84 aa, Zea mays
  misc_feature: Ceres CLONE 304705-F
  misc_feature (7)..(7): Xaa is any aa, unknown, or other
  misc_feature (9)..(9): Xaa is any aa, unknown, or other
  misc_feature (10)..(10): Xaa is any aa, unknown, or other
  misc_feature (56)..(56): Xaa is any aa, unknown, or other
  misc_feature (66)..(66): Xaa is any aa, unknown, or other
  misc_feature (70)..(70): Xaa is any aa, unknown, or other
MERAVPXRXXHTNTADLLSWSATGLTHLPRRPRPPAPASSRPRGLRRRCSARRFTXQEAEDLSKSXRKFXSGSKLKDMGWEWDF

SEQ ID NO: 4662 - DNA, 399 bp, Zea mays
  misc_feature: Ceres CLONE 304732-F
  misc_feature: SWISSPROT Homolog: EC 2.7.11.1 Non-specific serine/threonine protein kinase
  misc_feature (32)..(32): n is a, c, t, g, unknown, or other
  misc_feature (33)..(33): n is a, c, t, g, unknown, or other
  misc_feature (210)..(210): n is a, c, t, g, unknown, or other
accatccccgttccccaacccccccaaagccnngagccatcccgcccgcagccgcaaccaggcaagcaagcgggagcgccaactcgtgcctctcggcagcggcgtctgaactctgaaccgaccgaccgttccgttcacccccaccatggaggcgccgccgagaccggggcccatggagctggacgccccacctcccgccgccgccgcganttcctcccgccggcagcgacaagcacaaggtggacggggaagggggagacgctgtgacgggccatatcatctccaccaccatcggcgggaagaacggcgagcccaagcgcaccatcagttacatggcagaacgtgtcgtgggtacaggctcatttgggatcgtcttccaggctaagtgtctggaaacag

SEQ ID NO: 4663 - DNA, 197 bp, Zea mays
  misc_feature: Ceres CLONE 304735-F
atcaccaatcagtcagtcacagctcacagcaaacaccgcgavcgcccccgctcccaaacccgaccgagcaaagcgcaaagccccccaaccgcggatcaatccgcagcatcgatggcgcccaaggggagaaawagccggcggcatagwwgcccgcggaggaggagcccgcgaccgataaggcggagaaggctccggca

SEQ ID NO: 4664 - DNA, 137 bp, Zea mays
  misc_feature: Ceres CLONE 304773-F
  misc_feature: Encodes the peptide sequence at SEQ ID NO. 4665
  misc_feature (91)..(91): n is a, c, t, g, unknown, or other
aaacaaagccgaggtaaagcagggagcatcttgagtgttcgacagtgagccatggagaagacgtccgagagcgccataccgccggcggcdnccccgctgatgctgttcgggtcgtgggcgagctcgtacacgcaccg

SEQ ID NO: 4665 - protein, 28 aa, Zea mays
  misc_feature: Ceres CLONE 304773-F
  misc_feature (14)..(14): Xaa is any aa, unknown, or other
MEKTSESAIPPAAXPLMLFGSWASSYTH

SEQ ID NO: 4666 - DNA, 1350 bp, Zea mays
  misc_feature: Ceres CLONE 304789
  misc_feature: Encodes the peptide sequence at SEQ ID NO. 4667
atcgattcttggcatcgccctctctctaaaccccaactcctcgactcgagcaatccctaggtctccgcgcgaggcggtggcggctgtgaggggattttgattgatttggctcgagatggcggaggacaaggtgcggcggatcttcgtcggcgggttgtcctggaagaccacggagcgcacgctcgagcgcaccttcggtcagtacggcaatgtcatcgaggcacaggttgtagtgaaaagggaaacaggccgctcgaggggatttggatttgtcacattctcagaacctcgggctgtggatgctgccattcgtggaatgcataatgcggaactggatggccgtaatatttctgtgaacaaagctcatcctaggattgctgacgatgactatggctatggtggtggtggtggtggtggttactcgtctggtgctagaggtggatatcgtagtggcggtgatgtagttccagcagtgagtgatgaatgtttcaaatgcggccattctggacatgatgtagttccagcagtgagtgatgaatgtttcaaatgcggccgttctggacattgggctcgtgaatgcccttattcagatggcagtggtagaactggaagatattctcccgcttcaaggtatggtggtggcgctgggggacgtggtgaccgcgttggaggatcagatcgttttgctcgctatgatgatgaccgatatgatggtggccggtctgtagacagcagggatacttattatggtgctgggcgagatcgttatgctagggatcgccatctgccagcaacagaccaccattctggtgacaggtacagtggtgcagatcgttacacgtccagtggctttgccatagaaaggagctatgagagagatggaggcaggtccactggaacttactaccgtgatgacccgaggggcactggtggctatggcagaggtggttcacgtggcggcggcggcgggcctgctcgctttggtgggagttaccgagataggcctgctccgtatgaccgtcctagcaggggcggggcagctcgtgcttatgatgatcgttactgaagaatgtttccttgaagtagaacagagatgttggtgtattttagttttgcatcagtatttgcacttgccagcttgatccttcaattctatgctattcagcagcgcagtttgttttagtggtctctgaagacaatggttcagtatgtcagttactatcagtatgttggtaccataatctgtaggcagtgatcctggtccatttgacatgtttgtgtaattgcttggagtctgcactaaataatgaactaatcgcagcatgtgatctttgaaaaaaaaaaaaaaaa

SEQ ID NO: 4667 - protein, 316 aa, Zea mays
  misc_feature: Ceres CLONE 304789
  misc_feature (9)..(80): Pfam Name: RRM_1 Pfam Description: RNA recognition motif. (a.k.a. RRM, RBD, or RNP domain)
  misc_feature (140)..(157): Pfam Name: zf-CCHC Pfam Description: Zinc knuckle
  misc_feature: SWISSPROT Homolog: EC 5.2.1.8 Peptidylprolyl isomerase
MAEDKVRRIFVGGLSWKTTERTLERTFGQYGNVIEAQVVVKRETGRSRGFGFVTFSEPRAVDAAIRGMHNAELDGRNISVNKAHPRIADDDYGYGGGGGGGYSSGARGGYRSGGDVVPAVSDECFKCGHSGHDVVPAVSDECFKCGRSGHWARECPYSDGSGRTGRYSPASRYGGGAGGRGDRVGGSDRFARYDDDRYDGGRSVDSRDTYYGAGRDRYARDRHLPATDHHSGDRYSGADRYTSSGFAIERSYERDGGRSTGTYYRDDPRGTGGYGRGGSRGGGGGPARFGGSYRDRPAPYDRPSRGGAARAYDDRY

SEQ ID NO: 4668 - DNA, 382 bp, Zea mays
  misc_feature: Ceres CLONE 304795-F
  misc_feature: Translation starting site: 118
  misc_feature (43)..(43): n is a, c, t, g, unknown, or other
  misc_feature (135)..(135): n is a, c, t, g, unknown, or other
aacatatgtaccctctcgcgcaaacactcctctttccgcgchncctcccctcccgcccacttgctccgccggcgcgccaccgcscgcaccgcagcagycagtcagcagatcgtaaccatggcggattctaagghngctgcggcgctgaccctccgcacgcgcaagttcatgascaaccgccttctctcccgcaagcagttcgtgctcgaggtcatccaccccggccgccccaacgtctccaaggcggastcaaggagaggctggcgaagatctacgaggtgaaggacccaaactgcatcttcgtcttcaagtttcggaccaacttcggaggcggcaagtccaccggcttcgggtctcatctacgacaaccttgaggccgcca

SEQ ID NO: 4669 - DNA, 465 bp, Zea mays
  misc_feature: Ceres CLONE 304876-F
  misc_feature: Encodes the peptide sequence at SEQ ID NO. 4670
  misc_feature (389)..(389): n is a, c, t, g, unknown, or other
  misc_feature (434)..(434): n is a, c, t, g, unknown, or other
atgcctctgccaacaaacaaagaacagacctatcgctacacagtccgccgtggctctctgcaattaatggctgcctccacagcgtcgtcgtcatactctgccggtgtaagcgccgcctgctgtgtgtctccgcgccatggcagcagcttcgtcaagccgcagcgctctggacggccggcggcggcggcggcgaccctacctgcgtcaggcggcgaccagcgaacctatcgttagactgctgtcgtaggagtaagagtagggctagaagaggcgagckaatcagggcttcagatgatgctgcgaccatcatggacgcgggcggctgggcagcacggcttgawgccccgccgccggtagccgtcgtcactggagcgtctagagggattggnagagcatagctgtagcacttggcggacagggtgcaaggtggttgnkaactatgccaagtyaggcgtggaggccgaa

SEQ ID NO: 4670 - protein, 131 aa, Zea mays
  misc_feature: Ceres CLONE 304876-F
  misc_feature (92)..(92): Xaa is any aa, unknown, or other
  misc_feature (113)..(113): Xaa is any aa, unknown, or other
ASANKQRTDLSLHSPPWLSAINGCLHSVVVILCRCKRRLLCVSAPWQQLRQAAALWTAGGGGGDPTCVRRRPANLSLDCCRRSKSRARRGEXIRASDDAATIMDAGGWAARLXAPPPVAVVTGASRGIGRA

SEQ ID NO: 4671 - DNA, 209 bp, Zea mays
  misc_feature: Ceres CLONE 304877-F
  misc_feature: Encodes the peptide sequence at SEQ ID NO. 4672
  misc_feature (125)..(125): n is a, c, t, g, unknown, or other
acaattcacagcgctcaagttctcgcgcccacagccaaatttttctccactcaatcgcggcataagctgcactgcmscatggacgccagcggascggtagcaaggcgaagaagggggcggctggncgcaaggbtggcggccccaggtagaagtcggtgtcgcggtccgtcaaggccgggctgcagttccccgtmggccggatcgggcgc

SEQ ID NO: 4672 - protein, 43 aa, Zea mays
  misc_feature: Ceres CLONE 304877-F
  misc_feature (6)..(6): Xaa is any aa, unknown, or other
  misc_feature (16)..(16): Xaa is any aa, unknown, or other
  misc_feature (19)..(19): Xaa is any aa, unknown, or other
  misc_feature (39)..(39): Xaa is any aa, unknown, or other
MDASGXVARRRRGRLXARXAAPGRSRCRGPSRPGCSSPXAGSG

SEQ ID NO: 4673 - DNA, 481 bp, Zea mays
  misc_feature: Ceres CLONE 304900-F
  misc_feature: Translation starting site: 77
  misc_feature (127)..(127): n is a, c, t, g, unknown, or other
  misc_feature (128)..(128): n is a, c, t, g, unknown, or other
  misc_feature (184)..(184): n is a, c, t, g, unknown, or other
atccaacccacacacaggctgaccccaccaacagcaagcgaaaatctcccgatcccctctagtctccgcggcgaagatgtcggggcgcggcaagggcgggaagggcctgggcaagggcggacggaanncaccggaaggkctccgcgacaacatccaggggatcacgaagccggcgatccggcgnctggcgcgcaggggcggcgtgaacsatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccac

SEQ ID NO: 4674 - DNA, 471 bp, Zea mays
  misc_feature: Ceres CLONE 304912-F
  misc_feature: Encodes the peptide sequence at SEQ ID NO. 4675
aggatgttcaccgagaaaccctagttcgaacgcgccgccatcaccgtcgtctctcgctcgttccctcgcgctctccgctcgtgagtactcccacggatcggagcgagagtaggggcgtgtcggcggtgaaagcgaccgcgtcascatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaaagctgtagaggaacaaggggaaggcattgtgctgggaagtgtcccttacatacccttgg

SEQ ID NO: 4675 - protein, 108 aa, Zea mays
  misc_feature: Ceres CLONE 304912-F
MADEEHSERREEASELAPFDPTKKKKKKKVVIQEPSDEVDKLAEKTETLAVAEPAELNFTGMKKKKKKPVDLDSTLDELGDGEDTQDDQSCRGTRGRHCAGKCPLHTL

SEQ ID NO: 4676 - DNA, 123 bp, Zea mays
  misc_feature: Ceres CLONE 304985-F
  misc_feature (111)..(111): n is a, c, t, g, unknown, or other
aacaacagcaacacatctgcttcgcatttyttcccatcccccttcgcaacccaaaccccaactcgctyvgcatcgatggcgcccaaggccgagaagaagcccgctggcganagaagccggcgg

SEQ ID NO: 4677 - DNA, 127 bp, Zea mays
  misc_feature: Ceres CLONE 305000-F
acacgcacaccgcgacccagtccagagccagtacgtgcgamrcacgcacgctgctggtccgcgtacbagacgacggtcaggtcggccggtgcttttyagtttggaataatgacggcgacgacgacga

SEQ ID NO: 4678 - DNA, 490 bp, Zea mays
  misc_feature: Ceres CLONE 305039-F
  misc_feature: Translation starting site: 126
  misc_feature (110)..(110): n is a, c, t, g, unknown, or other
atacccctccgtttcccacccttccctccccactccggcagtccccgtcccaccactacagccactgctgmcccggccggccgcgtccctcttcctccgccaggcgccangcccgcactccagcaatggcgtctgcctcgcacgccccgacgccgctgctcaaggacgagctggacatcgtcatcccgacgatccgcaacctcgacttcctggagatgtggaggcccttcttccagccctaccacctcatcatcgtgcaggacggcgaccccagcaagatcatccgcgtccccgagggcttcgactacgagctctacaaccgcaacgacatcaaccgcatgctktgggcccaaggctcctgcatctccttcaaggactccgcctgccttctgcttcggctacatggtctccaagaagaagtacatctacaccatcgacgatgactgcttcgttgccaaggatccattatggaaggacatcaatgcacttg

SEQ ID NO: 4679 - DNA, 1049 bp, Zea mays
  misc_feature: Ceres CLONE 305041
  misc_feature: Encodes the peptide sequence at SEQ ID NO. 4680
aattggcatccaagccatggcgtcgttcaagtgcatgtgcgtcttcttagtctcgcttatgctcgccctcatcgtcaataacgcccaggaagagcggacgctcccgccgttcccctgcatcccaggccagccacgacccccgtggctcccaccctgcccgccagcgccagmwgagtgctacacgtcggtgtcggggctgatgccgtgcgcggacttcctcacccacatcgggctgccaccggcaccacccacgaccgcctgctgcgacggtctcaggtcgctcgtcaccaacgcgcccatctgcatgtgccacgtcgtcaatggcgacatcaacaagctcctaccggcgcccatgatacccgtgcgcatggtggcgctcccccgcttgtgcgtcgtccccttcccacgagccacgattcgccagtgcatcagaggccatgtgccaccgatgaaccctccatctccaccaccgactccgtcaaaatcatcaccgccaaaatcaccaccgtsgactccacccgcggcatcaccaccagaaccaccagcagcatcgccaccggaaccaccatcgacgccaccatcggaatcaccgtcgactccaccaccgacaccaacggcgacgccaccggaatcaccaccctcgactccaccgccagaatcaccatctgatccaccaccagctacgccaccagaatcaccatctgatccaccaccagctacgccaccggaatcaccatccgatccaccaccaacaccaacagcaacgccaccaacgactccatctccatcatcctgatcaccataaatttttttaaaagcagcagcagtctagtcaaattagttttgcgttttaagattctatctgatagacgtcctatcatagctagtcaaattagatttggttcacatcaaatgcagcagtgtgttagctatgtagttgcatacctatcatagctgagtctattagaagcacatgtaataatattcaggaccagtcatctataaaatgtatgcaaagatgccattgtcgtgaaaaaaaaaaaaaaaaa

SEQ ID NO: 4680 - protein, 259 aa, Zea mays
  misc_feature: Ceres CLONE 305041
  misc_feature (52)..(52): Xaa is any aa, unknown, or other
  misc_feature (165)..(165): Xaa is any aa, unknown, or other
MASFKCMCVFLVSLMLALIVNNAQEERTLPPFPCIPGQPRPPWLPPCPPAPXECYTSVSGLMPCADFLTHIGLPPAPPTTACCDGLRSLVTNAPICMCHVVNGDINKLLPAPMIPVRMVALPRLCVVPFPRATIRQCIRGHVPPMNPPSPPPTPSKSSPPKSPPXTPPAASPPEPPAASPPEPPSTPPSESPSTPPPTPTATPPESPPSTPPPESPSDPPPATPPESPSDPPPATPPESPSDPPPTPTATPPTTPSPSS

SEQ ID NO: 4681 - DNA, 113 bp, Zea mays
  misc_feature: Ceres CLONE 305058-F
acacgcacaccgcgacccagtccagagccagtacgtgcgamrcacgcacgctgctggtccgcgtacsagacgacggtcaggtcggccggtgcttttcagtttggaataatgac

SEQ ID NO: 4682 - DNA, 433 bp, Zea mays
  misc_feature: Ceres CLONE 305120-F
  misc_feature: Encodes the peptide sequence at SEQ ID NO. 4683
  misc_feature (114)..(114): n is a, c, t, g, unknown, or other
  misc_feature (172)..(172): n is a, c, t, g, unknown, or other
  misc_feature (423)..(423): n is a, c, t, g, unknown, or other
aagttcctcagacgcaaagaagatcgagtctgcagcccacaccatagtgcgagcagattgcgtccaataggcgcaaagggagatkggggtggccgctggacgagcgcggccatngtggctgcggcggcggcggcggcggcggtgctgctgctgctcgcgggcggcgcgcacngtactgctacgacgactgcttcaargactgcatggccaagttcaagtccatgagagactactgcagctacgcgtgcgagaaggtctgcgatccggacgccacgctccaggccccctcgccgttgtggggccagcagcagcgtttgccgaccaccacccgtttggacaagaagcatggtgctgtctggccggcggcgttgccgaccatcctttccacgagacgcacggcgacgtcgagccggcagggagccngacccagcta

SEQ ID NO: 4683 - protein, 76 aa, Zea mays
  misc_feature: Ceres CLONE 305120-F
  misc_feature (74)..(74): Xaa is any aa, unknown, or other
MAKFKSMRDYCSYACEKVCDPDATLQAPSPLWGQQQRLPTTTRLDKKHGAVWPAALPTILSTRRTATSSRQGAXPS

SEQ ID NO: 4684 - DNA, 447 bp, Zea mays
  misc_feature: Ceres CLONE 305127-F
  misc_feature: SWISSPROT Homolog: EC 5.2.1.8 Peptidylprolyl isomerase
agaagactgcagcaaaaccatcagatctagcagaactctctcgacctcatcggcgttggcggasgcgtkttgaccggagatggcgccgagcgggtggaggaggagcgcggcgacgtcgtcgctggcgcccggccacgtttgcctgtggtcgcgctcgccgccgccgcactgacgctcgcccakgctawgawggacctgacggaggttwcccacaaggtctacttcgacatcgagatcgacggcaagcccgcagccggattgtcatggggctttttgggaagwctgttcctaagacggcatagaacttccgagctctttgcacargagasaaaggggtcggcaagagtggcawagcctccactacawgggaagtaagttccacakaatcatccccagcttcatgctccawggaggtgacttcactctcggggacgggmrgggtggtga

SEQ ID NO: 4685 - DNA, 326 bp, Zea mays
  misc_feature: Ceres CLONE 305140-F
  misc_feature: Encodes the peptide sequence at SEQ ID NO. 4686
  misc_feature (188)..(188): n is a, c, t, g, unknown, or other
caaatcgaaaaatggcgttgctgagcccgcgcgtgccgsgctgccgccctccaccttcacctccgttgccggtgcccggtgctttggccctgccgcgaggtgccaggcgacggcggcgggcggcgtggcggccgcggggccccgtcgtcggagctggaggccatccggtggggcagcgcaagcykagnggcgctcgckacgagatggaggatgatgtcttgctccgcccgggctccctcctcgatggcttctccttcgccgccgtcttggatggacacgccggcttctccgccgtccagttcctcagggatgagctgtacaaggag

SEQ ID NO: 4686 - protein, 105 aa, Zea mays
  misc_feature: Ceres CLONE 305140-F
  misc_feature: SWISSPROT Homolog: EC 3.1.3.16 Phosphoprotein phosphatase
  misc_feature (10)..(10): Xaa is any aa, unknown, or other
  misc_feature (58)..(58): Xaa is any aa, unknown, or other
  misc_feature (59)..(59): Xaa is any aa, unknown, or other
  misc_feature (63)..(63): Xaa is any aa, unknown, or other
MALLSPRVPXCRPPPSPPLPVPGALALPRGARRRRRAAWRPRGPVVGAGGHPVGQRKXXGARXEMEDDVLLRPGSLLDGFSFAAVLDGHAGFSAVQFLRDELYKE

SEQ ID NO: 4687 - DNA, 356 bp, Zea mays
  misc_feature: Ceres CLONE 305151-F
  misc_feature: Encodes the peptide sequence at SEQ ID NO. 4688
  misc_feature (13)..(13): n is a, c, t, g, unknown, or other
  misc_feature (227)..(227): n is a, c, t, g, unknown, or other
  misc_feature (235)..(235): n is a, c, t, g, unknown, or other
  misc_feature (333)..(333): n is a, c, t, g, unknown, or other
aaaagatcgcgangaagggaatgatggaggcataggcactagcacctcctcgcctccacctccgtcctcttcgatcccgtccaatcccccgcgccccggcgcccctctccgccggcggctttgctgggtcccgcgctcctcctcctcctaggctgttctggttaggggctgcggcggagggaactaggtaagggggaaggaaaggggaggtttgagggagagcgcmnccagcgcnagcagcgatgccatcgcacgcggatctggaccgccagatctcgcagctgcgggattgcaagttcctgcctgaggcggaggtcaaaacgctatgcgagncaggccaaggcgatcctcatgga

SEQ ID NO: 4688 - protein, 38 aa, Zea mays
  misc_feature: Ceres CLONE 305151-F
  misc_feature: SWISSPROT Homolog: EC 3.1.3.16 Phosphoprotein phosphatase
  misc_feature (31)..(31): Xaa is any aa, unknown, or other
MPSHADLDRQISQLRDCKFLPEAEVKTLCEXGQGDPHG

SEQ ID NO: 4689 - DNA, 857 bp, Zea mays
  misc_feature: Ceres CLONE 305152-R
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (55)..(55): n is a, c, t, g, unknown, or other
  misc_feature (74)..(74): n is a, c, t, g, unknown, or other
atttaaattttatanntnatagagaaaagggtaagttaataaactttctctatcncacacagaaagaaaaaaanggggattgttttttctaattgggtaccgggccccccctcgaggtctacagtatcgataagcttataagtgcgagccaactaaacctccaaatagcaggtacatatgtttccttaattacatctctgatcatgatttgagttgcaaggatataaatataccatctacttaatttaacacaaatgaagatacaggcctgaagcaactagatgatgcttgttaggtttttagtcaataggaacttcaacctccatcttgagctcagaattgccaataatcttcataaagtctgggagtgtaaaatgtgaatcttttgtgtatccagcttcttctaacacatgaatcaagactttctgtctctgttgctctgtcataaatgaacctgtcagatctcgcaagatgctcaagatgtcatcaaaagcaaccttcccgttgcagtcagtatcataaaccctgaaaataaattcaatctttttgctgcagggcttgtggcggggggctaaatagctcgacaaaaatgcctaacaaactcctttgaagttggaggcccaatccaggcattccctcagagaggccctcctggggagaagggggaattttaacggggggaaactccaaggggaaccgaacaatggaaatttcggttcgacccggtaagaacctaaagcccaccccaaaccggttttaactgggtccgaaagcctggggccgagaatagccgcggggggggttaacaaacccgaaattatccgaaatccttccccttggccgtgccctgaaagaaa

SEQ ID NO: 4690 - DNA, 437 bp, Zea mays
  misc_feature: Ceres CLONE 305209-F
  misc_feature: Translation starting site: 51
  misc_feature: SWISSPROT Homolog: EC 2.5.1.18 Glutathione transferase
  misc_feature (88)..(88): n is a, c, t, g, unknown, or other
  misc_feature (89)..(89): n is a, c, t, g, unknown, or other
  misc_feature (271)..(271): n is a, c, t, g, unknown, or other
  misc_feature (367)..(367): n is a, c, t, g, unknown, or other
aaaaaagccgaggtaaagcagggagcatcttgagtgttcgacagtgagccatggagaagacgtccgagagcgccataccgccggcggnnhccccgctgatgctgttcgggtcgtgggcgagctcgtacacgcaccgcgtcagctggcgctgcggctcaagggcctggagtacgactacgtggaggaggacctggggaacaagagcgacgagctgctgcgccacaaccccgtccacaagaaggtgcccgtgctcgtccacggcggccgcghntcccggagtccgtcattatcctccagtaccttgacgacgcctggccggagacccgcccgctgctccccgccgacgccttcgaccgcgcgctcgkbntcctgggtgccacttcgccgacgacaagctcgggccggcggtgggcgcgkgtgttcgcttcgacggggga

SEQ ID NO: 4691 - DNA, 260 bp, Zea mays
  misc_feature: Ceres CLONE 305259-F
  misc_feature (91)..(91): n is a, c, t, g, unknown, or other
acatctcctcacttcacaccactcccgccattgtcctgcgcctttctgcaccgccacacacaccccgctccaatccaatggcgcctcgcangccgtcctcgcggtcgtggtcctcgccgcgctgctcccgctcgccctctctcgcgggctgcggcttggccaccaccgcgcccagccgcaytccgaggccgcacggtcacgcaccgctcggaggtggcgcgtggtcctcgggccacgccaccttctacggcggcggcgac

SEQ ID NO: 4692 - DNA, 395 bp, Zea mays
  misc_feature: Ceres CLONE 305262-F
  misc_feature: Translation starting site: 124
  misc_feature (297)..(297): n is a, c, t, g, unknown, or other
  misc_feature (299)..(299): n is a, c, t, g, unknown, or other
gcaatccgtatcatcatcttggcctcgtcaatccaccaccaccgtcgtycgctgagctcctcctccggcttcgcttcgcttcgctgtcttgcctcctcctcggtcgaagaagaagaagaaaacatgtgtccgggatccgtggagtcgtcgtcggcggcggcggcgggcaagagcgtgtgcgtgatggacgccgcggggccgctgggccacgcctcgtgaccgcctcctccggcgcgggtacacagtccacgccgccacgtacgcccgckacggggaggagggcgcggctgccgcgtngncttcggccacctgtcgcgcgccgccgacgcgtgcaggcaccgggctgaagctgttccgcgccgacccgttcgaytaccacgccatcgccgacgccg

SEQ ID NO: 4693 - DNA, 393 bp, Zea mays
  misc_feature: Ceres CLONE 305264-F
  misc_feature: Encodes the peptide sequence at SEQ ID NO. 4694
  misc_feature (2)..(2): n is a, c, t, g, unknown, or other
  misc_feature (297)..(297): n is a, c, t, g, unknown, or other
anagagagggagagagagaaagawaagawaagawaagaagaaggggaggcccgcgtactgtagtggggagatgcctcggcatactgcgcccgckgscggccatcggagcgcggcgagatggacgaggtggtagaggcagatccggacacgaggcggaggatcaggaggagaggtgggcgacgctgctaccagagtttgctctccgacgtgttgctgcgcgtcgaggcctccggcgccgagcagtggccggcgcggaaggacatcgtctctttcgcctgcktgtgccgctggtggcgnaaggccgcagtctccgttktgcgtcctccggcggagtccgccaagatcaccttcccctcctcgctcaagcagccagggcctagggagatcccaatg

SEQ ID NO: 4694 - protein, 92 aa, Zea mays
  misc_feature: Ceres CLONE 305264-F
  misc_feature (55)..(55): Xaa is any aa, unknown, or other
  misc_feature (67)..(67): Xaa is any aa, unknown, or other
MDEVVEADPDTRRRIRRRGGRRCYQSLLSDVLLRVEASGAEQWPARKDIVSFACXCRWWRKAAVSVXRPPAESAKITFPSSLKQPGPREIPM

SEQ ID NO: 4695 - DNA, 489 bp, Zea mays
  misc_feature: Ceres CLONE 305281-F
  misc_feature: Translation starting site: 304
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaagccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctg

SEQ ID NO: 4696 - DNA, 466 bp, Zea mays
  misc_feature: Ceres CLONE 305287-F
  misc_feature: Translation starting site: 98
  misc_feature: SWISSPROT Homolog: EC 5.2.1.8 Peptidylprolyl isomerase
gctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaascatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtatgggtggtatrggaatggatgatttt

SEQ ID NO: 4697 - DNA, 212 bp, Zea mays
  misc_feature: Ceres CLONE 305304-F
acgccgctgctccaagaaaccaccgccgagcccaaccgcacaagcgcgckmvgcaggagagagagagagagagagaggcggggagcaaaacaatggaggggaaagaggaggacgtgcgcctgggcscaacaagttctcggagcgccacccatcgggacggcggcgcagggcstgacggacaaggactacaaggagccccccccggcgccgct

SEQ ID NO: 4698 - DNA, 476 bp, Zea mays
  misc_feature: Ceres CLONE 305308-F
  misc_feature: Encodes the peptide sequence at SEQ ID NO. 4699
aatcatcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctgtcatcacaccttctacaacgagctccgcgtggctcccgaggagcaccccgtcctcctcaccgaggcgcccctgaaccccaaggctaacagggagaagatgacccagatcat

SEQ ID NO: 4699 - protein, 79 aa, Zea mays
  misc_feature: Ceres CLONE 305308-F
  misc_feature: SWISSPROT Homolog: EC 2.7.10.2 Non-specific protein-tyrosine kinase
MVGMGQKDAYVGDEAQSKRGILTLKYPIEHGIVSNWDDMEKICHHTFYNELRVAPEEHPVLLTEAPLNPKANREKMTQI

SEQ ID NO: 4700 - DNA, 345 bp, Zea mays
  misc_feature: Ceres CLONE 305318-F
  misc_feature: Translation starting site: 35
  misc_feature: SWISSPROT Homolog: EC 2.5.1.18 Glutathione transferase
  misc_feature (73)..(73): n is a, c, t, g, unknown, or other
  misc_feature (74)..(74): n is a, c, t, g, unknown, or other
  misc_feature (253)..(253): n is a, c, t, g, unknown, or other
aaaaaaaagcatcttgagtgttcgacagcgagccatggagaagacgtccgagaacgccatcccgccggcggtnnccccgctgatgctgttcgggtcgtgggcgagctcgtacacgcaccggtcagctggcgctsggctcaagggcctggagtacgactacgtggaggaggacctggggaacaagagcgacgagctgctgcgccacaaccccgtccacaagaaggtgcccgtgctcgtccacggcggcmgctwntcccggagtccgtcattatcctccagtaccttgacgacgcctggccggagacccgcccgctgctccccgccgacgccttcgaccgcgcgctc

SEQ ID NO: 4701 - DNA, 492 bp, Zea mays
  misc_feature: Ceres CLONE 305319-F
actcatctcatcctcatcccctacccgatcggatcccctgctcatccgccgagcaccaccaggcagcaggctccagtcgtcgagcaccagcaggagcacggcgcgccgcccagtaggagcacggccaggaggacgacgcccgcatcctgcctcttctcctctgctactggagcctctactgctaggagcacggctaggaggacgacgcccgcatccagcaggagcaccagcaggaggagaacacccatgctgctgccgttgagcgatgatctgatgcgcccccatcatggctcttctcctccctcgcggcctcgcctcgatctgctgctgccggatccgagcgccgtgcccacgggtcacggccagcgatatgcagggatcaagaatccaactttgagaaaatttgctcgagatgtaaatggcgccaccggagtaccagcagtacctcgtgtaggtgaccaagtaccaggccgcacagaactgcaaggtacg

SEQ ID NO: 4702 - DNA, 418 bp, Zea mays
  misc_feature: Ceres CLONE 305320-F
  misc_feature: Encodes the peptide sequence at SEQ ID NO. 4703
  misc_feature (307)..(307): n is a, c, t, g, unknown, or other
  misc_feature (308)..(308): n is a, c, t, g, unknown, or other
acacgagaaggccagggagacgtcttgcttctccttcgctcgtctacctgcttcctagttgttccatcatccatggcgcgcttcgcctccgctgtcctcttcgccgctgtcctgctcatggctggacggctgacccatgcggggccgtcgacggcgaggtgctttggcggcgcgcagtcctgccgggctccgcgtgccgaacgccgtcctccggctcctacgcccctatagccacttcgtaagcgaacgcaatkccgaggwbvccgggcgatccaacgctccgttcaactaccaataactacaagynnwmctctgcgactgckacctcacctccaggtgaccgcagtgaagcagggctcgctggtggcagcggcgcgagagatgacacgccgttcagctacagctacagggcgccgag

SEQ ID NO: 4703 - protein, 79 aa, Zea mays; identical to SEQ ID NO: 3989
  misc_feature: Ceres CLONE 305320-F

SEQ ID NO: 4704 - DNA, 508 bp, Zea mays
  misc_feature: Ceres CLONE 305351-F
  misc_feature: Encodes the peptide sequence at SEQ ID NO. 4705
cccgttcacttctctttggcccgaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaaactcaagaggctaaggatgcttcagagtccatttcaatcctttaccgtgtcattcaggacccatcttcttctgctgatgcactgagaacaaaagaagttgcaattacaaatcttacaaactacctcactaaagaaaacagagctgaggagctgcgtaatcttttgacccagctcagaccattttttgcagttattcctaaggcaaagactgcaaaaattgtccgtggaataattgatgctgtcgccaagatacctgggaacatcagatcttca

SEQ ID NO: 4705 - protein, 110 aa, Zea mays
  misc_feature: Ceres CLONE 305351-F
MSSSMESSYLPATTESLAQTQEAKDASESISILYRVIQDPSSSADALRTKEVAITNLTNYLTKENRAEELRNLLTQLRPFFAVIPKAKTAKIVRGIIDAVAKIPGNIRSS

SEQ ID NO: 4706 - DNA, 463 bp, Zea mays
  misc_feature: Ceres CLONE 305358-F
  misc_feature: Encodes the peptide sequence at SEQ ID NO. 4707
aacccatttcgctaatctccctccacgagccgaccaaatcgaatcgaatcgcgcgcvvccggcgcasattgccggcgatggcgagcctcaccctgccgccggcgccccccaacccacggcaggacgccatcgacctccaaaaggccttcaaagggtttggctgtgacagtacaacagtgataaacatacttactcatcgcgattcagtgcagcgtggactcattcaacaggaatacagggctatgtatcatgaggaactctcccatcgcatttcatctgaactcaatggaaaccacaagawagctttgctgtggattcttgatcctgctggacgtgatgcaactgttttgagagaagctctaagtgttgacactatggatctgagagcagccactgatattatatgttccaggacgccatcacagttgcaaataatgaaacagacttattatgctagatttgg

SEQ ID NO: 4707 - protein, 128 aa, Zea mays
  misc_feature: Ceres CLONE 305358-F
  misc_feature (15)..(80): Pfam Name: Annexin Pfam Description: Annexin
  misc_feature (75)..(75): Xaa is any aa, unknown, or other
MASLTLPPAPPNPRQDAIDLQKAFKGFGCDSTTVINILTHRDSVQRGLIQQEYRAMYHEELSHRISSELNGNHKXALLWILDPAGRDATVLREALSVDTMDLRAATDIICSRTPSQLQIMKQTYYARF

SEQ ID NO: 4708 - DNA, 471 bp, Zea mays
  misc_feature: Ceres CLONE 305381-F
  misc_feature: Translation starting site: 319
  misc_feature (195)..(195): n is a, c, t, g, unknown, or other
  misc_feature (197)..(197): n is a, c, t, g, unknown, or other
  misc_feature (198)..(198): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcantnntgtcatgcaggactacgtcgtcgacggcttcatgaagaacaccaactgtgacgacccggagctcaaggagaagctcaccagactctgcaagacgacgaccgtgagactcggtacgtggtgatgtcggatgakatcctcaagaactacccggagctggcgcaggaggggctgccgacgatgaatcagcgtctggacatctcgaacgcggcggtgacsagatggcgacggaggcgtccctgtygtgcgtccgctcgttgggcggcgcgctctcgt

SEQ ID NO: 4709 - DNA, 448 bp, Zea mays
  misc_feature: Ceres CLONE 305417-F
  misc_feature: Encodes the peptide sequence at SEQ ID NO. 4710
  misc_feature (59)..(59): n is a, c, t, g, unknown, or other
  misc_feature (189)..(189): n is a, c, t, g, unknown, or other
acacatttttacccctcgcggcggccccaccgaccgccggggcgcacggcgttcgccgnggcaacgcgttcacgtcacgtgcatcacgacaatctcctcctccgcctcgtcttcctgccaggccgcgggagcaccagcccagcggcagatcagtcgacgcgggcgattccagggtttagagaggagcgnagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcawagtttgaacccgtcacgttatgtgcaagtgtccaagcagtaccccaatagtccacgakctgatggwacatgawaccaacatcagggtc

SEQ ID NO: 4710 - protein, 72 aa, Zea mays
  misc_feature: Ceres CLONE 305417-F
  misc_feature: SWISSPROT Homolog: EC 3.5.3.12 Agmatine deiminase
  misc_feature (57)..(57): Xaa is any aa, unknown, or other
MVKVIQGRPAEMGFRMPAEWEPHEQCWMGWPERPDNWRENAGPAQEVFARTAIAISXFEPVTLCASVQAVPQ

SEQ ID NO: 4711 - DNA, 1238 bp, Zea mays
  misc_feature: Ceres CLONE 305454
  misc_feature: Encodes the peptide sequence at SEQ ID NO. 4712
gtcctctcttcttccaccaccacctcctactccgctgcaaccccaaatctctccttcctcgcatacgcgcgcagcgraggagctgagaccaacgaagaagaagaagaacaaccgagcaagcacaagcttagctagcgtgtaggtgtccaaggcgacgacggccgccgcgccaggctagccaaccagctgctcatcgctcctagctgcggasccgatatggctggcgccgacgtcgacgtcgggacggagctccgtctcggcctgccgggaggaggcgccgatgcggccaaggctgccaagaggggcttcgaggacaccatcgacctcaagctgaagctgcccaccgccggcatggaggaagctgccgccgccgccgccgccgccgccaagcccgagccggcagccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagctacacggagctctccgttgctctgaagaagatgttcagcaccttcaccacatccgggaacaacatgaatgagggaaaactggttgatccggtcagcggtgctgatgtggtcactacttacgaagacaaggatggcgactggatgctcgttggcgacgtcccgtgggagatgtttgtcgagtcatgcaggcgtctgaggatcatgaagagttctgaagccataggtcttgcaccaagaacgaaggacaagtgcaagaacaggagctgaagaagatacagcgttaaagacgctgcccattgtgtcaaaagaatggtgcccttgcagtgtgctgcggtttttctagaaatataatgcgttttaattactagttggagggagacctgtcttgttcaatttgttcatggaccagaagcaataatctatctgtgtgtagctggattggtgttatgcgatgtcccctaccgtgtcccagaatctacttggtgattttatcccagtgttgttaatcaagcttgtgtgattgttaagtaaagggcatcaatgagactattacaaaaaaaaaaaaaaaa

SEQ ID NO: 4712 - protein, 239 aa, Zea mays
  misc_feature: Ceres CLONE 305454
  misc_feature (10)..(231): Pfam Name: AUX_IAA Pfam Description: AUX/IAA family
  misc_feature: The sequence is a functional homolog of SEQ ID NO 739 in the 10/374,780 US patent application
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 890 in the 10/412,699 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 667 in the 11/479,226 US patent application
MAGADVDVGTELRLGLPGGGADAAKAAKRGFEDTIDLKLKLPTAGMEEAAAAAAAAAKPEPAAEKAKRPAEAPAADAEKPPAPKAQAVGWPPVRSYRRNVMTVQSVKSKKEEEPEKQQSAANAGGNGSAFVKVSMDGAPYLRKVDLKMYNSYTELSVALKKMFSTFTTSGNNMNEGKLVDPVSGADVVTTYEDKDGDWMLVGDVPWEMFVESCRRLRIMKSSEAIGLAPRTKDKCKNRS

SEQ ID NO: 4713 - DNA, 414 bp, Zea mays
  misc_feature: Ceres CLONE 305455-F
  misc_feature: Encodes the peptide sequence at SEQ ID NO. 4714
  misc_feature (144)..(144): n is a, c, t, g, unknown, or other
  misc_feature (177)..(177): n is a, c, t, g, unknown, or other
  misc_feature (269)..(269): n is a, c, t, g, unknown, or other
atccagtcgcacctccgtctccgaaatcaaggtagcatacaccgctgcagtttctagagccctctctgccactcgtgatcccactagtcacgatgcctgccctcgccaagcccgcctcccgcaccgccaagcccgccgcggcdnmgaagccgaagcctgccgccgccaagccgamsnccaccgctggtgcctcccacccgccttactttgagatgatcaaggaggctatcacggcgctaaaggagaggaccggctccagctcgcaagcnatcgccaagtatgtgggggacaagcacggcgcgtctctgccggccaacttcaagaagatgctttccatccagctccgtgggtccgcagccaagggcaagctcgttaaggtcaaggcctcgtacaakctatcggacgccgccaaga

SEQ ID NO: 4714 - protein, 107 aa, Zea mays
  misc_feature: Ceres CLONE 305455-F
  misc_feature (34)..(104): Pfam Name: Linker_histone Pfam Description: linker histone H1 and H5 family
  misc_feature (18)..(18): Xaa is any aa, unknown, or other
  misc_feature (28)..(28): Xaa is any aa, unknown, or other
  misc_feature (29)..(29): Xaa is any aa, unknown, or other
  misc_feature (101)..(101): Xaa is any aa, unknown, or other
MPALAKPASRTAKPAAAXKPKPAAAKPXXTAGASHPPYFEMIKEAITALKERTGSSSQAIAKYVGDKHGASLPANFKKMLSIQLRGSAAKGKLVKVKASYXLSDAAK

SEQ ID NO: 4715 - DNA, 250 bp, Zea mays
  misc_feature: Ceres CLONE 305474-F
  misc_feature: Encodes the peptide sequence at SEQ ID NO. 4716
  misc_feature (38)..(38): n is a, c, t, g, unknown, or other
  misc_feature (39)..(39): n is a, c, t, g, unknown, or other
atcatcacacccaacgcaacagcagcaaacgcgcagannaaatcactgatacaatggccatcaggggcagcatcggcttcgcagtgctctgstcgcgctgatgctgcacgccgcggsacggcggcgkcggccaggaccgtgcctatgcmgggcgcctcctcracgtccaccggcagcaccgcgtcgctcccggccgcggcggcaaccaagaacgacgactctggctcgggcggcgcggcgtggcggacaa

SEQ ID NO: 4716 - protein, 83 aa, Zea mays
  misc_feature: Ceres CLONE 305474-F
  misc_feature (13)..(13): Xaa is any aa, unknown, or other
  misc_feature (31)..(31): Xaa is any aa, unknown, or other
  misc_feature (43)..(43): Xaa is any aa, unknown, or other
  misc_feature (50)..(50): Xaa is any aa, unknown, or other
IITPNATAANAQXKSLIQWPSGAASASQCSXRADAARRGTAAXARTVPMXGASSTSTGSTASLPAAAATKNDDSGSGGAAWRT

SEQ ID NO: 4717 - DNA, 102 bp, Zea mays
  misc_feature: Ceres CLONE 305548-F
acacgcacaccgcgacccagtccagagccagtacgtgcgamggcacgcacgctgctggtccgcgtacsagacgacggtcaggtcggccggtgcttttcagtt

SEQ ID NO: 4718 - DNA, 124 bp, Zea mays
  misc_feature: Ceres CLONE 305560-F
acacgcacaccgcgacccagtccagagccagtacgtgcgamrgcacgcacgctgctggtccgcgtacbaggacgacggtcaggtcggccggtgcttttcagtttggaataatgacggcgacgac

SEQ ID NO: 4719 - DNA, 519 bp, Zea mays
  misc_feature: Ceres CLONE 305567-F
  misc_feature: Encodes the peptide sequence at SEQ ID NO. 4720
  misc_feature (425)..(425): n is a, c, t, g, unknown, or other
  misc_feature (459)..(459): n is a, c, t, g, unknown, or other
  misc_feature (468)..(468): n is a, c, t, g, unknown, or other
  misc_feature (511)..(511): n is a, c, t, g, unknown, or other
cgttcacttctctttggcccgaaaccgagagctagtgcttgattcggtcgtttttgggcacgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccatttcaatcctttaccgtgtcattcaggacccatcttcttctgctgatgcactgagaacaaaagaagttgcaattacaaatyttacaaactacctcactaaagataacagagctgaggagctgcgtaatctttttgatcccagctcagaccattttttgcagntattcctaaggcaaagactgcaaaaattgtycgnggaataatnkatgctgtcgccaagatacctggwacatcagatcytcagatgnyactctgc

SEQ ID NO: 4720 - protein, 96 aa, Zea mays
  misc_feature: Ceres CLONE 305567-F
  misc_feature (57)..(57): Xaa is any aa, unknown, or other
  misc_feature (84)..(84): Xaa is any aa, unknown, or other
  misc_feature (94)..(94): Xaa is any aa, unknown, or other
  misc_feature (95)..(95): Xaa is any aa, unknown, or other
MSSSMESSYLPATTESLAQAQEAKDASESISILYRVIQDPSSSADALRTKEVAITNXTNYLTKDNRAEELRNLFDPSSDHFLQXFLRQRLQKLXXE

SEQ ID NO: 4721 - DNA, 490 bp, Zea mays
  misc_feature: Ceres CLONE 305595-F
  misc_feature: Translation starting site: 131
  misc_feature (48)..(48): n is a, c, t, g, unknown, or other
  misc_feature (281)..(281): n is a, c, t, g, unknown, or other
  misc_feature (354)..(354): n is a, c, t, g, unknown, or other
gagctgagtccccttcccttctctcgtcgcctccgcctccgccttcanhttagcctccaagcaggggcgccgcgcggggtattctgtccgtcgttgaggatagagagtcacttgcaccgggggagcggagatgaagccggttgttggggatcgtggtgtcgaacaagatgcagaagtcggtggtggtttcagtggaccgctctcttccacaacaaggtatacwaccgctacgtcaagcgcacctcctaagttcatggcacacgacgatgacaacacctgcnacattkgcgaccggkttaggctggatccttctaggcccttkakcagacaagcactgggttgttgctgawattntccgcagagctaaggtgtacgttccaccagctgcwacakcgtccagtgaacgtgkgtagcaaatytyaacaagctggtggtgctaccawatgatccatctkawgttactcagaacaagatgcagtcacggcttgtt

SEQ ID NO: 4722 - DNA, 477 bp, Zea mays
  misc_feature: Ceres CLONE 305639-F
  misc_feature: Encodes the peptide sequence at SEQ ID NO. 4723
cccgagaaaaggaagacagagaaggaaactgcagtgaagtcgccggcgccgscgacagggaggaaggagcagcagcgcaggggaggcccggcgatctcttctgccgcgtgcsgagggagtaaaaggagccgcgacaggatgcactcctttgggcaccgcgccaacgcgtggtcaacgttcgcggtcaccatactggccgcgatttgcttcgccgcctccttctccgacaacttcaacaccccaacacccactgcctccgttaagatcttgaatctaaactggttccagaaggaggccaacggcaacgacgaggttagcatgacgctgaacatttcggccgacctttcgtctcttttcacgtggaacacaaaacaggtgtttgtttttgtggcagcagagtatgagactccacagaatgctttgaatcaagtttccctttggatggcattatacctgcaaagagcatgccaagttttt

SEQ ID NO: 4723 - protein, 113 aa, Zea mays
  misc_feature: Ceres CLONE 305639-F
  misc_feature (1)..(112): Pfam Name: SPC22 Pfam Description: Signal peptidase subunit
MHSFGHRANAWSTFAVTILAAICFAASFSDNFNTPTPTASVKILNLNWFQKEANGNDEVSMTLNISADLSSLFTWNTKQVFVFVAAEYETPQNALNQVSLWMALYLQRACQVF

SEQ ID NO: 4724 - DNA, 475 bp, Zea mays
  misc_feature: Ceres CLONE 305694-F
  misc_feature: Encodes the peptide sequence at SEQ ID NO. 4725
  misc_feature (45)..(45): n is a, c, t, g, unknown, or other
  misc_feature (46)..(46): n is a, c, t, g, unknown, or other
acaccgccactcgcccacacgcgaaggcacctagcagccgccacnnccgaactgaggaacacgcctggcgacgggatacagcagcagcgcgcccctctatccccgacgcgacggcgccctgcagctgcagataaacctgttccaatgggcaaacaaaaagagggtgtggacaaaagaactgctaggaagatgatccgatctacggaaggctgtgcaaagagcattactttcgagaggaacaacaaatcagacgatgtgcagcttcacgatctgccgaatgacatcctaggtagcatactatcacggttgacattcagagaatcctcacagatgggccttgtttctcatacctggcggtcgctgtggagaagctgttgccggaaactggtcttcaccagtgccaccatgttccaacccggaaataggagcatcaaacatacaaggaccaactttgccatgagagtcaacagtttct

SEQ ID NO: 4725 - protein, 110 aa, Zea mays
  misc_feature: Ceres CLONE 305694-F
  misc_feature (38)..(85): Pfam Name: F-box Pfam Description: F-box domain
MGKQKEGVDKRTARKMIRSTEGCAKSITFERNNKSDDVQLHDLPNDILGSILSRLTFRESSQMGLVSHTWRSLWRSCCRKLVFTSATMFQPGNRSIKHTRTNFAMRVNSF

SEQ ID NO: 4726 - DNA, 489 bp, Zea mays
  misc_feature: Ceres CLONE 305716-F
  misc_feature: Encodes the peptide sequence at SEQ ID NO. 4727
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcakntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagatggcgacggaggcgtccctgtygttgcgtccgctcgtkgggcggcgcgctctcgtccatcacccacctcgtgt

SEQ ID NO: 4727 - protein, 96 aa, Zea mays
  misc_feature: Ceres CLONE 305716-F
  misc_feature: SWISSPROT Homolog: EC 2.3.1.74 Naringenin-chalcone synthase
  misc_feature (80)..(80): Xaa is any aa, unknown, or other
  misc_feature (85)..(85): Xaa is any aa, unknown, or other
MQDYVVDGFMKNTNCDDPELKEKLTRLCKTTTVRTRYVVMSDEILKNYPELAQEGLPTMNQRLDISNAAVTRWRRRRPCXCVRSXGGALSSITHLV

SEQ ID NO: 4728 - DNA, 405 bp, Zea mays
  misc_feature: Ceres CLONE 305722-F
  misc_feature (149)..(149): n is a, c, t, g, unknown, or other
  misc_feature (347)..(347): n is a, c, t, g, unknown, or other
actcatcgtcacaacgcgtcctcgaataawaatccagacgaaacccaaaatccccaccgaacgcaacctaaaatctccccatccctcctcgatccagccccgcgagaagagccatggccgattccgcaaccaacgacgcccccctggdnccagcaaccagcccacggaggaggaggtgacggtggagagggccgcggcgacggakgacaggaggaggagaggctgcggtacctcgagttcgtgcagcaggcggcggcgcaggcgctggtgctggcggccgcggcgtacsstacgcaagcagggcgccggcccgctccgccccggggtcgatcaggtcgagggcackngaaggccgtcgtcggcccgtctacgaccgtttccacgccgtcccgctcgayctcctca

SEQ ID NO: 4729 - DNA, 185 bp, Zea mays
  misc_feature: Ceres CLONE 305734-F
aatcaaagaccagaaagctcaaaccaagaccggcgtgcgcggacgaagcacagatccatcggagtgacagcgagcgagcgagavggagmrgagagacagagagattatccgcgcgtcaccgactcccggcgaagacgatggggaaggggttcgcatcctacctggcgatgaagacggggccggag

SEQ ID NO: 4730 - DNA, 449 bp, Zea mays
  misc_feature: Ceres CLONE 305745-F2
  misc_feature: SWISSPROT Homolog: EC 1.6.5.5 NADPH:quinone reductase
  misc_feature (203)..(203): n is a, c, t, g, unknown, or other
awatatagggtggggcaagcaaggcaggcggacggggcaagggcaagcgagggatgagaatgagggccgtggtgatcacgtgcgccggcgggccggagtgctggaggcgcgggaggtggaggaccatcccgcgctaggcgaaggagaggtgctcctcgaggtcgccgccgcgggcgtcaatcgcgcggacaccgtgcagcgantgggccggtacccgccgcctgccggscgtccccttacccggggctcgagtgctccggcaccatcctcgcgctcggccccaacgtcccctcccgctgggccgtgggcgataaggtttgckcgctcctcagcggcggcgggtacgcggataaggtggtggcgccggcggggcagctgctgccgatacccgatggggtgtcgctgacgcacgcaccggcttgccgatgtggcctgcaccgtctggtcaa

SEQ ID NO: 4731 - DNA, 449 bp, Zea mays; identical to SEQ ID NO: 4730
  misc_feature: Ceres CLONE 305745-F
  misc_feature: Encodes the peptide sequence at SEQ ID NO. 4732
  misc_feature (203)..(203): n is a, c, t, g, unknown, or other

SEQ ID NO: 4732 - protein, 133 aa, Zea mays
  misc_feature: Ceres CLONE 305745-F
  misc_feature (67)..(67): Xaa is any aa, unknown, or other
IGWGKQGRRTGQGQARDENEGRGDHVRRRAGVLEAREVEDHPALGEGEVLLEVAAAGVNRADTVQRXGRYPPPAGRPLTRGSSAPAPSSRSAPTSPPAGPWAIRFARSSAAAGTRIRWWRRRGSCCRYPMGCR

SEQ ID NO: 4733 - DNA, 826 bp, Zea mays
  misc_feature: Ceres CLONE 305782-R
  misc_feature (84)..(84): n is a, c, t, g, unknown, or other
  misc_feature (88)..(88): n is a, c, t, g, unknown, or other
  misc_feature (119)..(119): n is a, c, t, g, unknown, or other
  misc_feature (573)..(573): n is a, c, t, g, unknown, or other
ggggttttgtttttttggtgggtgagtgggttgtgctgcggctacgagcgagtgcgagaagacagacacaggggaggagtgttntttnttttccgaatggggtacggggccccccctcnaggtcgacggtatcgataagcttttttttttttttttttgatcccaaaaaaagacaatagtttgatacacaatcacacaaagtacaagtggaatttgaggagacaccgcatgcatatacaggcatgcaacgagaatagccaaacaaatgaaggaatgcacttgctgaacagaccggcggcgcgcgggcagctaccacccaaatccgtcgactagccttttcaaactttgcatcgggagggtaaaaggagaccttttgctgagcacccgtgccgtgcggaaatggaaatggaatgggatggaagcatccaagtgcatttatatcctggccggaccgctcacccccactggactagcacctctagcccgatgggcacgtatactgatatgacgaagcaccttgacgctctgatggcggttgcaaaggcagcgccgtccgcgcgagatgccccgccnaatgccctctcacgaggcggtgcagccacgtgggaccgttgggccgtcccccgaaaaggtggagcctgcgcctgcccggagaaaccggcccacgcgaggaaggccagagccttggattcccccgtcccactggggggcaaactatgtcccaaaggaaccggcccttgcgtgcccatgaaactggtccgggccctcccaggggtgcaaaaacgggaaggcccggccctgggggtaaccgccccttttccgcggg

SEQ ID NO: 4734 - DNA, 156 bp, Zea mays
  misc_feature: Ceres CLONE 305785-F
tttttttttcagggccttgaaatctcgccctcgttgcggtcgtccacatccttttctctcctcctcgccggcccaacctgattgttcttcaaccaagaggaagaaaggaaggaagggaccggaagcatcagccatgtcgaactcggcgtcgggaat

SEQ ID NO: 4735 - DNA, 252 bp, Zea mays
  misc_feature: Ceres CLONE 305825-F
  misc_feature (181)..(181): n is a, c, t, g, unknown, or other
aaatcgaaacaaagaaagaaaaaatcgagaggacgccagggccgattctctgcgtgacttggggcgtcgtcgcgagttttctcctgccgagggcggcgcgaccggacaaccagcgtgasgcggaccggcgacatgactcgcggcaaccagcgtgaccgcgaccgtgagcgcgcggcggcgnaagcccaacgccaagaactcccaggacgggctcaccccggagcagcgccgcgatgagggacaagaaagctc

SEQ ID NO: 4736 - DNA, 389 bp, Zea mays
  misc_feature: Ceres CLONE 305837-F
  misc_feature: Encodes the peptide sequence at SEQ ID NO. 4737
  misc_feature (195)..(195): n is a, c, t, g, unknown, or other
  misc_feature (205)..(205): n is a, c, t, g, unknown, or other
  misc_feature (342)..(342): n is a, c, t, g, unknown, or other
  misc_feature (381)..(381): n is a, c, t, g, unknown, or other
accagacagacagaggagaggagaaagggcaaaaggcaacaccgcccgcgacgaccacgatggcagcctcgctccaagtccaagccgcggccaccttgatgcaaccggccaagatcggcggccgggcgcstccgcctcgctgccgtcgtcccgcccgtcgtcgcaactcgccagggcgttcggcgtcgacgcggncgccgcsggnatcacgtgctccctccagtccgacgtcagggacgtcccagcaagtgcgtcgacgccgccaagctcgccggcttcgcgctcgccacctcggcgctcctcgtctcgggcgcgacgcgktatggcacgcccaagaggctnacctacgacgagatccagagcaagacgtacctggaggtnaagggcac

SEQ ID NO: 4737 - protein, 129 aa, Zea mays
  misc_feature: Ceres CLONE 305837-F
  misc_feature (65)..(65): Xaa is any aa, unknown, or other
  misc_feature (107)..(107): Xaa is any aa, unknown, or other
  misc_feature (114)..(114): Xaa is any aa, unknown, or other
  misc_feature (127)..(127): Xaa is any aa, unknown, or other
PDRQRRGERAKGNTARDDHDGSLAPSPSRGHLDATGQDRRPGASASLPSSRPSSQLARAFGVDAXAAGITCSLQSDVRDVPASASTPPSSPASRSPPRRSSSRARRXMARPRGXPTTRSRARRTWRXRA

SEQ ID NO: 4738 - DNA, 174 bp, Zea mays
  misc_feature: Ceres CLONE 305840-F
gtttttctagacccccggatcgctcagagattgagtcgtagtcgtacccgactagtcgcmgcgtcbdcctttccccgcgcaagcagagcaccacccggtgaycgagcaatggaggcggggggcgtgggcctggcgctgcagacgcgggcggcggccttcggtccggccagcgcc

SEQ ID NO: 4739 - DNA, 523 bp, Zea mays
  misc_feature: Ceres CLONE 305855-F
  misc_feature: Encodes the peptide sequence at SEQ ID NO. 4740
  misc_feature (190)..(190): n is a, c, t, g, unknown, or other
ctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcansktgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacsagaatggcgacggaggcgtccctgtcgtgcgtccgctcgtggggcggcgcgctctcgtccatcacccacctcgtgtacgtctcgtcgagcgaggcgcgcttcccggggcggcga

SEQ ID NO: 4740 - protein, 148 aa, Zea mays
  misc_feature: Ceres CLONE 305855-F
  misc_feature (10)..(146): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
  misc_feature (38)..(38): Xaa is any aa, unknown, or other
MVSSSMDTTSDKRASSMLAPNPGKATILALGHAFPQXXVMQDYVVDGFMKNTNCDDPELKEKLTRLCKTTTVRTRYVVMSDEILKNYPELAQEGLPTMNQRLDISNAAVTRMATEASLSCVRSWGGALSSITHLVYVSSSEARFPGRR

SEQ ID NO: 4741 - DNA, 474 bp, Zea mays
  misc_feature: Ceres CLONE 305866-F
  misc_feature: Encodes the peptide sequence at SEQ ID NO. 4742
ggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtgtaggtgcctacattaagtacatccgccctcaggatgctggatgggatgccaaggagtttgataattgagactccatacactattatgtttggtcagataaatgt

SEQ ID NO: 4742 - protein, 125 aa, Zea mays
  misc_feature: Ceres CLONE 305866-F
  misc_feature (24)..(125): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECVGAYIKYIRPQDAGWDAKEFDN

SEQ ID NO: 4743 - DNA, 489 bp, Zea mays
  misc_feature: Ceres CLONE 305870-F
  misc_feature: Translation starting site: 162
aytccaaagccaacaaacagagctccaactctgaaagcatccgtcccttggcagcagcaacaagctactagctatgtgtgtttagagcgagcgagggaaaaawagaaaacatctaagatatactccatcatcttcgtttgattaacccgcccagtaaagccatgggtactaatgatagagcggtcatttctctagtactcctcgtgtgcatcgcaagccgctcgtccttgggtgccgctgaaactgacgttgagcagaagcgcttgtyagtcccgttgatgtttgtgttcggtgattcgctggtcgatgtcggaaacaataacttcctgccgctcctgcaccccgtgctgcatctccgtacggcatccgacttcccttctggcacccccggcgccgtctcaggacgttcacgaatggctacaaccttgccgatttagtcgcgcgacgtctggggttcaagatgagtccacctgcttacctctcgttgac

SEQ ID NO: 4744 - DNA, 469 bp, Zea mays
  misc_feature: Ceres CLONE 305872-F
  misc_feature: Translation starting site: 79
ctacggccgccgccagcatcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagaggacaggaagaaggtcaagaacatcaagcacagcgtcaacatcagcctcgacgacgtcatcgagatcgccaagaccatgcggaacaggtccatggccaaggagttggccgggaccgtcaa

SEQ ID NO: 4745 - DNA, 473 bp, Zea mays
  misc_feature: Ceres CLONE 305880-F
  misc_feature: Encodes the peptide sequence at SEQ ID NO. 4746
  misc_feature (152)..(152): n is a, c, t, g, unknown, or other
  misc_feature (347)..(347): n is a, c, t, g, unknown, or other
gactaataacaaaagaactcgctccattcagagattcagagaagacccgcctctcccgtgagccgtgacgcgacgccggatcgtcctcgtctcctagctcgtggaatgaagggaggtggcgtcatcagggccgccggcggaggtgccgcgtngccgggtctgttgcgaacgcgactgcgcttcccgtggtgctcctctcctgctccctcttcttcctcgccggcttcttcggctcgctcctcttcacccaggatccggagaggcggatatgccggtaccgagagagcggctgttsgaggcggcgtggccgragatgccttacggcgagtccggcgaggctgcgcgtnccttgatcccataccagattttgagctggcagcctcgtgctttgtactttccacaatttgcgacatcagaacagtgtcaaaatatagtaaaaacggcaaaggagagacttaagccatcaacattag

SEQ ID NO: 4746 - protein, 68 aa, Zea mays
  misc_feature: Ceres CLONE 305880-F
  misc_feature (9)..(9): Xaa is any aa, unknown, or other
  misc_feature (15)..(15): Xaa is any aa, unknown, or other
  misc_feature (27)..(27): Xaa is any aa, unknown, or other
MPVPRERLXEAAWPXMPYGESGEAARXLIPYQILSWQPRALYFPQFATSEQCQNIVKTAKERLKPSTL

SEQ ID NO: 4747 - DNA, 208 bp, Zea mays
  misc_feature: Ceres CLONE 305930-F
  misc_feature: Encodes the peptide sequence at SEQ ID NO. 4748
  misc_feature (62)..(62): n is a, c, t, g, unknown, or other
atccacacacacacaacacagcagagagattactacgatccaacagttctagagcaagakanaggagacacaccgcagagttagcaggctaataacttgcaggagcagcaggaatggcggcgacsgtcsctcctcttgccttctcctcgccgtgcttctggcaggagtggccgctgcmcgccttcgacgaagcggctgctgcggcttc

SEQ ID NO: 4748 - protein, 31 aa, Zea mays
  misc_feature: Ceres CLONE 305930-F
  misc_feature (6)..(6): Xaa is any aa, unknown, or other
  misc_feature (22)..(22): Xaa is any aa, unknown, or other
MAATVXPLAFSSPCFWQEWPLXAFDEAAAAA

SEQ ID NO: 4749 - DNA, 187 bp, Zea mays
  misc_feature: Ceres CLONE 305951-F
  misc_feature (52)..(52): n is a, c, t, g, unknown, or other
  misc_feature (66)..(66): n is a, c, t, g, unknown, or other
  misc_feature (107)..(107): n is a, c, t, g, unknown, or other
aagtcgcccagaccagatttgccagaacgcaacctcggctccgaaaccctancygcacgcagctdnccacttctactcccctcgcctcgccacacccgccgcgcgwnacgatcagacgccatggccgccgagaactactggaggtacgctgatgcgcggcasagcagcaggcgatggtggccgccgc

SEQ ID NO: 4750 - DNA, 352 bp, Zea mays
  misc_feature: Ceres CLONE 306015-F
  misc_feature: Encodes the peptide sequence at SEQ ID NO. 4751
  misc_feature (175)..(175): n is a, c, t, g, unknown, or other
  misc_feature (298)..(298): n is a, c, t, g, unknown, or other
aaaggaggcactggacgcggacatccaggaccgcgtcatgaaggagcgggagatgcagagctacatcgcggagccgagbbgaggttgccgagagggaggccgcgtggaaggccgagctctcccgccgcgastgaggatcgcgaggcaggaggcgaggctgaaggtggaaaggganaacctggagaaagataagagcgtcctcatggggacggcttcgagccaggacagccaatacggagcgctggagatcaccgtcagcggcgaaaagtacaggtgcctccggttctcgaaggcgaanaatgtgagagkttaaaccataacgacacattcactcaggttcaggggggtattg

SEQ ID NO: 4751 - protein, 102 aa, Zea mays
  misc_feature: Ceres CLONE 306015-F
  misc_feature (26)..(26): Xaa is any aa, unknown, or other
  misc_feature (27)..(27): Xaa is any aa, unknown, or other
  misc_feature (44)..(44): Xaa is any aa, unknown, or other
  misc_feature (58)..(58): Xaa is any aa, unknown, or other
  misc_feature (99)..(99): Xaa is any aa, unknown, or other
KEALDADIQDRVMKEREMQSYIAEPXXGCREGGRVEGRALPPRXRIARQEARLKVERXNLEKDKSVLMGTASSQDSQYGALEITVSGEKYRCLRFSKAXNVR

SEQ ID NO: 4752 - DNA, 109 bp, Zea mays; identical to SEQ ID NO: 3915
  misc_feature: Ceres CLONE 306058-F

SEQ ID NO: 4753 - DNA, 485 bp, Zea mays
  misc_feature: Ceres CLONE 306066-F
  misc_feature: Encodes the peptide sequence at SEQ ID NO. 4754
  misc_feature (454)..(454): n is a, c, t, g, unknown, or other
cagaagtccagaccaaagctccaaagtccaatccctcgctagcyacttgccatctgatcaaccagccagccgatctcagcgatccgccatggccaccgcgtattacgagaggccccgtkgcggcgccgtcgaggaggcggacgacttcgatgagttcgaccccacgccgtacgsttggggtacgacctcgccgtcaccttcggtcgcccgctgccaccgtccgaggaaacctgctacgcgtgctcggcgccctcgacctcctacgacgcaccgcactacgccgcctccgagccgtccccctacggtcaccacgccaagccaaagcccaactacgggttccgcccccagcaggagcaacagccgtcttacgagcggctacggatccaggcccgagcccgctgcggaggagggcggtggctatggatctggcttcggatccgggtatgggaggaanaacaggaggaggagagctacggctctggata

SEQ ID NO: 4754 - protein, 132 aa, Zea mays
  misc_feature: Ceres CLONE 306066-F
  misc_feature (11)..(11): Xaa is any aa, unknown, or other
  misc_feature (29)..(29): Xaa is any aa, unknown, or other
  misc_feature (122)..(122): Xaa is any aa, unknown, or other
MATAYYERPRXGAVEEADDFDEFDPTPYXWGTTSPSPSVARCHRPRKPATRARRPRPPTTHRTTPPPSRPPTVTTPSQSPTTGSAPSRSNSRLTSGYGSRPEPAAEEGGGYGSGFGSGYGRXNRRRRATALD

SEQ ID NO: 4755 - DNA, 510 bp, Zea mays
  misc_feature: Ceres CLONE 306130-F
  misc_feature: Encodes the peptide sequence at SEQ ID NO. 4756
gcgtccacctccgccccccgccctccccgcgtcccccctctcctacgcagatcgtccagatgtcgtccgaggcggtgaaggtggcggtgccggagtcggtactccgcaagcggaagcsggaggagcagtgggccgccgagaagaaggagaagtccctggccgagaggaagaagtccatcgagagccggaagctcatcttcacccgcgccaagcagtacgccgaggagtacgatgcccaggagaaggaactggtacagcttaagcgtgaggcccgtttgaagggtggtttctatgtcagccctgaggcaaagctgctatttgtggtccgcatccgtggtatcaatgccatgcaccctaagaccaggaagatattgcagcttctgcgtttgaggcagatcttcaatggcgtgttcctgaaagtcaacaaggctaccattaacatgcttcgcagggttgagccttatgttgcatatgggtaccgaacttgaagagttgtcagggagttgatct

SEQ ID NO: 4756 - protein, 142 aa, Zea mays
  misc_feature: Ceres CLONE 306130-F
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
  misc_feature (20)..(20): Xaa is any aa, unknown, or other
MSSEAVKVAVPESVLRKRKXEEQWAAEKKEKSLAERKKSIESRKLIFTRAKQYAEEYDAQEKELVQLKREARLKGGFYVSPEAKLLFVVRIRGINAMHPKTRKILQLLRLRQIFNGVFLKVNKATINMLRRVEPYVAYGYRT

SEQ ID NO: 4757 - DNA, 412 bp, Zea mays
  misc_feature: Ceres CLONE 306151-F
  misc_feature: Encodes the peptide sequence at SEQ ID NO. 4758
  misc_feature (195)..(195): n is a, c, t, g, unknown, or other
  misc_feature (196)..(196): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgac

SEQ ID NO: 4758 - protein, 70 aa, Zea mays; identical to SEQ ID NO: 1949
  misc_feature: Ceres CLONE 306151-F
  misc_feature: SWISSPROT Homolog: EC 2.3.1.74 Naringenin-chalcone synthase

SEQ ID NO: 4759 - DNA, 260 bp, Zea mays
  misc_feature: Ceres CLONE 306163-F
  misc_feature (61)..(61): n is a, c, t, g, unknown, or other
atagccagcgccaaccccggaaaggcggaaacccatcgcaactaatccccaaccccaaacntccaatccacccatcccctcctcatccactccgggcggccatggcctgctccttcgccgccgcgaccgtcgtctcttccgcccccaccccggccgccacgcctcgccgctgccccgcagtccgtctctgtttcccgctccggtcgccaccgccgccagcgctccgcctcgtcgcctccagatccgcgcgggccatcaga

SEQ ID NO: 4760 - DNA, 446 bp, Zea mays
  misc_feature: Ceres CLONE 306177-F
  misc_feature: Translation starting site: 58
  misc_feature (33)..(33): n is a, c, t, g, unknown, or other
  misc_feature (324)..(324): n is a, c, t, g, unknown, or other
  misc_feature (338)..(338): n is a, c, t, g, unknown, or other
atcgccccttgaaccctagctcccgcaactkcngccgccactcccacgcccgcagccatgccgcccaagctcgacccgtcgcaggtggtggaggtgttcgtccgtgtgaccggcggcgaggtcggcgcacgtcttcgctggcccccaagatcggcccgctcggtctttcccccaagaagatcggagagggacatcgccaaggagacggccaaggactggaaggccctccgcgtcaccgtcaagctcaccgtccagaaccggcagccaaggtctccgtcgtcccctccgccgcggcgctcgtcatcaaggcgctcaaggagccanatagggaccgcaanaaggtcaagaacatcaagcacagcgtcaacatcagcctcgacgacgtcatcgagatcgccaggaccatgaggcacaggtcatggccaaggaattggcggcaccgtcaa

SEQ ID NO: 4761 - DNA, 741 bp, Zea mays
  misc_feature: Ceres CLONE 306275-R
  misc_feature: Pfam Name: DUF1677 Pfam Description: Protein of unknown function (DUF1677)
ccaattgggtaccgggccccccctcgaggtcgacggtatcgatattttttttttttttttttaccgagctcacgcgaagcagaatatatcagtacaaggccagaaaccagcaagtgatatgatatacattcgctggtctaataatatatatagttcgtcgatcttctccatcccccaccccatatgtacacatgtttattcatcttacttgcttaatcctggcagcaactgctagtgcaagcagaaacgcacaagacagagactagctagcctgttctccctctccatcacgcacacaagcatctcggattccttcctcattcgacgagagcggcgaagcagctccccgtgcgcgccagcgagctcccggcgccgcccgatgccacggcggagatgccaggggcggaatcgcgccccccgctgctcggcgtggagcgcgccttcctcggcgccggcgtcggcggcggggacccgagcctgcggcacatgagcaggcgcagcgcggcgatgaggtcgtcggcgctgctcacgggcgacgcctgcggcgtggacgccccgcggcagacgcaagcgtgccggtccagcgcctcggcggcgaagaatgggcgggccatcaaatctcatcctcttgaatatgaccgagccagtttgcccacactcgacacactgggaaaagaggtccacaaaggttgtccatctagtataggaaagaaaaaacactggcacaccataagaaaacac

SEQ ID NO: 4762 - DNA, 265 bp, Zea mays
  misc_feature: Ceres CLONE 306277-F
  misc_feature: Encodes the peptide sequence at SEQ ID NO. 4763
ctccccaactcgccgtckrccttctgcgcctccatttcggcctctgtcccttgcaagttcaatctcaccttccaaccatgggtaaagagaagtcccacatcaacattgtggttattggccatgtcgactctggcaagtcgaccaccacaggacaccttatctacaagcttggagggcattgacaagcgtgtgatcgagaggtttgagaagggaggctgctgaaaatgaataagcgggtcccttcaagtacacgtggggtgctcga

SEQ ID NO: 4763 - protein, 34 aa, Zea mays
  misc_feature: Ceres CLONE 306277-F
MGKEKSHINIVVIGHVDSGKSTTTGHLIYKLGGH

SEQ ID NO: 4764 - DNA, 718 bp, Zea mays
  misc_feature: Ceres CLONE 306294-R
  misc_feature: Pfam Name: BcrAD_BadFG Pfam Description: BadF/BadG/BcrA/BcrD ATPase family
caattgggtaccgggccccccctcgaggtcgacggtatcgataagcttttttttttttttttttgaggccaagcacaatgtatgtaaaaaagatctgaacatttgacgatcaattatccatggtagacagatacatgttactacctccaaacacaaacagaacacatacaacaatcaccgagagttagaatcagaggaatatttgaacaattcttactacctacttacatcagaaatatgttctatccacaccgcatgtttgcacccatccacgatttattctttttgctgggaaccaaaagccttcatgctgatgaatgtatcattgggaccaatacccctttggctcgccaactcctcaatgtacaattgacacccttaaatgctgggaatcaactaccattgtccaatttcaaccctttgtggtgatggctccaggctagcaaggcagcaccgattgctggttccacctcaagccaaataagatcagtgcccgggaagaccttggaaatacaatttatgacctcaccactgatatcccactttttatttccttcaaggaaccctccaaccaaaacaagtggaaacatgtcctttgcatcttcaccacacaatctaagacgccgaacaaccgctataacagtgtcagccaactcttggactgaatcatgcaagaatttgttagctacttcatcaccatcttcagcagaagaaccac

SEQ ID NO: 4765 - DNA, 183 bp, Zea mays
  misc_feature: Ceres CLONE 306296-F
  misc_feature: Encodes the peptide sequence at SEQ ID NO. 4766
  misc_feature (18)..(18): n is a, c, t, g, unknown, or other
  misc_feature (19)..(19): n is a, c, t, g, unknown, or other
  misc_feature (128)..(128): n is a, c, t, g, unknown, or other
atcacacccaacgcaacnncagcaatcgcgcagagaaaaatcactgatacaatggccatcaggggcagcatcggcttcgcagtgctctsstcgcgctgatgctgcacgccgcggcgacggcgcggcgncccaggaccgtgcctatgccgggcgcctcctcgacgtccaccggcagcaccgcgt

SEQ ID NO: 4766 - protein, 28 aa, Zea mays
  misc_feature: Ceres CLONE 306296-F
MLHAAATARRPRTVPMPGASSTSTGSTA

SEQ ID NO: 4767 - DNA, 352 bp, Zea mays
  misc_feature: Ceres CLONE 306323-F
agaatcttcagacatccgagcgtcttgcgcgtttcgatttgaaccacttggcgctgctgccggaccggtcctcacccctcaacccgccgaacttcctcgtcaccgccggcggsattcgatcgttgccaagtctcccaccatcgcctccacgggaaaaaaaatggcgcaggaggctgcaccggcgaggccgcgggcccaccaggctcgtctacttcgatgatatgggggcactccaccactcatccgccaccgttctctccgttccaccaggaggaggggcggccgggtagcggtggtgctggacgccacggtcttccacccgcagcgttcggccaaccggcggacacgggcg

SEQ ID NO: 4768 - DNA, 745 bp, Zea mays
  misc_feature: Ceres CLONE 306375-R
ccgattgggtaccgggccccccctcgaggtcgacggtatcgataagcttttttttttttttttttatttttttttttttttttttttttttttttttttttttttttttttttttttttttttttttttttttttttttttttttttttggaaaaagggggggcccccttgggaaaaaccccccccgggggaatttttctgaaggatgatggaatgacaaaaaaccccccccccatgggtttttttcgggggggcccctggggaacgaaatacgaaaaaaaaaaaaaacccctccctggggggggaaaaaaaaaaggggggggggacatgtccatgagggggaaaaaaaaaaaggggtggcctggttcaaaatttcccggggggaacaaaaaatttttttcgaaaagattttcccccccccccccttttggggttttccccgggggcccaaaaattaaaatccaaaaaaacctgaaacaggggtcccggggccccaacccaaggggccccccttccaacccaaaattgcccggcccggaaaggccccagggcttctggatcctcggttgccccggaattatcttaagcgcccccgggaaacctgcaattttgcccccctgattgaaccctgggggtaaccctttttttttgttccaaacccaaacgggtagcccggccaaacaaaaaccctccctaataaaactggcgtggttgctgtccccaaaggaaaaaaaaataggatttt

SEQ ID NO: 4769 - DNA, 419 bp, Zea mays
  misc_feature: Ceres CLONE 306395-F
  misc_feature: Encodes the peptide sequence at SEQ ID NO. 4770
  misc_feature (69)..(69): n is a, c, t, g, unknown, or other
aaaactgatccactctccgcttcccgctccgatcgacctgctccctccccaccaccgagcccatggcgnaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactkat

SEQ ID NO: 4770 - protein, 118 aa, Zea mays
  misc_feature: Ceres CLONE 306395-F
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (3)..(3): Xaa is any aa, unknown, or other
MAXQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLT

SEQ ID NO: 4771 - DNA, 136 bp, Zea mays
  misc_feature: Ceres CLONE 306396-F
acacgcacaccgcgacccagtccagagccagtacgtgcgamgcacgcacgctgctggtccgcgtacsagacgacggtcaggtcggccggtgcttttcagtttggaataatgacggcgacgacgacgacagccgccg

SEQ ID NO: 4772 - DNA, 132 bp, Zea mays
  misc_feature: Ceres CLONE 306427-F
  misc_feature (39)..(39): n is a, c, t, g, unknown, or other
acgcacaccgcgacccagtccagagccagtacgtgcganrcaacgcacgctgctggtccgcgtacsagacgacggtcaggtcggccggtgcttttctagtttggaataatgacggcgacgacgacgacagcc

SEQ ID NO: 4773 - DNA, 308 bp, Zea mays
  misc_feature: Ceres CLONE 306443-F
  misc_feature: Encodes the peptide sequence at SEQ ID NO. 4774
  misc_feature (235)..(235): n is a, c, t, g, unknown, or other
aaaaacccacgtttcaaaaaaaagagaggaaagcaaagttccttcttccctcggaaaaaaaatcagtctcaatggagagcagcgtaggcatagagaaggccgcagcggtggcgttggtgcaggtgtgggcggtggaggagggtacggctgcggcgggtgggagacgccgaagcgcgaggagtgccgcatcccggcgacgctgccgtgccccgcggcgccgaggaaggccgtgcgnacttcgggaagcggcgcascgcccaagaacggctacttccagccgccggacctggaggcgctcttcgcgctcg

SEQ ID NO: 4774 - protein, 102 aa, Zea mays
  misc_feature: Ceres CLONE 306443-F
  misc_feature (85)..(85): Xaa is any aa, unknown, or other
KTHVSKKREESKVPSSLGKKISLNGEQRRHREGRSGGVGAGVGGGGGYGCGGWETPKREECRIPATLPCPAAPRKAVRTSGSGAXPKNGYFQPPDLEALFAL

SEQ ID NO: 4775 - DNA, 422 bp, Zea mays
  misc_feature: Ceres CLONE 306448-F
  misc_feature: Translation starting site: 26
  misc_feature: SWISSPROT Homolog: EC 1.1.1.288 Xanthoxin dehydrogenase
  misc_feature: SWISSPROT Homolog: EC 1.1.1.53 3-alpha-(or 20-beta)-hydroxysteroid dehydrogenase
  misc_feature (357)..(357): n is a, c, t, g, unknown, or other
aggttggttaactaggaacgcagccatggcaagcagtgccgtcatcgtccctgcctctccaagaaagttggagggaaaggtggccgtgatcactggcggggcgagcgggataggggagcgcacggcccggctgttcgtggagcacggcgcccacgtcgtgtggccgacatccaggacgaggccggcgcgcgcgtctgscgatctcggcgggggtgccgccagctacgtccactgcgtacgtcaccagcgaggacgacgtcgcggccgsgtggaccacgccgtgcgacgttcggcgcgctggacatcatgttcaacaacgcgggcgtcasgkggccggcgtgctacagcgtccggganrtcggcaaggctgacttcgagcgcgtcctggccgtgaatctggtgggcccgttcctcggcaccaa

SEQ ID NO: 4776 - DNA, 310 bp, Zea mays
  misc_feature: Ceres CLONE 306496-F
  misc_feature: Encodes the peptide sequence at SEQ ID NO. 4777
  misc_feature (203)..(203): n is a, c, t, g, unknown, or other
aaacaacagcggcacagcgctcgattcggcttcgctcgactcgcgggctcccctcgcaaagctctaaacccctctgagagaacctatccgggccaccacaaccgccacccatggacggcggcgacgctccggcggcgggaggcgggaaggtggcgtgcgcggcgtggatccggcgccgggaggacaagtcggcggcggcgcsncgcgggtgttcgcggcgtacggccgggcgggggcggccggctccccggcbtccttcgaggtgctttggcttcgacgccaaggagtgctccctctccccctctcccct

SEQ ID NO: 4777 - protein, 66 aa, Zea mays
  misc_feature: Ceres CLONE 306496-F
  misc_feature (31)..(31): Xaa is any aa, unknown, or other
  misc_feature (48)..(48): Xaa is any aa, unknown, or other
MDGGDAPAAGGGKVACAAWIRRREDKSAAAXRGCSRRTAGRGRPAPRXPSRCFGFDAKECSLSPSP

SEQ ID NO: 4778 - DNA, 317 bp, Zea mays
  misc_feature: Ceres CLONE 306517-F
  misc_feature: Encodes the peptide sequence at SEQ ID NO. 4779
attacttgcctctcgctcgccaacaccagtgccagaggtccagagcttcgtcaaagacacgccgaaaagggggaggcgactcggccgaggtccggttccgaactccggtcctccgatttgcgcgtccggatctaccagccatggcatcatcttcggacccgtggatgaaggagtacaatgaagcatccagacttgctgatgacatcagttccatgattgctgatagagggtcccttccacaatcaggcccagaaattatgcggcatacttcagccatccggagaaaaataactattcttgggactagactggatagc

SEQ ID NO: 4779 - protein, 59 aa, Zea mays
  misc_feature: Ceres CLONE 306517-F
MASSSDPWMKEYNEASRLADDISSMIADRGSLPQSGPEIMRHTSAIRRKITILGTRLDS

SEQ ID NO: 4780 - DNA, 280 bp, Zea mays
  misc_feature: Ceres CLONE 306536-F
  misc_feature: Encodes the peptide sequence at SEQ ID NO. 4781
  misc_feature (233)..(233): n is a, c, t, g, unknown, or other
accaggcaccagcatagatctcgttctcgccactattattctgcacagcaacgcatcaagccttctagaaccatctcgccgccgccacaccacaacccgtcgaagygamsaagcaatggccggagtcggatcgaaggccctcgccgttgccgccgttctggcgcggatctccctctcggtggccgccgcggcgaggcgccggcgcccagccccgtctccgccgccgtcgcgtnctkacgcccttcgccgcggccctcgtcgcctccgccgccgccttcct

SEQ ID NO: 4781 - protein, 55 aa, Zea mays
  misc_feature: Ceres CLONE 306536-F
  misc_feature (40)..(40): Xaa is any aa, unknown, or other
  misc_feature (41)..(41): Xaa is any aa, unknown, or other
MAGVGSKALAVAAVLARISLSVAAAARRRRPAPSPPPSRXXALRRGPRRLRRRLP

SEQ ID NO: 4782 - DNA, 490 bp, Zea mays
  misc_feature: Ceres CLONE 306550-F
  misc_feature: Encodes the peptide sequence at SEQ ID NO. 4783
  misc_feature (426)..(426): n is a, c, t, g, unknown, or other
gtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgcgtgacggsgtntatggcggcggtggcggctacggcggtcggcgcgagggtggtgcacggatcgttggcgcgcgcg

SEQ ID NO: 4783 - protein, 134 aa, Zea mays
  misc_feature: Ceres CLONE 306550-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (112)..(112): Xaa is any aa, unknown, or other
  misc_feature (113)..(113): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRVTXXMAAVAATAVGARVVHGSLARA

SEQ ID NO: 4784 - DNA, 483 bp, Zea mays
  misc_feature: Ceres CLONE 306572-F
  misc_feature: Encodes the peptide sequence at SEQ ID NO. 4785
  misc_feature (108)..(108): n is a, c, t, g, unknown, or other
  misc_feature (338)..(338): n is a, c, t, g, unknown, or other
gaccctagtccaaaccaccgcaccgacaccgayhccgagccccgccgcgcygsctacctccgctcctctcttcgcccctgccggcgtcgaggccgaagcgaaggcgangcatgcatcacgaccccaaccccttcgacgagggcagcgccgaggacaaccccttctcaaatggaggagccggasacaagcagcagtacggcttccggccgactgagcccgtcgggttcggcggcgctacaggggcgacgcgttcgttgacgtcccgctcgagaccatgggggactctcggagcaaggtgaaggagctctcgtcgtgggaatcagatctgaagcggcganaggcggatatcaagaggagggaagaggcgctgaagaatgctggcgtgccaatggaggagaagaactggccaccattcttccccatcatccaccatgatattgccaatggagataccaggcaaatgtgcagaagtttgcagtatct

SEQ ID NO: 4785 - protein, 69 aa, Zea mays
  misc_feature: Ceres CLONE 306572-F
  misc_feature (22)..(22): Xaa is any aa, unknown, or other
MGDSRSKVKELSSWESDLKRRXADIKRREEALKNAGVPMEEKNWPPFFPIIHHDIANGDTRQMCRSLQY

SEQ ID NO: 4786 - DNA, 518 bp, Zea mays
  misc_feature: Ceres CLONE 306586-F
  misc_feature: Encodes the peptide sequence at SEQ ID NO. 4787
  misc_feature (44)..(44): n is a, c, t, g, unknown, or other
  misc_feature (48)..(48): n is a, c, t, g, unknown, or other
atctacgttctactcccactcgcggtcgcggtagccggcggcgncggnaggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgcggaggccaaggccaacgtcaagaagcgcatcgagtacatctccgcagagctgaagcgatggatcgggcgctcaaagacttggaggaaaagcaaaacagcaagaaggaatcgatattcaagttgcagcagaggatgcaggctgtacaagctaaggcttagacrrctgtttgttggttgcaacttgaatatcgatgccttcttaacttacctagga

SEQ ID NO: 4787 - protein, 150 aa, Zea mays
  misc_feature: Ceres CLONE 306586-F
  misc_feature (19)..(115): Pfam Name: Prefoldin_2 Pfam Description: Prefoldin subunit
  misc_feature (133)..(133): Xaa is any aa, unknown, or other
MASSSSTPAAVREMQKDLEVQANALSKIQKDIAKNHQVRKQYTIQVGENELVLKELELLSDGANVYKLIGPVLVKQDLAEAKANVKKRIEYISAELKRWIGRSKTWRKSKTARRNRYSSCSRGCRLYKLRLRXLFVGCNLNIDAFLTYLG

SEQ ID NO: 4788 - DNA, 165 bp, Zea mays
  misc_feature: Ceres CLONE 306628-F
  misc_feature (60)..(60): n is a, c, t, g, unknown, or other
  misc_feature (61)..(61): n is a, c, t, g, unknown, or other
agtcgtcacaccacgcgaaasagcagcaaagtcaccagcaaccagcagatcccgtcgccnncacgatggccagctcgtcgtcgtcgtcgtcagctctggtcgtcctcgtggtggttctagcygcggcggtggcgtgctccgcgacgsccccgtccccgcgcggca

SEQ ID NO: 4789 - DNA, 381 bp, Zea mays
  misc_feature: Ceres CLONE 306661-F
  misc_feature (233)..(233): n is a, c, t, g, unknown, or other
aatcttgctctgaacgcattcctcccatctcccaagacctcctcagacccgagaagcgcmkgcggccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcgcasgtncggcagcggtgcccccgtctacctcgcggccgtcctggagtacctcgccgctgaggtccttggagctcgccggcaacgctgccaaggacaacaagaagacgcgcatcgtcccgcgccacgtgctgctggcgatccgcaacgacgagga

SEQ ID NO: 4790 - DNA, 443 bp, Zea mays
  misc_feature: Ceres CLONE 306699-F
  misc_feature: Encodes the peptide sequence at SEQ ID NO. 4791
  misc_feature (212)..(212): n is a, c, t, g, unknown, or other
  misc_feature (254)..(254): n is a, c, t, g, unknown, or other
gtcctcgtctcctcgaggcccggagctgcgagtctgtgacacttgaccgtgagcggacggcgactccgaggacttcaccagcgagtccctcaagcaccgaggccgagccgcccaccgcccgccgccgcctcgcctggcgctagtcgccgttgccgagcctgttcggcacatccgttggggtgccggggcacgatcaggctgcgcacagcganagtcggcctccgggtgccccaagctgcagagcmsgcggccancgttggaccggtgaatcagactacccttgtttcaaatcctgcgtccgccattgggggcgtgaggccaccctagtagaggctagaggatgatatacacggcgatcgacacgttctacctgacagatgagcagctccgtgactcgccatcacggaaggwtgggatcgacgaggccaccgagactgcgctcc

SEQ ID NO: 4791 - protein, 34 aa, Zea mays
  misc_feature: Ceres CLONE 306699-F
  misc_feature (24)..(24): Xaa is any aa, unknown, or other
MIYTAIDTFYLTDEQLRDSPSRKXGIDEATETAL

SEQ ID NO: 4792 - DNA, 1806 bp, Zea mays
  misc_feature: Ceres CLONE 306709
  misc_feature: Encodes the peptide sequence at SEQ ID NO. 4793
ggccatctctagagtcgcccggctacctgccgcgccgcaaacccgagccactcgcctgccgcgctgattagatttctttgcatccgccagtggagtcgaatcgatggcggcgtggtcgtcgccgccgtcgcttcgccacctcctcatgctccgtccatgcttgcccctcagccccacctgccttgctggctccttgcgccgccacatccacagccgctgccgcctcttctcctccgccgcatcctcctcgacactgacccacggcgacatcgcctcgacgcacggtgacgccgatggcgtcgtcgaagtcaaccctccgcgcggaactagggatttcccgccggaggacatgcggctccgcacctggctcttcgaccaattcagggaggtctcccgcctcatggccttcgaggaggtcgatttccccgtcctcgagtcggaggctctcttcatccggaaggcaggggaggaaattacgcagcagctctacaacttcgaggacaaagggggtcgccgtgttgttctcaggcccgaaattaccccttccctcgcgcgcctagtcataaagcaaggaaaatcagtctcccttccactgaaatggtttactataggacaatgctggcgatatgagcgcatgaccagaggaagaaggcgggaacattaccaatggaatatggatatatttggtgtgcctaaagttcgggctgaggctgagcttcttcatgctattgttctcttatttcaacgtcttggaattacatcttcagatgtggggatcagggtgtmcagtcggaaggttcttmaggctgttttgaacatgtactccatcccagagcacttattcactcaagtttgtgttattgttgataaattgggtaaaatgactagggaagaaatcgagaaggaacttgtttcaactgggttgtcatctgaagctgtacagggtatcatcgatgtgctttcaatcaagtcattgtccaaacttgaagaggtgttaggctctgatgttgaagctgttgctgacttgaagaaactcttctccttcgcggagcaatatggttatgctgattggatttgttttgatgcatcagtggtccgtggccttgcatactacacaggaattgtatttgaggcatttgatagagaaggaaaactgagagcaatttgcggtggtggaaggtatgatagattgctttcaacatttggaagtgaagatataccggcttgtggctttggatttggagatgctgttatagtggaactgctgaaagaaaagggtctcttgcctgatatgtcacgccaaattgatgacatcgtcttccctttggacgaagaacttgaaggaccagcatccagtattgcttcctctctgaggaagaaaggccgatctgttgaccttgtagaagacaaacgtctcaaatgggtatttaagcatgcggagaggatcaatgcgagccggctgatattggttggaaattctgagtgggagcgaggcatggtacgggtraaggtgctatcaaccagggaagagtttgaggtaaagacaagtgaactagagtgattgtagaaatgttacgttatgctagcctcggctaatgcttgtgagatgatacaatcaaacagtagctagctatttctggagagtttaaacttattgtaacagtctgtaacaactattcatattcatacagaatggatgggcatgatccttgccagctagtaaaaaaaaaaaaaaaaaaaaaaaaaaaaaaaaaaaaaaaaaaaaaaaaaataaawaaaaaaaaaaaawttwaaaaaaaaaaaaaa

SEQ ID NO: 4793 - protein, 485 aa, Zea mays
  misc_feature: Ceres CLONE 306709
  misc_feature (85)..(250): Pfam Name: tRNA-synt_2b Pfam Description: tRNA synthetase class II core domain (G, H, P, S and T)
  misc_feature: SWISSPROT Homolog: EC 6.1.1.21 Histidine--tRNA ligase
  misc_feature (228)..(228): Xaa is any aa, unknown, or other
  misc_feature (234)..(234): Xaa is any aa, unknown, or other
  misc_feature (468)..(468): Xaa is any aa, unknown, or other
MAAWSSPPSLRHLLMLRPCLPLSPTCLAGSLRRHIHSRCRLFSSAASSSTLTHGDIASTHGDADGVVEVNPPRGTRDFPPEDMRLRTWLFDQFREVSRLMAFEEVDFPVLESEALFIRKAGEEITQQLYNFEDKGGRRVVLRPEITPSLARLVIKQGKSVSLPLKWFTIGQCWRYERMTRGRRREHYQWNMDIFGVPKVRAEAELLHAIVLLFQRLGITSSDVGIRVXSRKVLXAVLNMYSIPEHLFTQVCVIVDKLGKMTREEIEKELVSTGLSSEAVQGIIDVLSIKSLSKLEEVLGSDVEAVADLKKLFSFAEQYGYADWICFDASVVRGLAYYTGIVFEAFDREGKLRAICGGGRYDRLLSTFGSEDIPACGFGFGDAVIVELLKEKGLLPDMSRQIDDIVFPLDEELEGPASSIASSLRKKGRSVDLVEDKRLKWVFKHAERINASRLILVGNSEWERGMVRXKVLSTREEFEVKTSELE

SEQ ID NO: 4794 - DNA, 387 bp, Zea mays
  misc_feature: Ceres CLONE 306821-F
  misc_feature: Encodes the peptide sequence at SEQ ID NO. 4795
  misc_feature (307)..(307): n is a, c, t, g, unknown, or other
  misc_feature (341)..(341): n is a, c, t, g, unknown, or other
ctatgggctttgtggccgccctgtcggaaaacccgcgcaagawaagagaaacccgcaagccgcccgcgcagaccatcgccccgttgccacggtcaaattcgtcggcgtttggtgccgcggcgtgactgtccgccggtcgcgcgcgcgtcctgcctggttggatcccttcggacttccgcagattcccgcgcgggggtgtttgatttggatgakaggagcgcggcgcgggatggggaccccttcgcagggctcggcggccgtgacggcggcccgggtcgacctctgcgcgctcgacctcatgcctgtntttgccaaggagatgatcgccggcggctcgcscnctttctccaaaaccgccatcgcgccgctcgagcgcgtcaagatatt

SEQ ID NO: 4795 - protein, 52 aa, Zea mays
  misc_feature: Ceres CLONE 306821-F
  misc_feature (37)..(37): Xaa is any aa, unknown, or other
  misc_feature (38)..(38): Xaa is any aa, unknown, or other
MGTPSQGSAAVTAARVDLCALDLMPVFAKEMIAGGSXXFSKTAIAPLERVKI

SEQ ID NO: 4796 - DNA, 173 bp, Zea mays
  misc_feature: Ceres CLONE 306832-F
  misc_feature (130)..(130): n is a, c, t, g, unknown, or other
aaatcgacctagctaggcacaagagcgctagacgccgcagcgcasacgcaccacccaccgagcggcggcgaggcagggcaatccgcaggagcagaggccgcgcgcgcaggcatgggcgcscggtgcacgncctcgccttgttcctcctgctcctggtgggggcaggggcggcg

SEQ ID NO: 4797 - DNA, 360 bp, Zea mays
  misc_feature: Ceres CLONE 306850-F
  misc_feature: Translation starting site: 186
aggcctaggcttttttgaggagcgcggactagggagtagggaggacgggacggagagagagagagaggcgcgtgcgttcgtggtcggtgccggtgcgtgcgtggcgtggtggccgctgccgtacgtgatccgtccaccccctctcctcttccgacgccggcgacasgggaggtactcsgggaggaatggccgtggcaagggctccgctcggcgcggttgctgcgatggcggtggccgctctcgtcttcgccatactcatgaccgccgccgctgcsccagggcaccggcgcccgckccaccagcgacggcacatcaatcgacctggggattgcgtacatccttatgctggttgccctagtg

SEQ ID NO: 4798 - DNA, 252 bp, Zea mays
  misc_feature: Ceres CLONE 306868-F
  misc_feature: Encodes the peptide sequence at SEQ ID NO. 4799
  misc_feature (109)..(109): n is a, c, t, g, unknown, or other
aacaacagccctacaacttactgcttgctctagctagctagctgctcccggcccatatccactacacaagtaggctagcagcagcagcagcaatggcctcggtgacggntcccggccgtggcctcgtcctgctgctcgccgccagcgccttcctggccagckaggtggcggcgtgcggcggctgccgawaccaactcctcctcctccatcgccaccaccgccgtcgcccwccagcacgccgtscctccgcca

SEQ ID NO: 4799 - protein, 53 aa, Zea mays
  misc_feature: Ceres CLONE 306868-F
  misc_feature (6)..(6): Xaa is any aa, unknown, or other
  misc_feature (24)..(24): Xaa is any aa, unknown, or other
  misc_feature (33)..(33): Xaa is any aa, unknown, or other
  misc_feature (51)..(51): Xaa is any aa, unknown, or other
MASVTXPGRGLVLLLAASAFLASXVAACGGCRXQLLLLHRHHRRRPPARRXSA

SEQ ID NO: 4800 - DNA, 449 bp, Zea mays
  misc_feature: Ceres CLONE 306895-F
  misc_feature: Translation starting site: 302
  misc_feature: SWISSPROT Homolog: EC 5.2.1.8 Peptidylprolyl isomerase
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgcatcgagggcatgaacggcaaggagctggacggccgcaacatcaccgtcaacgaggcccagtcccgcggcggccgtggcggcggctacggcaactccgacgggaactcgaggaactgagtgttgggcccgckckgccaagttatcctgttcgctaccg

SEQ ID NO: 4801 - DNA, 297 bp, Zea mays
  misc_feature: Ceres CLONE 306897-F
  misc_feature: Translation starting site: 115
  misc_feature (93)..(93): n is a, c, t, g, unknown, or other
atctgagatcgacatcgatccaccgaggtttcttgtgcgtgccgccatggccatggcagtagctcaccttcttcctcagctctccgccgaacnattggagctagcaggaacagaatggccattctcttgattcttcagctttttctcttgacggcgctaggcgtggatggagcggcgtcgttcatcttcaccaacgcctgcwagcacgcggtgtgggtgggcgcgctccacggcgccactcgccgccgctcgckcgttcgggcttctacctggcgccgtccgccacgtccagcatgg

SEQ ID NO: 4802 - DNA, 1304 bp, Zea mays
  misc_feature: Ceres CLONE 306916
  misc_feature: Encodes the peptide sequence at SEQ ID NO. 4803
aagcgacgcgaagcaccgaggagaggcggcgagagttcttggtcggctagatggaaaaggcgggccagaagcggcggccgctgacggtgatggcatcctcatcgtcgcaggtggcagcagcgcggggcatgggcatgaccaacccactggcggagtggaccgaccgcgtcaggtcgctggaggccggcgtgctggcgtggctagcgaagcagcccacccacgtcgaggccgccgtggtcacggcggtcggcgccgtgcagggcgccgcgctcgggcgggctcatgggcacgcttgcgcccgacggcggggcccgcgctcccttgtgccgccgccgccgccggggaccgacccaaaggtcttggcctccttcaagcaagcgcaggctttagcgggtggacccctggtgcaagcacgaaactttgcggtcatgactggtgcgaatgctggcatatcttgtgtcatgagaaggataagaggagtggaggatgtccagggcagcatggcagcagcttttggttctggggctctattctccatcgtgagtggaatggggaccccaaatccagtagctaatgcaattacaactggtgttggttttgctgtatttcaaggtggttttttcatgatctctcaaaaattttcacagccacagagtggagatacatactattctcgtggaagaagcatgctgcaaaagttaggccttcagaactatgagaagaacttcaagaagggtctcctaactgatcaaaccttgccccttcttacggacagtgctctcagagatgtgaagatcccgcctggccccaggctcctcatacttgatcacattaaaagagatccagagttgacaaaagcaaattaagtgatcggcactgcggcactgcctcacggtgccagttcttttccccctcgagttgcagaaattggaccaggagaaccgtttaatttagctattcagtgacgacctctttggagcagtatttggttgtgcttactagtatatgttttctagtcatcattcacgcttttttttgagccgaagtgtttgcaaatcactctgatcttggaatgacagaattttgtattctcaaaggtttatgctgatcaatccagattttactactagtttagggatgtcaaacgaagggaaactgcaattcgcacattttatttggcttctggatggtagtttggttctgatctgtaacgtttagccctttgctaagctgtgtcctgcataaggctttgcggcctgattaatataagcacacatgttggaatttcaaaaaaaaaaaaaaaa

SEQ ID NO: 4803 - protein, 271 aa, Zea mays
  misc_feature: Ceres CLONE 306916
  misc_feature (51)..(197): Pfam Name: Tim17 Pfam Description: Tim17/Tim22/Tim23 family
  misc_feature (203)..(264): Pfam Name: SAM_1 Pfam Description: SAM domain (Sterile alpha motif)
MEKAGQKRRPLTVMASSSSQVAAARGMGMTNPLAEWTDRVRSLEAGVLAWLAKQPTHVEAAVVTAVGAVQGAALGRAHGHACARRRGPRSLVPPPPPGTDPKVLASFKQAQALAGGPLVQARNFAVMTGANAGISCVMRRIRGVEDVQGSMAAAFGSGALFSIVSGMGTPNPVANAITTGVGFAVFQGGFFMISQKFSQPQSGDTYYSRGRSMLQKLGLQNYEKNFKKGLLTDQTLPLLTDSALRDVKIPPGPRLLILDHIKRDPELTKAN

SEQ ID NO: 4804 - DNA, 438 bp, Zea mays
  misc_feature: Ceres CLONE 306918-F
aacagccctacaacttactgcttgctctagctagctagctgctcccggcccatatccactacacaagtaggctwagcagcagcagcagcaatggcctcggtgacgagttcccggccgtggcctcgtcctgctgctcgccgccagcgccttcctggccagcgaggtggcggcgtgcggcggctgcccgawaccaactcctcctcctccatcgccaccaccgccgtcgcccwmcakcacgccgtscctccgccaccgtccagctccggcggcaagtgccccaagawcgcgctgaaactgggcgtgtgcgcaacgtgctgggcctcgtcaaggtgtccatcggcaaggtgcccaccgactcgtgctgcccgctgctggacggcctcgcgacctggaggccgccgtctgcytctgcaccgcgctcaaggccaacgtgctcgg

SEQ ID NO: 4805 - DNA, 492 bp, Zea mays
  misc_feature: Ceres CLONE 306923-F
  misc_feature: Encodes the peptide sequence at SEQ ID NO. 4806
  misc_feature (445)..(445): n is a, c, t, g, unknown, or other
agtttggcgatcgcgatcgggaccttccctcagctacaggccgacagcccacgccttcgaacggccggggatccgtacctccgctccgcccccgactccctctcgccggacggttgcagatccggtcaggccgatccgtctcggacccggtggtagcagtggaggaatccgctgccggtccatcgatcgggagagatgcggcasagcggggcggggtcggggccgggaggagggaggatgacccggggctcctcacgagagccgtcaacagggcgttccgcttcgtccgcctcgccgagttcgagatcttcttcgtcctcttcttcctcatcgccttctttytyttcaaggacctcatgtyacagcctcaatacaatcagctatttktyaagawgcctgatctagataacccctggccttagggagtacagaactacatatgtknatwakttgtagcctactagcctggtctttttctttgagttgtgttgc

SEQ ID NO: 4806 - protein, 139 aa, Zea mays
  misc_feature: Ceres CLONE 306923-F
  misc_feature (68)..(68): Xaa is any aa, unknown, or other
  misc_feature (114)..(114): Xaa is any aa, unknown, or other
  misc_feature (120)..(120): Xaa is any aa, unknown, or other
  misc_feature (129)..(129): Xaa is any aa, unknown, or other
  misc_feature (131)..(131): Xaa is any aa, unknown, or other
FGDRDRDLPSATGRQPTPSNGRGSVPPLRPRLPLAGRLQIRSGRSVSDPVVAVEESAAGPSIGRDAAXRGGVGAGRREDDPGLLTRAVNRAFRFVRLAEFEIFFVLFFLIAFFXFKDLMXQPQYNQLFXKXPDLDNPWP

SEQ ID NO: 4807 - DNA, 398 bp, Zea mays
  misc_feature: Ceres CLONE 310575-F
  misc_feature (141)..(141): n is a, c, t, g, unknown, or other
  misc_feature (248)..(248): n is a, c, t, g, unknown, or other
atcttgctctgaacgcattcctcccatctcccaagacctcctcagacccgagaagcgcaskgcgggtccatggacgccaccggcactggagctggagggaaggcgaagaagggagcggccgtcgcaaggccggcgggcganggaagaagtcrgtgacgaggtccgtagaaggccgggctccagttccccgtcggccgcatcgggcgctacctcaagaagggccgctacgcgcascgtcggcagcggtncccccgtctacctcgcggccgtcctggagtacctcgccgctgaggtcctggagctcgccggcaacgctgccaaggacaacaagawgacgcgcatcgtcccgcgccacgtgctgctggcgatccgcacgacgaggagctcgggaagctgct

SEQ ID NO: 4808 - DNA, 405 bp, Zea mays
  misc_feature: Ceres CLONE 310581-F
  misc_feature: Encodes the peptide sequence at SEQ ID NO. 4809
  misc_feature (169)..(169): n is a, c, t, g, unknown, or other
  misc_feature (332)..(332): n is a, c, t, g, unknown, or other
atccctaatcccagcgcmgacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcagggangtccattggcgcccgcgtctgctccggcgccgggaccggtcgctggcgcggcctccgctccggcctccgctgtggccgtggtgtcgtccgcactgctgtccctccttattgacggccctgaatgcatgtaggaagtatcatactagatttgagcgggaatttngttcagtgttgctattcctcattctttttgtatcatatatgtctgcgacatttatatatatgaataaagttgg

SEQ ID NO: 4809 - protein, 67 aa, Zea mays
  misc_feature: Ceres CLONE 310581-F
  misc_feature (25)..(25): Xaa is any aa, unknown, or other
MAPRVASALLFVVAVLVASAAAQGXPLAPASAPAPGPVAGAASAPASAVAVVSSALLSLLIDGPECM

SEQ ID NO: 4810 - DNA, 409 bp, Zea mays
  misc_feature: Ceres CLONE 310588-F
  misc_feature: Translation starting site: 96
  misc_feature (145)..(145): n is a, c, t, g, unknown, or other
  misc_feature (173)..(173): n is a, c, t, g, unknown, or other
  misc_feature (267)..(267): n is a, c, t, g, unknown, or other
acagccaaggaaatcttccgttctcaaaccaacctaggcaattmgccgcagcctctcaccctcgcgagtcccgacctcccgcagccgccgcacagatgrcacccaaggcggagaagaagccggcggccaagaagcccgcggaggnggagcccagcgacagagaaggaggaganggyccggmggggaagaagcccaagcccgagaagcgcctcccgggggcaagtccaaggagggcggcgagggcaagaaggggaatwakaaggcgangaagtccgtggagacctacaagatctacatcttcaaggtgctgaagcaggtgcaccccgacatggcatctcgtccaaggccatgtccatcatgaactccttcatcaacgacatcttcgagaagctcgcggccgagtccgcca

SEQ ID NO: 4811 - DNA, 236 bp, Zea mays
  misc_feature: Ceres CLONE 310597-F
  misc_feature (169)..(169): n is a, c, t, g, unknown, or other
  misc_feature (172)..(172): n is a, c, t, g, unknown, or other
accgttgtttgccatgtygtcggctgcgctgcgagtgcgcgggcggggcaccagctccctcgccggcccgcgtcgtgctccaactccaagcagaacagraagccgcmtgtggtgatagcgcacgagtgccccagcgcgatgcgtgcccacttggtgaggtgccvgcggngcncgacgtgctgtcgtgcgtctcggcgttcgcgcggcgtgggcggtgcggtgcgatggtgctgggc

SEQ ID NO: 4812 - DNA, 207 bp, Zea mays
  misc_feature: Ceres CLONE 310638-F
  misc_feature: Encodes the peptide sequence at SEQ ID NO. 4813
aaaaagaaggcaagagttctcggcttctcgcgagtcgsattccggsaagagaaagaggcggagttgcggagaagatgcagagcttcagcatgaagagggagatcagcgaggcccacgacaccattcgcttcggcatcaacgccggcgtcaaagccgacctcgacccrccgcacccgctccagtctaccatccaatcggagaccaagt

SEQ ID NO: 4813 - protein, 44 aa, Zea mays
  misc_feature: Ceres CLONE 310638-F
MQSFSMKREISEAHDTIRFGINAGVKADLDPPHPLQSTIQSETK

SEQ ID NO: 4814 - DNA, 225 bp, Zea mays
  misc_feature: Ceres CLONE 310651-F
aacggagaagagaacaagagatagtacttgacactcctgtcctgctcctccactcccacgctcccagccgagctcgagcgcacgcacacgcgcacaagcaggagctcctgtcccgctagatcccaaacagtctcctgcccgcgcgcgatttgggggggggagcgaaggaatcaccggatggcgatgttcgcgcggccgctgctggccaccctgctgctgctgccg

SEQ ID NO: 4815 - DNA, 279 bp, Zea mays
  misc_feature: Ceres CLONE 310665-F
  misc_feature: Encodes the peptide sequence at SEQ ID NO. 4816
  misc_feature (83)..(83): n is a, c, t, g, unknown, or other
  misc_feature (85)..(85): n is a, c, t, g, unknown, or other
  misc_feature (214)..(214): n is a, c, t, g, unknown, or other
atcacccaaaacacaagtagggttaggaaggcggcggccagcggcgagaggaggaggggtcggccatgacggggaaggcgamnangaagcacacagcgaaggagatcgccgcgaagatcgacgcggcgacgacgaaccggggtggmggcaaggccgggmaggmggaccggctggggcaggaagggcgggcatgcgaastggcgtgcccgctctnccgcaccccggcgcccgacatcaagtccatgcagatccaccacgaggcgcgccaccccaagctcc

SEQ ID NO: 4816 - protein, 71 aa, Zea mays
  misc_feature: Ceres CLONE 310665-F
  misc_feature (6)..(6): Xaa is any aa, unknown, or other
  misc_feature (7)..(7): Xaa is any aa, unknown, or other
  misc_feature (32)..(32): Xaa is any aa, unknown, or other
  misc_feature (33)..(33): Xaa is any aa, unknown, or other
  misc_feature (45)..(45): Xaa is any aa, unknown, or other
  misc_feature (50)..(50): Xaa is any aa, unknown, or other
MTGKAXXKHTAKEIAAKIDAATTNRGGGKAGXXDRLGQEGRACEXACPLXRTPAPDIKSMQIHHEARHPKL

SEQ ID NO: 4817 - DNA, 459 bp, Zea mays
  misc_feature: Ceres CLONE 310672-F
  misc_feature: Encodes the peptide sequence at SEQ ID NO. 4818
  misc_feature (107)..(107): n is a, c, t, g, unknown, or other
gcgcggacggacagattacattcacctcccatccatttctcaccagaagcgaaggcgaaggcggaggcggaggagcggaggtaggagatctcgagcaagccggasgnagtagatgaagacgttcgacccgtggccggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagaaacgcatgtttggmcagccagttctgttatgcttttgaatgawaaatttagacccctctttctcgtttccttaatcgaaatgcttgarctctatgttccatttgtaatgtaataagaggcaaatgaattgaaccaacagcaatcaacttctgatt

SEQ ID NO: 4818 - protein, 57 aa, Zea mays; identical to SEQ ID NO: 544
  misc_feature: Ceres CLONE 310672-F

SEQ ID NO: 4819 - DNA, 427 bp, Zea mays
  misc_feature: Ceres CLONE 310674-F
  misc_feature: Translation starting site: 80
  misc_feature (224)..(224): n is a, c, t, g, unknown, or other
  misc_feature (225)..(225): n is a, c, t, g, unknown, or other
  misc_feature (398)..(398): n is a, c, t, g, unknown, or other
agaacgatctcaatctccctagcaatctctagcagcagatcctcgtgcgamgaagcgctasccccttcgtactgtcccgatggcccgcacgaagcagacggcgaggwagtccactggcggcaaggcgccaaggaagcagctggcbaccaaggcggcgcgcaactctgccccggcgaccggcggagtgaagaagccccaccgmyttccgccccggcaccgtcgcnnccgggagatccgcaagtaccagaagagcacgrmagctgctgatccgcaagctgccgttccagsgcctggtgcgtgagatcgcccaggacttcaagaccgacctccgacttccagagctccgccgtcgccgcgctgcaggaggcgtccgaggcctacctcgtcgggctcttcgnggacaccaacctctgcgccattcacgcca

SEQ ID NO: 4820 - DNA, 115 bp, Zea mays
  misc_feature: Ceres CLONE 311008-F
acacgcacaccgcgacccagtccagagccagtacgtgcgamggcacgcacgctgctggtccgcgtacgagacgacggtcaggtcggccggtgcttttcagtttggaataatgacg

SEQ ID NO: 4821 - DNA, 367 bp, Zea mays
  misc_feature: Ceres CLONE 311041-F
  misc_feature: Encodes the peptide sequence at SEQ ID NO. 4822
  misc_feature (69)..(69): n is a, c, t, g, unknown, or other
  misc_feature (262)..(262): n is a, c, t, g, unknown, or other
cgtggttctactgaacgagcactcgcctgcgctcttctctctctcgtggcgacgactgggtgaccgcyncgccccaggcctgaggctccatcttcgggcccttcactggctacgagcaccaccagaggattatggattggctggggcagaagcgcgcggagatgctgatgcaggtgctgctggtggcgtctgctgtggcggcgttcctggtgggctacgtgcgcgcggacttccagctcatgctgctcgtctacgccggcgnbcgtgctcacagcgctcggtcaccgtccccaactggcccttctttcaaccgtaacccgctcaagtggctcgacgctgccgaggccgagcgccacccgcgccccca

SEQ ID NO: 4822 - protein, 78 aa, Zea mays
  misc_feature: Ceres CLONE 311041-F
  misc_feature (1)..(78): Pfam Name: SPC12 Pfam Description: Microsomal signal peptidase 12 kDa subunit (SPC12)
  misc_feature (44)..(44): Xaa is any aa, unknown, or other
MDWLGQKRAEMLMQVLLVASAVAAFLVGYVRADFQLMLLVYAGXRAHSARSPSPTGPSFNRNPLKWLDAAEAERHPRP

SEQ ID NO: 4823 - DNA, 201 bp, Zea mays
  misc_feature: Ceres CLONE 311073-F
  misc_feature: Encodes the peptide sequence at SEQ ID NO. 4824
  misc_feature (90)..(90): n is a, c, t, g, unknown, or other
atcacccaaaacacaagtagggttaggaaggcggcggccagcggcgagagcgcgagaggaggaggggtcggccatgacggggaaggcganssagaagcacacagcgaaggagatcaccgcgaagatcgacgcggcgacgacgaaccggggcggcggcaaggccgggcaggcggaccggctggggcaggacaagggcgggca

SEQ ID NO: 4824 - protein, 42 aa, Zea mays
  misc_feature: Ceres CLONE 311073-F
  misc_feature (6)..(6): Xaa is any aa, unknown, or other
  misc_feature (7)..(7): Xaa is any aa, unknown, or other
MTGKAXXKHTAKEITAKIDAATTNRGGGKAGQADRLGQDKGG

SEQ ID NO: 4825 - DNA, 484 bp, Zea mays
  misc_feature: Ceres CLONE 311088-F
  misc_feature: Encodes the peptide sequence at SEQ ID NO. 4826
gcacgtttcagaccctcacccattggaaaggtttagaaagttagctaggtttcagcctctcgcactgctcgtgcctcgagcacaacggtggcggcgacggcagcgggactgttctggccgacgacggcatcgacgacgacgaggagtgttaaaacagctcgttgttttgggatttgctgcctcaagtttcatctagctacctccaacaaacccttcaatctccatggctacatcggacaagaaaacaaggggctatgttccttggaatgatgagatggataaggtactccttgatacatttgtggactattacaataaaagtgatagatgtcagaatgggtggaagtctcatgtatacacagttgctgtgaagaatgtttgtgagaagtgtaatgtcaccattacaaaggaaaatattagctctcgcagcaagaactttgataagcactacaatatcattaatggtttgttgtccactagtggt

SEQ ID NO: 4826 - protein, 87 aa, Zea mays
  misc_feature: Ceres CLONE 311088-F
MATSDKKTRGYVPWNDEMDKVLLDTFVDYYNKSDRCQNGWKSHVYTVAVKNVCEKCNVTITKENISSRSKNFDKHYNIINGLLSTSG

SEQ ID NO: 4827 - DNA, 828 bp, Zea mays
  misc_feature: Ceres CLONE 311104-R
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
tttaattaaataaaaactaatatacagngnngnnnnnntttaataaaaaccaattgggtccgggccccccctcgaggtcgagttttcgatattttttttttttttttttcatcaaaaacgcttttatggggaacagagttgctggagtttccacggaacatcaaaacgtagagtggagtcccaaccaccctcttaaaatgaaaaagactatccgacgagttggggtcatgttgaatgctgtttgaaaacaggtaaaatgcaaaacgaaactagaatcaccaaatcgtgcatgatcagataagagataaggccgaccgatcagtaggattacgaccgagaagctctattaatcctcttggaaaccacaagcgagccaaccattggtgcgattgaactggttttttatgtggccccagattccaatcttatacccccacactctgaacccgcggggtcacggacggtcaaaaattttaaaacattctgtttttctcctatagaacaaaaaaacggggtaacttcctaagggaacctattacccaccggcttgtatactatcgttaaacaaaatacgtctttttctgaggcccctgggggaataagggcgatgtacaaaaaaagacggggtgcgtattttgggggtggccgcgagtcctcccccccccaatattctctgcgatagcgatacgactgtgtatgtagatctaaacagaacccgggtggtccttgagaaaagaggggttcgtagcggtggcggcgccagtgtgtaagctacgcctcgtgcgtgcatgtcggtatgaagcgtcctgctagaaccactggccgttc

SEQ ID NO: 4828 - DNA, 407 bp, Zea mays
  misc_feature: Ceres CLONE 311122-F
  misc_feature: Encodes the peptide sequence at SEQ ID NO. 4829
aaaagaaaaacggtgagctagaaacttccaaatcgaacggcacacaaaaatcacaacccggaaagggaccagcagcgcaaaggtgagcgagctttccttcggaactctcgtgctcacctcatccgtccgacadatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaatctgaagca

SEQ ID NO: 4829 - protein, 72 aa, Zea mays
  misc_feature: Ceres CLONE 311122-F
  misc_feature (10)..(72): Pfam Name: S1FA Pfam Description: DNA binding protein S1FA
MADQFVDSANNVIIEEVNKGLNPGMVVLLVVASFLLLFFVGNYALYVYAQKTLPPKKKKPVSKKKLKRENLK

SEQ ID NO: 4830 - DNA, 199 bp, Zea mays
  misc_feature: Ceres CLONE 311142-F
  misc_feature (156)..(156): n is a, c, t, g, unknown, or other
gagaggacgccagggccgattctctgcgtgacttggggcgtcgtcgcgagttttctccggccgagggcggcgcgaccggacaaccagcgtgasscggaccggcgacatgactcgcggcaaccagcgtgaccgcgaccgtgagcgcgcggcggsgtnaagcccaacgccaagaactcccaggacgggctcaccccggagc

SEQ ID NO: 4831 - DNA, 485 bp, Zea mays
  misc_feature: Ceres CLONE 311193-F
  misc_feature: Encodes the peptide sequence at SEQ ID NO. 4832
attagaatccacctcgcaccccgcgagcggtgacttccctagggtttagtcgcgccgccgccgccgccgaaacagcacatcgctctctcgatctcagccatggcggaaggtggagcagccccaggacgcggtgaagctcttcaaccgctcgaccttcacgatgtccaggtgaacgatatctcgctgaacgactacctggctgtgactgcggcgamsacgcgaacattcctgccgcactccgcggggcgctactccaagaagcggttccgcaaggcgcagtgcsattccgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgttgaggatgccacccgtattggttctgctggtgttg

SEQ ID NO: 4832 - protein, 117 aa, Zea mays
  misc_feature: Ceres CLONE 311193-F
  misc_feature (44)..(118): Pfam Name: Ribosomal_S7 Pfam Description: Ribosomal protein S7p/S5e
  misc_feature (39)..(39): Xaa is any aa, unknown, or other
  misc_feature (62)..(62): Xaa is any aa, unknown, or other
MAEGGAAPGRGEALQPLDLHDVQVNDISLNDYLAVTAAXTRTFLPHSAGRYSKKRFRKAQCXSVERLTNSLMMHGRNNGKKVMAVRIMKHTLEIIHLLTDANPIQVVVDAIINSGPR

SEQ ID NO: 4833 - DNA, 471 bp, Zea mays
  misc_feature: Ceres CLONE 311202-F
  misc_feature: Encodes the peptide sequence at SEQ ID NO. 4834
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcktgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacssagatggcgacggaggcgtccctgtcgtgcgtccgctcgtggggcggcgcgctctcg

SEQ ID NO: 4834 - protein, 129 aa, Zea mays
  misc_feature: Ceres CLONE 311202-F
  misc_feature (10)..(129): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (38)..(38): Xaa is any aa, unknown, or other
  misc_feature (111)..(111): Xaa is any aa, unknown, or other
MVSSSMDTTSDKRASSMLAPNPGKATILALGHAFPQQXVMQDYVVDGFMKNTNCDDPELKEKLTRLCKTTTVRTRYVVMSDEILKNYPELAQEGLPTMNQRLDISNAAVTXMATEASLSCVRSWGGALS

SEQ ID NO: 4835 - DNA, 418 bp, Zea mays
  misc_feature: Ceres CLONE 311209-F
  misc_feature: Encodes the peptide sequence at SEQ ID NO. 4836
  misc_feature (53)..(53): n is a, c, t, g, unknown, or other
aaggatcatcatcatcagaagcagcagcaaggcaacatgtctcagcacggcgncctcggcgacacggcccggcggtggcgcgagctccacggcgacggcggctgggcgggaacgctggacccgctggacctcgacctgcggcgcaccgtgctccgctacggcgagatggcgcaggcgacctacgacgccttcaacaacgagcgggcgtcgcgcacgcgggggctgtcccgcttcgccagggcgcgcttcttcgaccgggtgcggctgccggcgcacgcgccgcgtaccgggtcaccaggttcctgtacgccacgtcgtcggtggccgtgcggacgccttcatcctcaggtccggtgtccaggtcgcgccggttgcagggagtccaacttggattcggctacgtcgcggtggccaccga

SEQ ID NO: 4836 - protein, 127 aa, Zea mays
  misc_feature: Ceres CLONE 311209-F
  misc_feature (6)..(6): Xaa is any aa, unknown, or other
MSQHGXLGDTARRWRELHGDGGWAGTLDPLDLDLRRTVLRYGEMAQATYDAFNNERASRTRGLSRFARARFFDRVRLPAHAPRTGSPGSCTPRRRWPCGRLHPQVRCPGRAGCRESNLDSATSRWPP

SEQ ID NO: 4837 - DNA, 202 bp, Zea mays
  misc_feature: Ceres CLONE 311217-F
  misc_feature (151)..(151): n is a, c, t, g, unknown, or other
  misc_feature (153)..(153): n is a, c, t, g, unknown, or other
aaccgccacccgcaccgccgcacgcacacaccaactcctctccaacctcctcgccccgccccgtcggttcgattcggtcgaagcgggcgggcgggcgggcaggctagggatccggatgggcgcggcggcgagaaggctctaggggcgccangnaggtggtggtccgtggggactgggaggggagggcggcgatggaggagaa

SEQ ID NO: 4838 - DNA, 206 bp, Zea mays
  misc_feature: Ceres CLONE 311218-F
atttgaggctttgagctatggtttatggaaagcttgccggcctttgacgctggaaggagaaaccagtcagtctccggcgctgcccctccgccgtggccggssacgggtggaggcagtatgtgagcgagagacagtgggcagccggagacgsgttgtccctctgaaggcctcacgacctgccggcttctgatggccacgagcgcgtg

SEQ ID NO: 4839 - DNA, 282 bp, Zea mays
  misc_feature: Ceres CLONE 311223-F
  misc_feature: Encodes the peptide sequence at SEQ ID NO. 4840
gtacaggtcgcaacaaccccgacgagcaaacccacccatttgccaccaaccccgacgagcggcgatgaccggcacgtgtccaagctggcggcgcccgtccggcagcaccgccgctccggccggcgtccctccgcactgccgccctcgccttcgccccctccccgcgccggtccgcgtctccgtcgccgggcgagccaggagccccatcattgcgatggcttcggccaaggaaggaaatggtgcaccgaccaagaggactgcgcttcatgatctttacgagct

SEQ ID NO: 4840 - protein, 72 aa, Zea mays
  misc_feature: Ceres CLONE 311223-F
MTGTCPSWRRPSGSTAAPAGVPPHCRPRLRPLPAPVRVSVAGRARSPIIAMASAKEGNGAPTKRTALHDLYE

SEQ ID NO: 4841 - DNA, 449 bp, Zea mays
  misc_feature: Ceres CLONE 311226-F
  misc_feature: Encodes the peptide sequence at SEQ ID NO. 4842
  misc_feature (280)..(280): n is a, c, t, g, unknown, or other
  misc_feature (281)..(281): n is a, c, t, g, unknown, or other
  misc_feature (354)..(354): n is a, c, t, g, unknown, or other
ctcctcgttccctcgagaactgtaccatcacgcgccgcccgcccgcccttgattgagcagggactgggagagagggtgaaagggggcaagaaaacgcttcttgttgccgctgtgcttctgcggatccgcggtggctgcgcacgccggcggggaagaggagtcgctggcggcgcgcctccagtctttcttcacctccgtgctctccgggctcttcggccaggccgaggccgaggacgaggacgaagagatgcccacgcgcaaccacaacgctgccgsgctnncgctccgcagcatcaccatcacaaccgaggtggtgctcccgctcttggaaagagcaaggccgtgcccggcgangctgatgccatkaaccggcgakcccccctcggcgatattggcaacctcgtcagcgtccgcccagccgaaggaaacctcagctgcaggagcagatc

SEQ ID NO: 4842 - protein, 149 aa, Zea mays
  misc_feature: Ceres CLONE 311226-F
  misc_feature (94)..(94): Xaa is any aa, unknown, or other
  misc_feature (118)..(118): Xaa is any aa, unknown, or other
  misc_feature (122)..(122): Xaa is any aa, unknown, or other
  misc_feature (126)..(126): Xaa is any aa, unknown, or other
LLVPSRTVPSRAARPPLIEQGLGERVKGGKKTLLVAAVLLRIRGGCARRRGRGVAGGAPPVFLHLRALRALRPGRGRGRGRRDAHAQPQRCRAXAPQHHHHNRGGAPALGKSKAVPGXADAXNRRXPLGDIGNLVSVRPAEGNLSCRSR

SEQ ID NO: 4843 - DNA, 503 bp, Zea mays
  misc_feature: Ceres CLONE 311239-F
  misc_feature: Encodes the peptide sequence at SEQ ID NO. 4844
  misc_feature (197)..(197): n is a, c, t, g, unknown, or other
  misc_feature (198)..(198): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgcvsdwmmcgcagcagnntgtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcggtgacssagatggcgacggaggcgtccctgtcgtgcgtccgctcgtggggcggcgcgctctcgtccatcacccacctcgtgtacgtctcgtcgag

SEQ ID NO: 4844 - protein, 61 aa, Zea mays
  misc_feature: Ceres CLONE 311239-F
  misc_feature: SWISSPROT Homolog: EC 2.3.1.95 Trihydroxystilbene synthase
  misc_feature (33)..(33): Xaa is any aa, unknown, or other
MSDEILKNYPELAQEGLPTMNQRLDISNAAVTXMATEASLSCVRSWGGALSSITHLVYVSS

SEQ ID NO: 4845 - DNA, 102 bp, Zea mays
  misc_feature: Ceres CLONE 311286-F
aaacacgcacaccgcgacccagtccagagccagtacgtgcgamggcacgcacgctgctggtccgcgtacgagacgacggtcaggtcggccggtgcttttcag

SEQ ID NO: 4846 - DNA, 438 bp, Zea mays
  misc_feature: Ceres CLONE 311289-F
  misc_feature: Encodes the peptide sequence at SEQ ID NO. 4847
  misc_feature (183)..(183): n is a, c, t, g, unknown, or other
  misc_feature (185)..(185): n is a, c, t, g, unknown, or other
acgcaacctcccactgcattctcgaattccgattcccaatccagcaaaccctaccagccttttgcaaactcagagagggacccgatggcacccaaggcggagaagaagccggcggragaagcccgcagaggaggagcccgcggccccggcggagaaggctcccgctgggaagaagccgavsgnangaagcggctcccggcggtaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggsgcccaagctcgcccgttacaacaagaagcccaccattcacctc

SEQ ID NO: 4847 - protein, 118 aa, Zea mays
  misc_feature: Ceres CLONE 311289-F
  misc_feature (58)..(118): Pfam Name: Histone Pfam Description: Core histone H2A/H2B/H3/H4
  misc_feature (11)..(11): Xaa is any aa, unknown, or other
  misc_feature (32)..(32): Xaa is any aa, unknown, or other
  misc_feature (33)..(33): Xaa is any aa, unknown, or other
  misc_feature (34)..(34): Xaa is any aa, unknown, or other
  misc_feature (104)..(104): Xaa is any aa, unknown, or other
MAPKAEKKPAXEARRGGARGPGGEGSRWEEAXXXKRLPAVKSAGKEGGVDKKGRKKAKKSVETYKIYIFKVLKQVHPDIGISSKAMSIMNSFINDIFEKLAGEXPKLARYNKKPTIHL

SEQ ID NO: 4848 - DNA, 236 bp, Zea mays
  misc_feature: Ceres CLONE 311304-F
  misc_feature: Encodes the peptide sequence at SEQ ID NO. 4849
gcgtcaccgtcttctccatcgccggdgctcccttactctcgatggcatccccggccgccgctcgccgccttctcctcctccgccaccgccatgggcaccttctccccaaacgccacttctcttcctcatccgctcctgacggcctcgatggcggcggtggccggktcaagatcttcgaccgcgacctgaagcgccggcaccgggaccgcgcggcgtgggcgatkcgtgagaccgat

SEQ ID NO: 4849 - protein, 65 aa, Zea mays
  misc_feature: Ceres CLONE 311304-F
  misc_feature (42)..(42): Xaa is any aa, unknown, or other
  misc_feature (61)..(61): Xaa is any aa, unknown, or other
MASPAAARRLLLLRHRHGHLLPKRHFSSSSAPDGLDGGGGRXKIFDRDLKRRHRDRAAWAXRETD

SEQ ID NO: 4850 - DNA, 320 bp, Zea mays
  misc_feature: Ceres CLONE 311352-F
  misc_feature: Encodes the peptide sequence at SEQ ID NO. 4851
  misc_feature (177)..(177): n is a, c, t, g, unknown, or other
ctctctctctcggctctcggtagtccgatccascaaaccatgtcgggcagccaggtcggcggcggcgggctgcgagggtggagccctttcgacgcgatccgcagcttcccgtcgacgcccgagtcgctcatgtcgcagatcgacgcggccatcgtctccaccgagtacgcccgcgcntgcgccctcctcgacccctcccaagtctcagcctcgtcgcsgcccgagaccgagcccgagggccagggggaccgrggagcctcccctctgcctccgcctgctacgacgcgagggtcgcggacgaggcgtaccgcgcggcgtgc

SEQ ID NO: 4851 - protein, 93 aa, Zea mays
  misc_feature: Ceres CLONE 311352-F
  misc_feature (60)..(60): Xaa is any aa, unknown, or other
MSGSQVGGGGLRGWSPFDAIRSFPSTPESLMSQIDAAIVSTEYARACALLDPSQVSASSXPETEPEGQGDRGASPLPPPATTRGSRTRRTARR

SEQ ID NO: 4852 - DNA, 108 bp, Zea mays
  misc_feature: Ceres CLONE 311356-F
acgcacaccgcgacccagtccagagccagtacgtgcgamggtcacgcacgctgctggtccgcgtacssagacgacggtcaggtcggccggtgcttttcagtttggaat

SEQ ID NO: 4853 - DNA, 474 bp, Zea mays
  misc_feature: Ceres CLONE 311363-F
  misc_feature: Encodes the peptide sequence at SEQ ID NO. 4854
  misc_feature (34)..(34): n is a, c, t, g, unknown, or other
  misc_feature (338)..(338): n is a, c, t, g, unknown, or other
  misc_feature (341)..(341): n is a, c, t, g, unknown, or other
  misc_feature (446)..(446): n is a, c, t, g, unknown, or other
atcaatcctcatcgccacccaacccgccgagtcncaagcaagttgagcatccatccatccatggcgggaggcaagtccaccggcaatgcsscgcgcassaggaagcgcgtcgaggcaaccgtcctcaagckctccagggacgggagcgcttcaccagatgcgaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaanttncgcccaccgccttcttcctcttcatggacgactttcaggaaggagttcaaggccacccatcctgacaacaagagtgtcgctaccgttgcaaaggaaggagggganaggtggaagtccatgacagacgaggaga

SEQ ID NO: 4854 - protein, 157 aa, Zea mays
  misc_feature: Ceres CLONE 311363-F
  misc_feature (11)..(11): Xaa is any aa, unknown, or other
  misc_feature (30)..(30): Xaa is any aa, unknown, or other
  misc_feature (32)..(32): Xaa is any aa, unknown, or other
  misc_feature (33)..(33): Xaa is any aa, unknown, or other
  misc_feature (112)..(112): Xaa is any aa, unknown, or other
  misc_feature (113)..(113): Xaa is any aa, unknown, or other
  misc_feature (148)..(148): Xaa is any aa, unknown, or other
QSSSPPNPPSXKQVEHPSIHGGRQVHRQCXAXXEARRGNRPQALQGRERFTRCEACNKDVPVVLIDMHSCSLDEKIRMTLEAQVVEKTVEVASADRKKSSAKGGGNKDAKRXXRPPPSSSSWTTFRKEFKATHPDNKSVATVAKEGGXRWKSMTDEE

SEQ ID NO: 4855 - DNA, 173 bp, Zea mays
  misc_feature: Ceres CLONE 311368-F
  misc_feature (59)..(59): n is a, c, t, g, unknown, or other
  misc_feature (162)..(162): n is a, c, t, g, unknown, or other
attcgcaacacaatcgtcctccgccaccctccattaaccctagcggcassagcgctcgntttgatccccgcggcggttccggcgtccgggttaggggagcgaggatgacggagycctggtgcggaacaagccggggatggccagcatcaaggagatgccggntgctgcaggac

SEQ ID NO: 4856 - DNA, 96 bp, Zea mays
  misc_feature: Ceres CLONE 311386-F
aaaaaatactcccgtgttcttcgaccggcggcggtggtgcgamgagtgcggttaagtgagacgagatgagggggacgaagcggccgctcggcgtgg

SEQ ID NO: 4857 - DNA, 414 bp, Zea mays
  misc_feature: Ceres CLONE 311406-F
  misc_feature: Encodes the peptide sequence at SEQ ID NO. 4858
acaggtcttccgagaagcaagcacaagcactgcaccgaacgagcagcgagcgtgttgaggcaggcagtcagtggcagtgggagtaggagacaaggctaccgatatgaagggcctcttgttgctcgtcctcgccctggtcgcgtccgctgcatgcctcgtgaccgtccgcggcgcggcgagtgcggggcgacgcgccggacaggatggcgctgaagctggcgccgtgcgttccgcggcgcagtaaccccagctcggcgccgtccaacgctgytgcacggcggtgcacaccatcgggaagcagagcccccagtgcctctgcgccgtcatgctgtccaagacggccaakaagtccgggatcaagcccgaggtggccatcaccatccccaagcgctgcaacctcgtcgaccgccccgt

SEQ ID NO: 4858 - protein, 29 aa, Zea mays
  misc_feature: Ceres CLONE 311406-F
  misc_feature (7)..(7): Xaa is any aa, unknown, or other
MLSKTAXKSGIKPEVAITIPKRCNLVDRP

SEQ ID NO: 4859 - DNA, 630 bp, Zea mays
  misc_feature: Ceres CLONE 311460-R
  misc_feature: Translation starting site: 214
  misc_feature: SWISSPROT Homolog: EC 1.15.1.1 Superoxide dismutase
tcgaggtcgacgttctcgataagctttttttttttttttttttaacgcaacccagacgacgatagaattgattatttatcggagcacaagcaactccgctccgcacaaattagcagtaacaagcgtggtcagcaatgtctcgaaccaaaccaaccgaagacgaacaaatcgaactgcacaccgcggggatttattattgagaaaatcaagggaatgcagacattggatctctacttgggcgcgaagttggccttgatgtggtccacctcgccgctgctgatgcggaaggccttggcgaggatgtcggagggcacgggcggcacggcgccgaagagcgtcatggcgatggcctgcgtgccctggagctggctgttgaaggcggcgacgacggcggcggggccgtggcccctgttctgctggaagtggacgaggccgcgcgggaagacgaagacgtcgcccttggtgacggtcttggtgaaaagcgcgttggcggtggtgatgaagccgacctcgagcgtgccctcgaggacgaagatgatctcggtggcccgcgggtgcatgtgcgggcggttcttgcccccccgcgcgtagtcgatgccccccctggagaccccccaccgtgttcacgcc

SEQ ID NO: 4860 - DNA, 734 bp, Zea mays
  misc_feature: Ceres CLONE 311461
  misc_feature: Encodes the peptide sequence at SEQ ID NO. 4861
aaaatgtgggtggcgagaaacgacgaggtcttggtgcgtgacccaatccgatcaatataatcagagtcagtgtgactgtgagcagagcaagcagtatagggcgagcttcagccatggaaaagagaagcaatggtagtgccagcctcgtcctcggccttctgatggccgcctccctgtcgtgccagtgccacggcgcgcgcgacgtccccgcggagaagcccctccggccacagaacgtgttcgggttcggcggcttctacccgggccccaccgtcaactgggtgttcccgggccccaacggcgtcaccccgcaggtcggcttcggcgggatgccgggctctagcgccttcccgggcggcggtggcgtggtcggcatccacggtggtgctggtgctggtgccggtgccggtgccgtggcgaagaagccgtgagaggaggtggccgtgtgtctgtgagcttgcgatgctttgtgagagtgttgtcagtacgtggcataagcgaagtctgtgtcttgttcttgctgcggctggctgtcgagacttcactctcgtacgtgtctcgtgtccctttttatcctgtagtatttgtgtgcgaaggacttctttctcatcatatggtagccggctgctagtgtacatctcgaaccccttttcttctcggcgtgtgtttattcagttctgtattgtatccccctatgttagcatggatgctgattaggaaaaaaaaaaaaaaaa

SEQ ID NO: 4861 - protein, 105 aa, Zea mays
  misc_feature: Ceres CLONE 311461
MEKRSNGSASLVLGLLMAASLSCQCHGARDVPAEKPLRPQNVFGFGGFYPGPTVNWVFPGPNGVTPQVGFGGMPGSSAFPGGGGVVGIHGGAGAGAGAGAVAKKP

SEQ ID NO: 4862 - DNA, 381 bp, Zea mays
  misc_feature: Ceres CLONE 311472-F
  misc_feature: Encodes the peptide sequence at SEQ ID NO. 4863
agaaaaaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccassggcgaggcgcgcgctggtcgtggaggcccggggcggcaggggctggtcggagcggcagatgcagcagcagcgccgcgcgccgctsstcggaaaaaatccgagggacgacggcaacccgcgattcgtcatcttcatccgcaccgccaatgtctactttctggtacccgctcaacatcatcacgggcggtacgacgggcgaagatcattgctcg

SEQ ID NO: 4863 - protein, 126 aa, Zea mays
  misc_feature: Ceres CLONE 311472-F
  misc_feature (56)..(56): Xaa is any aa, unknown, or other
  misc_feature (85)..(85): Xaa is any aa, unknown, or other
KKEHAAPSNKEGPRFHGGGGRRVAEAVASAGAYPDYPATRRRRRTLPSPPGRGAPXARRALVVEARGGRGWSERQMQQQRRAPLXGKNPRDDGNPRFVIFIRTANVYFLVPAQHHHGRYDGRRSLL

SEQ ID NO: 4864 - DNA, 408 bp, Zea mays
  misc_feature: Ceres CLONE 311495-F
assgatcacacaccactccacagcagtagcaagagggatagagcaaggccacacacacacacaccactaggctaggttagccttttagtcgtcgtcgaggagcaagaagggcgcgcacssaagcaggcaagcaagaagagagccgatssgacssgagagctagcacgcgatgggcgaggtcttccaagatgatgggttgcggcactctgctggccctggccctgggccgtgtcgaccgccgaggcgaggaacatcaagacgacgacgacggagaagaaggacgacgcggtggttgcagccgcagacattcccgcccttcgaccgcctcggcgcggcgcgtccccggcgttcggcggcctccccggcggcassattcctggcagcagcattcccgggttcagcatgccc

SEQ ID NO: 4865 - DNA, 395 bp, Zea mays
  misc_feature: Ceres CLONE 311525-F
  misc_feature (87)..(87): n is a, c, t, g, unknown, or other
  misc_feature (98)..(98): n is a, c, t, g, unknown, or other
  misc_feature (210)..(210): n is a, c, t, g, unknown, or other
aagaaccaacgtgctcgatctccatctcgaccgtcgctcaccgggaagctacgctacgacgaagcatggcgkccgtcaccgcccgcnccccggtcgcnccctgcgcccgtcggcgtctctcaagtcgtcgtcgtcgtcggcggcggccttccttggccactctagccgcctcggccgcactgctaccgcgtcgccgacgaggccasstanaaggcggaggccaagggcgagtggctcccgggccttccctcccccgcctacctcgacggcagcctgccgggtgacaatggcttcgacccgttggcctggcggaggacccggagaacctgaggtgktacgtgcaggcggactggttgaacgggcggtgggcgatgctgggcgtggccgggatgctg

SEQ ID NO: 4866 - DNA, 389 bp, Zea mays
  misc_feature: Ceres CLONE 311555-F
  misc_feature (143)..(143): n is a, c, t, g, unknown, or other
agaaaagggcggataaactgcttgaactggaagcgaccctagtccaaaccaccgcaccgacaccgactccgagccccgccgcgccgcgctacctccgctcctctcttcgcccctgccggcgtcgaggccgaagcgaaggcgangcatgcatcacgaccccaaccccttcgacgagggcagcgcgaggacaaccccttctcaaatggaggagccggasstcaagcagcagtacggcttccggccgactgagcccgtcgggttcggcggcgctacaggggcgacgcgtcgttggacgtcccgctcgagaccatgggggactctcggagcaaggtgaaggagctctcgtcgtgggaatcagatctgaagcggcgagaggcggatatcaagag

SEQ ID NO: 4867 - DNA, 377 bp, Zea mays
  misc_feature: Ceres CLONE 311579-F
  misc_feature: Encodes the peptide sequence at SEQ ID NO. 4868
aaaaaaaccgttccatgccacaacaagacccagaacccacaatctttctttgtgcacagaaagaagaaagaacctatggcacagtcgtcgtccgcctccgtcaagctgctggttctggttgtcctccctgcgctcctcctgttcctcgtccaagcgcaaggggctcggccagcggsggcgaacacgacgaccccgacccccgccaccaccaccgggtgcgcggcgtcgagcgtgacggtgtcgcagtccaacacgggcgacagggccgggtacgacccggtgttcgaggtgacggtgagcaacgcctgccgctgcgccgtccgcgccgtgssctccgctccgagggcttcgcagctcggtgcccgtggacccgcgcc

SEQ ID NO: 4868 - protein, 100 aa, Zea mays
  misc_feature: Ceres CLONE 311579-F
  misc_feature (34)..(34): Xaa is any aa, unknown, or other
  misc_feature (86)..(86): Xaa is any aa, unknown, or other
MAQSSSASVKLLVLVVLPALLLFLVQAQGARPAXANTTTPTPATTTGCAASSVTVSQSNTGDRAGYDPVFEVTVSNACRCAVRAVXSAPRASQLGARGPA

SEQ ID NO: 4869 - DNA, 499 bp, Zea mays
  misc_feature: Ceres CLONE 311604-F
  misc_feature: Pfam Name: ETC_C1_NDUFA5 Pfam Description: ETC complex I subunit conserved region
aaacctacgaagagccgactcaaccgctagtacagtccacacatgacacaacgacaccaactgtcctcaatccagcagccctcgagtctcgtccccgcacatcagcagagagacgccactaccaccaccgcaagcgacgacggggagatgtttctgcgacggatcctgaccggcggaggtggcctggcggcgctgagggcggcgcgcgcgtgaaaggagacgacggggatcgtcggccttgaggtggcgcccaacgcgcgggaggttctcatcgggctctacacgcgtacgctcaaggagatcgaggccgtccccaaagacgagggctaccgcaagccgttgagtccttcaccaatcaccgcctccagatctgccaggaggaggacgactggaagcgcatcgaggaccgaatcggatgcgggcaagtcgaggagctcatcgaggaggccgagggacgagctcaagctcatcgccaaaatgattgaatgggaatcgtggg

SEQ ID NO: 4870 - DNA, 371 bp, Zea mays
  misc_feature: Ceres CLONE 311608-F
  misc_feature: Encodes the peptide sequence at SEQ ID NO. 4871
atacggcataccacactagagccgccgccgccgccgccgctgccgtttcgcgcaccgtaccctagccctcgtcagcggcggcttcgagctcctccagccatgacgttcaagcggaggaatggcggacgcaacaagcacgggcgcggtcacgtcaagtacatccgctgctccaactgtgccaagtgctgccccaaggataaagctatcaagcggttcttggtgaggaacattgttgagcaggctgccgtgagagatgtgcaggaggcctgtgtacatgatggatatgttctaccyaaattgtatgcaaaggttcatcactgtgtctcatgcgcaatccatgcgcacattgtccgtgtccgctctcgtgagaa

SEQ ID NO: 4871 - protein, 90 aa, Zea mays
  misc_feature: Ceres CLONE 311608-F
  misc_feature (1)..(90): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRE

SEQ ID NO: 4872 - DNA, 350 bp, Zea mays
  misc_feature: Ceres CLONE 311619-F
  misc_feature: Translation starting site: 156
  misc_feature (89)..(89): n is a, c, t, g, unknown, or other
  misc_feature (217)..(217): n is a, c, t, g, unknown, or other
  misc_feature (218)..(218): n is a, c, t, g, unknown, or other
aatctgacgtcctgctgctgttccctccaatccaacgaactgaccacaaccacctaagctaaaagctaaccaccagacccccggccatngcgctcgcgccacttccgctgccgtgctcaagaccccgttcctcggggccaggcgcgcgctcgccaatgccgccgccaagcccgcgcctcgccgcgcgctggtcgtcgccgccgcggccgccgccawnnagtcgtggatcccggccatcaagagcgacgccgagatcgtgaacccgccctggctcgacggctcgctccccggcgacttcgggttcgacccgctggggctgggcaaggacccggcgttcctcaagtggtacc

SEQ ID NO: 4873 - DNA, 479 bp, Zea mays
  misc_feature: Ceres CLONE 311660-F
  misc_feature: Encodes the peptide sequence at SEQ ID NO. 4874
aagaaatgcgtcaggggttgtgaagggaaggagtgccgatggccggtggcacccggcgccgctgcggccggtggtggttgcgatgaaaggccacccagggtctggcaagtccacgtcggcgcgcgccattcgcgaccgcgctttgctgtccgctcctggacaaggacgatgtgagggactgcatgttgcccctagaggcttggctgctgctgggctgctcaacgacctctcctacgccgtgctgtggcggatggccgagcgccaggtaaggctcggactgtctgtcgtcatcgatttcaccgctgtcacgccgctctcacctcgacatgctgacacgcctagccggtgtgcttgtggtcgtcgtggagtgwtcgccctggtgataacgaggaatggcgccggacgttgtkatagccgtggggtcggctgttgccaatggtggcggtggtgatggattggcataagcaaagacatgggct

SEQ ID NO: 4874 - protein, 149 aa, Zea mays
  misc_feature: Ceres CLONE 311660-F
  misc_feature (124)..(124): Xaa is any aa, unknown, or other
  misc_feature (137)..(137): Xaa is any aa, unknown, or other
RNASGVVKGRSADGRWHPAPLRPVVVAMKGHPGSGKSTSARAIRDRALLSAPGQGRCEGLHVAPRGLAAAGLLNDLSYAVLWRMAERQVRLGLSVVIDFTAVTPLSPRHADTPSRCACGRRGVXALVITRNGAGRCXSRGVGCCQWWRW

SEQ ID NO: 4875 - DNA, 421 bp, Zea mays
  misc_feature: Ceres CLONE 311676-F
  misc_feature: Encodes the peptide sequence at SEQ ID NO. 4876
  misc_feature (338)..(338): n is a, c, t, g, unknown, or other
gcgtcctccctgccgttccccttcttcagttctcccgctgctgctgccgccgccgctctccgtccgcgtccagatcccgccaccccaaccgatctgccggcctccagcatggcgtcgggggcgggggcgagggcgaaggcagcgggagccctggcgctggcgctcgtgctcgcgctasgtgtgccaactccgagggcgacgcgctctcggcgctgcgcscagccttcagggaccccggcggcgtgctgcagagctgggaccccacgctcgtcaacccctgcacctggttccacgtcacctgcgaccgcgacaaccgcgtcacccgcctagatcttggnaattttgaacttatctggtcatctggtgcctgagcttgggaaatttggagcatctgcagtacctggaactttacaagaacagc

SEQ ID NO: 4876 - protein, 122 aa, Zea mays
  misc_feature: Ceres CLONE 311676-F
  misc_feature (61)..(101): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (59)..(59): Xaa is any aa, unknown, or other
  misc_feature (73)..(73): Xaa is any aa, unknown, or other
VLPAVPLLQFSRCCCRRRSPSASRSRHPNRSAGLQHGVGGGGEGEGSGSPGAGARARAXCANSEGDALSALRXAFRDPGGVLQSWDPTLVNPCTWFHVTCDRDNRVTRLDLGNFELIWSSGA

SEQ ID NO: 4877 - DNA, 418 bp, Zea mays
  misc_feature: Ceres CLONE 311745-F
  misc_feature: Translation starting site: 66
  misc_feature (82)..(82): n is a, c, t, g, unknown, or other
  misc_feature (83)..(83): n is a, c, t, g, unknown, or other
  misc_feature (85)..(85): n is a, c, t, g, unknown, or other
atcacccaaaacacaagtagggttaggaaggcggcggccagcggcgagaggaggaggggtcggccatgacggggaaggcgannangaagcacacagcgaaggagatcgccgcgaacatcgacgcggsacgacgaaccggggtggcggcaaggccgggcaggcggaccggctggggcaggaagggcgggcatgcgaacgtggcgtgcccgctctgccgcaccccggcgcccgacatcaagtccatgcagatccaccacgaggcgcgccaccccaagctccccttcgagccggagaagctcctcaacctgcactcctccgcccccgctgctgctgctgccgccgccgccgccgccgccgccgctgccgaggccaccacctccaagcccaagcccggcgtccgcggcassctcaagaagta

SEQ ID NO: 4878 - DNA, 422 bp, Zea mays
  misc_feature: Ceres CLONE 311752-F
  misc_feature: Encodes the peptide sequence at SEQ ID NO. 4879
  misc_feature (53)..(53): n is a, c, t, g, unknown, or other
  misc_feature (155)..(155): n is a, c, t, g, unknown, or other
  misc_feature (389)..(389): n is a, c, t, g, unknown, or other
attccattccattcatccgctccgctccactccagtcggtcctactagtcctnccctccccgcctccccggcatcccttcgccatagcagcaccagacagcagagcaccaaacccwcdcttctttcacctcccctgccccctcctccattctccntcgcaatccgccgccgccgatggsaggccgacgcgcgcgctcctgctcccgctcctcctgctcctggtgctggcccgcgcgtcgggcgacgtgccggcggsggcgtccctcggctgggacctccgcgtggtgggcgcgggakaggacgaggagttcggcttccctggcggggactccgtggcgtgccgggtgctgcagggcggcggctacctcagctacggcgcgctgcsaggngacaacgtgccctgctccgtccggggagcctcc

SEQ ID NO: 4879 - protein, 140 aa, Zea mays
  misc_feature: Ceres CLONE 311752-F
  misc_feature (39)..(39): Xaa is any aa, unknown, or other
  misc_feature (85)..(85): Xaa is any aa, unknown, or other
  misc_feature (99)..(99): Xaa is any aa, unknown, or other
  misc_feature (128)..(128): Xaa is any aa, unknown, or other
SIPFIRSAPLQSVLLVLPSPPPRHPFAIAAPDSRAPNPXFFHLPCPLLHSPSQSAAADGRPTRALLLPLLLLLVLARASGDVPAXASLGWDLRVVGAGXDEEFGFPGGDSVACRVLQGGGYLSYGALXGDNVPCSVRGAS

SEQ ID NO: 4880 - DNA, 107 bp, Zea mays
  misc_feature: Ceres CLONE 311817-F
  misc_feature (47)..(47): n is a, c, t, g, unknown, or other
atcaccaatcagtcagtcacagctcacagcaaacaccgcgamggccnccgctcccaaacccgaccgagcaaagcgcaaagccccccaaccgcggatcaatccgcagc

SEQ ID NO: 4881 - DNA, 91 bp, Zea mays
  misc_feature: Ceres CLONE 311840-F
  misc_feature: Encodes the peptide sequence at SEQ ID NO. 4882
gacggacgagacgaggcacggaaacggagcgagccagactacccacctaggcccagcggcatgaggggcagcgagatgttgaccgccgccg

SEQ ID NO: 4882 - protein, 30 aa, Zea mays
  misc_feature: Ceres CLONE 311840-F
DGRDEARKRSEPDYPPRPSGMRGSEMLTAA

SEQ ID NO: 4883 - DNA, 347 bp, Zea mays
  misc_feature: Ceres CLONE 311853-F
  misc_feature: Encodes the peptide sequence at SEQ ID NO. 4884
  misc_feature (191)..(191): n is a, c, t, g, unknown, or other
gcatcccatctccatccccatccatagagctgcaggggcctgcgctgcrccaacaagctcatcagctcaccgtacctaggaggacgaccgagcagctaaggtagtagtagctagctagccagtgatggcggctacaaagcgcagggcggggcgctcggcgtcgtcctggctgtcgccgcgctcttcgcggncasgaattgggcgatggcggtggacgacgagcacatgtaccactggaaktgcttccaagtcgtgcacggggaactgccgckacgaggacgcctttgacgacgtcgtsscccgccactccgagggytcctcccacgtcgtcgtcgctgccgtctccg

SEQ ID NO: 4884 - protein, 74 aa, Zea mays
  misc_feature: Ceres CLONE 311853-F
  misc_feature (23)..(23): Xaa is any aa, unknown, or other
  misc_feature (24)..(24): Xaa is any aa, unknown, or other
  misc_feature (39)..(39): Xaa is any aa, unknown, or other
  misc_feature (50)..(50): Xaa is any aa, unknown, or other
  misc_feature (59)..(59): Xaa is any aa, unknown, or other
MAATKRRAGRSASSWLSPRSSRXXIGRWRWTTSTCTTGXASKSCTGNCRXEDAFDDVVXRHSEGSSHVVVAAVS

SEQ ID NO: 4885 - DNA, 262 bp, Zea mays
  misc_feature: Ceres CLONE 311881-F
  misc_feature: Encodes the peptide sequence at SEQ ID NO. 4886
  misc_feature (104)..(104): n is a, c, t, g, unknown, or other
  misc_feature (108)..(108): n is a, c, t, g, unknown, or other
  misc_feature (110)..(110): n is a, c, t, g, unknown, or other
aacaacaccagaatccgcgaatcacagacgcgtctatctcagcttgctgcactgcactaccctgccctgccatcatatcgtacgtgagcccggccgagcgagangggnankaggcatggctgctccgaagctcgcgacgctggcgctggccgtgctcctggcggcgaccgtggtggctcccccggccgcggtgcgcgcgkgaattgtcgtgctccaccgtgtacagcacgctgatgccgtgcctgccgttcgtccagatggg

SEQ ID NO: 4886 - protein, 49 aa, Zea mays
  misc_feature: Ceres CLONE 311881-F
  misc_feature (29)..(29): Xaa is any aa, unknown, or other
MAAPKLATLALAVLLAATVVAPPAAVRAXIVVLHRVQHADAVPAVRPDG

SEQ ID NO: 4887 - DNA, 117 bp, Zea mays
  misc_feature: Ceres CLONE 311906-F
acacgcacaccgcgacccagtccagagccagtacgtgcgamgcaacgcacgctgctggtccgcgtacssagacgacggtcaggtcggccggtgcttttcagtttggaataatgacgg

SEQ ID NO: 4888 - DNA, 111 bp, Zea mays
  misc_feature: Ceres CLONE 311907-F
acacgcacaccgcgacccagtccagagccagtacgtgcgamgtcacgcacgctgctggtccgcgtacssagacgacggtcaggtcggccggtgcttttcagtttggaataa

SEQ ID NO: 4889 - DNA, 128 bp, Zea mays
  misc_feature: Ceres CLONE 311920-F
acgcacaccgcgacccagtccagagccagtacgtgcgamggccacgcacgctgctggtccgcgtacssagacgacggtcaggtcggccggtgcttttcagtttggaataatgacggcgacgacgacga

SEQ ID NO: 4890 - DNA, 184 bp, Zea mays
  misc_feature: Ceres CLONE 311932-F
  misc_feature (108)..(108): n is a, c, t, g, unknown, or other
  misc_feature (109)..(109): n is a, c, t, g, unknown, or other
aaaaaaccaacgtgctcgatctccctccgccactccatccatctcctcgctcccattccccgggaagctacgaagcatggcgtccgtcaccgcccgcgccccggwcgnncccttcgcccgtcgtcggcatcgctcaagtcgtcgtcggccttccttggccactctagccgcctcggcckcaccg

SEQ ID NO: 4891 - DNA, 223 bp, Zea mays
  misc_feature: Ceres CLONE 311992-F
  misc_feature: Encodes the peptide sequence at SEQ ID NO. 4892
  misc_feature (54)..(54): n is a, c, t, g, unknown, or other
  misc_feature (177)..(177): n is a, c, t, g, unknown, or other
aaaaaaatttcgaaacgagaggtgtctgcctgtcacttgcgaagaaatcgcganggggwacktgacacctgacgagctgagcaggcaggcggtagtggccgagcgaaassatcctcgatctcgtatcgtagctgccgccgctcagagcaatggagagggcggtgcagttcggaagtngcacaccaacacggccgaccttctctcctggtcggccacgggcctg

SEQ ID NO: 4892 - protein, 74 aa, Zea mays
  misc_feature: Ceres CLONE 311992-F
  misc_feature (18)..(18): Xaa is any aa, unknown, or other
  misc_feature (20)..(20): Xaa is any aa, unknown, or other
  misc_feature (21)..(21): Xaa is any aa, unknown, or other
  misc_feature (36)..(36): Xaa is any aa, unknown, or other
  misc_feature (37)..(37): Xaa is any aa, unknown, or other
  misc_feature (59)..(59): Xaa is any aa, unknown, or other
KKFRNERCLPVTCEEIAXGXXTPDELSRQAVVAERXXPRSRIVAAAAQSNGEGGAVRKXHTNTADLLSWSATGL

SEQ ID NO: 4893 - DNA, 390 bp, Zea mays
  misc_feature: Ceres CLONE 312009-F
  misc_feature: Encodes the peptide sequence at SEQ ID NO. 4894
  misc_feature (122)..(122): n is a, c, t, g, unknown, or other
aggatcatcatcatcagaagcagcagcaaggcaacatgtctcagcacggcggcctcggcgacacggcccggcggtggcgctasstccacggcgacggcggctgggcgggaacgctggacccnctggacctcgwtcctgcggcgcaccgtgctccgctacggcgagatggcgcaggcgacctacgacgccttcaacaacgagcgggcgtcgccgcacgcgggggctgtcccgcttcgccagggcgcgcttcttcgaccgggtgcggctgccggcgcacgssccgcgttaccgggtcaccaggttcctgtacgccacgtcgtcggtggccgtgcggacgccttcatcctcaggtccgtgtccagggtcgcgccggtgcagggagtccaactg

SEQ ID NO: 4894 - protein, 129 aa, Zea mays
  misc_feature: Ceres CLONE 312009-F
  misc_feature (28)..(28): Xaa is any aa, unknown, or other
  misc_feature (41)..(41): Xaa is any aa, unknown, or other
  misc_feature (93)..(93): Xaa is any aa, unknown, or other
GSSSSEAAARQHVSARRPRRHGPAVALXPRRRRLGGNAGPXGPRSCGAPCSATARWRRRPTTPSTTSGRRRTRGLSRFARARFFDRVRLPAHXPRYRVTRFLYATSSVAVRTPSSSGPCPGSRRCRESN

SEQ ID NO: 4895 - DNA, 423 bp, Zea mays
  misc_feature: Ceres CLONE 312016-F
  misc_feature: Encodes the peptide sequence at SEQ ID NO. 4896
  misc_feature (41)..(41): n is a, c, t, g, unknown, or other
  misc_feature (308)..(308): n is a, c, t, g, unknown, or other
accgattccgtgtgctgttcgctgtcgcctattgcgcttgnctacttggtaactacagcgtcggccgccatcccccgcagcagccgttttctagctgcttcccgctggttcgcggccgccgtcctgggcgtctgagcgaggggtaaccctgcccttttgttcctgggctattcctcagctcgcgccgctgtcgcctcaccccccaatccaatcctccggctcygcgatcgatcggcgggcgcggatggaggcgctgaagaagcaggccagcaagctccgcgagcacgtcgccaagcagcagcaggcgntcctcaagcagttcagtacgcggtatagtcaagatccttctcttgttgatgaagcggassttgagttgccaccagaatctccaaaggctttacagtactacaagagcagctaagc

SEQ ID NO: 4896 - protein, 58 aa, Zea mays
  misc_feature: Ceres CLONE 312016-F
  misc_feature (22)..(22): Xaa is any aa, unknown, or other
  misc_feature (41)..(41): Xaa is any aa, unknown, or other
  misc_feature (42)..(42): Xaa is any aa, unknown, or other
MEALKKQASKLREHVAKQQQAXLKQFSTRYSQDPSLVDEAXXELPPESPKALQYYKSS

SEQ ID NO: 4897 - DNA, 468 bp, Zea mays
  misc_feature: Ceres CLONE 312017-F
  misc_feature: Encodes the peptide sequence at SEQ ID NO. 4898
aagaactacggcacgaccgccgacgtagcagagggatctgttcggctcccgtattcgagacccccctaccctttcgtcgacgactaggcttgcggcgaccgcccttggcttcgcgtcgssmgcatcaccagggactgacgattggcgggggagcgaatgssagatgggctgatcagaactgcgacaaggtccggttttctctctaaaccgcggtctctggaggtgggtttgctttttccgtagtcacagatggacgacgacgwtcggcagcctgggcattcggaactggggcttctatgacaccgtgaaaggcagcctcggcctgcagctcatgtcgcccatgccacctgatcgggacacgaagccactgctcccgagagctggtttcttgcagcagcatgggcatcacaatgcccacaccagctccacgcacagcagccgcargcatttaccgtgactccgctggtg

SEQ ID NO: 4898 - protein, 41 aa, Zea mays
  misc_feature: Ceres CLONE 312017-F
  misc_feature (38)..(38): Xaa is any aa, unknown, or other
MSPMPPDRDTKPLLPRAGFLQQHGHHNAHTSSTHSSRXHLP

SEQ ID NO: 4899 - DNA, 252 bp, Zea mays
  misc_feature: Ceres CLONE 312029-F
  misc_feature: Encodes the peptide sequence at SEQ ID NO. 4900
  misc_feature (46)..(46): n is a, c, t, g, unknown, or other
acacttctcacgccgcctkcccggagcctctgcatcagccaacaangcgccaccacgggactcgcgccatcttcaggcagcgcaaacacatggcgaggatactcgtcgaagcgcccgcagctcgggctcgccgggggactccatcaactcggacatgatcctcatcctcgccggcctgctctgcgcgctggtctgcgtcctcggcctgggcctcgtcgcccggtgcgcgtgctcgtggcgctgggccaccga

SEQ ID NO: 4900 - protein, 83 aa, Zea mays
  misc_feature: Ceres CLONE 312029-F
  misc_feature (15)..(15): Xaa is any aa, unknown, or other
HFSRRLPGASASANXAPPRDSRHLQAAQTHGEDTRRSARSSGSPGDSINSDMILILAGLLCALVCVLGLGLVARCACSWRWAT

SEQ ID NO: 4901 - DNA, 497 bp, Zea mays
  misc_feature: Ceres CLONE 312060-F
  misc_feature: Encodes the peptide sequence at SEQ ID NO. 4902
atccgggtccgcgcattgcactagctccccccaggctctaccagaaccgccgccgtttctggatctctcgacggcgagcagcgactcgtccggtcgtccctcagcactgtgcttggcggacgcaggacaagacacaggatgagggctgtggtgcagcgcgtcctctcggccagtgtcgaggtcgaggggcgaatagtgtctgcgatcggccctggactcctcgttctcgtcggcgtccacgaggcggacacggactccgacgccgactacatttgtcggaaggtcctgaacatgaggctgttttcaaatgacaagactggaaaagcatgggatcaaagtgttatgcagcgtaactttgaagtgctattggtcagtcagttcaccttatacggcatcctgaagggtaataagccagattttcacgtggctatgtcacctgcaaaagcgaaaccattctatgcttctctagttgagaaatttcaaaggtcatactcggc

SEQ ID NO: 4902 - protein, 119 aa, Zea mays
  misc_feature: Ceres CLONE 312060-F
  misc_feature (2)..(119): Pfam Name: Tyr_Deacylase Pfam Description: D-Tyr-tRNA(Tyr) deacylase
MRAVVQRVLSASVEVEGRIVSAIGPGLLVLVGVHEADTDSDADYICRKVLNMRLFSNDKTGKAWDQSVMQRNFEVLLVSQFTLYGILKGNKPDFHVAMSPAKAKPFYASLVEKFQRSYS

SEQ ID NO: 4903 - DNA, 488 bp, Zea mays
  misc_feature: Ceres CLONE 312076-F
  misc_feature: Encodes the peptide sequence at SEQ ID NO. 4904
agaagctcctccggtcctcccttctctccgtagaaacattttcccgacgggtgtttcccacgccggaatggaccagccggcaccataagcccaagattcgtttgcattcagtaatgcctttgcctaaatcagacctggggtcataactctttagtagagaaccaagaagatgcaggcatctagggcaaggcttttcaaggagtacaaggaggtacagcgagagaagtcagctgaccctgatatccaattaatatgtgatgattctaacatattcaagtggactgctcttatcaagggcccttctgaaacaccttatgaaggtggtgtgtttcaacttgcattcgcaattccagagcagtatcctctgctgcctcctcaagttcgatttttgaccaaaactttccacccaaatgtgcatttcaagacaggtgagatttgtctggatatattgaagaatgcatggagccctatatggaccctttcagtct

SEQ ID NO: 4904 - protein, 106 aa, Zea mays
  misc_feature: Ceres CLONE 312076-F
  misc_feature (7)..(106): Pfam Name: UQ_con Pfam Description: Ubiquitin-conjugating enzyme
  misc_feature: SWISSPROT Homolog: EC 6.3.2.19 Ubiquitin--protein ligase
MQASRARLFKEYKEVQREKSADPDIQLICDDSNIFKWTALIKGPSETPYEGGVFQLAFAIPEQYPLLPPQVRFLTKTFHPNVHFKTGEICLDILKNAWSPIWTLSV

SEQ ID NO: 4905 - DNA, 299 bp, Zea mays
  misc_feature: Ceres CLONE 312086-F
  misc_feature: Encodes the peptide sequence at SEQ ID NO. 4906
  misc_feature (99)..(99): n is a, c, t, g, unknown, or other
  misc_feature (100)..(100): n is a, c, t, g, unknown, or other
atctacccatatgcgataaaataaaatctttcaattacctgcttccggcagcggtacgatggccgcttcgagaatggcgctcgtctcttgcgcccgcynnctcccgtccttaccctctccgctcaccctctcgaggccccgcgccggcgccgtctcatttctggctgcccaaccgtcgccggcgasscaccgagatccggcagaatcttgctctcttctgttctttatcaccgacgtcgccatcgctaactgaggccgccgtagcactgccgccaccgaagctgcggtggaagagacga

SEQ ID NO: 4906 - protein, 64 aa, Zea mays
  misc_feature: Ceres CLONE 312086-F
  misc_feature (14)..(14): Xaa is any aa, unknown, or other
  misc_feature (43)..(43): Xaa is any aa, unknown, or other
MAASRMALVSCARXLPSLPSPLTLSRPRAGAVSFLAAQPSPAXHRDPAESCSLLFFITDVAIAN

SEQ ID NO: 4907 - DNA, 470 bp, Zea mays
  misc_feature: Ceres CLONE 312132-F
  misc_feature: Encodes the peptide sequence at SEQ ID NO. 4908
  misc_feature (69)..(69): n is a, c, t, g, unknown, or other
  misc_feature (70)..(70): n is a, c, t, g, unknown, or other
atcactgccaaatcccccagaaagtcaactcctccccaattccacgctgccaccaactcgccgtcctcnncgccaagcaccaaagctccgatggcccgcacgaagcagacggcgcgcaagtcaacgggcggcaaggcgccccgcaagcagctggcgaccaaggcggcgcgcaagtctgcgccggccaccggggcgtgaagaagccccaccgcttccgccccggcaccgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggctacctcgtggggctctttgaggaacactaacctgtgcgccatccacgccaagcgcgtcaccatcatgcccaaggacatccagctc

SEQ ID NO: 4908 - protein, 156 aa, Zea mays
  misc_feature: Ceres CLONE 312132-F
  misc_feature (87)..(156): Pfam Name: Histone Pfam Description: Core histone H2A/H2B/H3/H4
  misc_feature (23)..(23): Xaa is any aa, unknown, or other
HCQIPQKVNSSPIPRCHQLAVLXAKHQSSDGPHEADGAQVNGRQGAPQAAGDQGGAQVCAGHRGVKKPHRFRPGTVALREIRKYQKSTELLIRKLPFQRLVREIAQDFKTDLRFQSSAVSALQEAAEATSWGSLRNTNLCAIHAKRVTIMPKDIQL

SEQ ID NO: 4909 - DNA, 391 bp, Zea mays
  misc_feature: Ceres CLONE 312134-F
  misc_feature: Encodes the peptide sequence at SEQ ID NO. 4910
  misc_feature (309)..(309): n is a, c, t, g, unknown, or other
tccccggccgcctccccgctataaagcacctgccttgccacctctctgtcctcacgaccacacaccaccgctccacacacaagaagagagccgagagcbsagctacctagcacgcgatggcgatggcgatggcgatgtccgcttccaagatgatggcggtcgcggccgcgccctgctagccctggccctggccgtgtcgaccgccgaggcaaggaacatcaagacgacgacgacggcggcgacggagaagaaggacgacgcggtggtgcagccgcagaccttcccgcccttcgaccgcctcggcgcggncgcgtccccggcgtccggtggcctccccggcacctcgtcgggcggcagcagcattccagcgttcagcatgccgggcagcggc

SEQ ID NO: 4910 - protein, 130 aa, Zea mays
  misc_feature: Ceres CLONE 312134-F
  misc_feature (33)..(33): Xaa is any aa, unknown, or other
  misc_feature (103)..(103): Xaa is any aa, unknown, or other
PRPPPRYKAPALPPLCPHDHTPPLHTQEESREXSYLARDGDGDGDVRFQDDGGRGRALLALALAVSTAEARNIKTTTTAATEKKDDAVVQPQTFPPFDRLGAXASPASGGLPGTSSGGSSIPAFSMPGSG

SEQ ID NO: 4911 - DNA, 504 bp, Zea mays
  misc_feature: Ceres CLONE 312143-F
  misc_feature: Encodes the peptide sequence at SEQ ID NO. 4912
aaccactcgcattcgtcactcgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcsttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctgctcagctgctacattccaatgccgctttgcactttctgaagaggagaaggccgtgcagaaggagttcaagctgatcgcgagcggatgcatcgacctcctggttggtgcgatgcgc

SEQ ID NO: 4912 - protein, 139 aa, Zea mays
  misc_feature: Ceres CLONE 312143-F
MASLVVRAAGAAAAAARLPSLRPRRNGSGVLSGLRVGTGHYGARLALLRPQLLTKSSRSPALLSMTAVWARGMNMSLTPACQARMSSTISTVFSPRRLTTCSAATFQCRFALSEEEKAVQKEFKLIASGCIDLLVGAMR

SEQ ID NO: 4913 - DNA, 427 bp, Zea mays
  misc_feature: Ceres CLONE 312155-F
  misc_feature: Encodes the peptide sequence at SEQ ID NO. 4914
  misc_feature (291)..(291): n is a, c, t, g, unknown, or other
  misc_feature (294)..(294): n is a, c, t, g, unknown, or other
atctctagttctctacacaccgacacgcatgcagatcggttgccggggcacgatgaggaccgcgtggccgctgctcctcgtggcgacggcgctgctttcgacttcggcagcaagggccaggaggacctgcaggttccctgscgtcttcaacttcggcgactccaactccgacaccggcggcttctgggcggccttcccggcgcasagggtcccgttcggcatgacgtacttcggcaggccggccggcgcggcctccgacggccgcctcgtcatcgacttcatagcgcaavnttnggggctgccgctgctgagcccctacctgcagtccatagggtcggactaccgkcacgcgccaacttcgcgacgctggcgtcgacggcgctgctgcccaacacgtcggtgttcgtcaccgkgaccagccccttct

SEQ ID NO: 4914 - protein, 125 aa, Zea mays
  misc_feature: Ceres CLONE 312155-F
  misc_feature: SWISSPROT Homolog: EC 3.2.1.51 Alpha-L-fucosidase
  misc_feature (30)..(30): Xaa is any aa, unknown, or other
  misc_feature (51)..(51): Xaa is any aa, unknown, or other
  misc_feature (80)..(80): Xaa is any aa, unknown, or other
  misc_feature (81)..(81): Xaa is any aa, unknown, or other
  misc_feature (121)..(121): Xaa is any aa, unknown, or other
MRTAWPLLLVATALLSTSAARARRTCRFPXVFNFGDSNSDTGGFWAAFPAXRVPFGMTYFGRPAGAASDGRLVIDFIAQXXGLPLLSPYLQSIGSDYRHAPTSRRWRRRRCCPTRRCSSPXPAPS

SEQ ID NO: 4915 - DNA, 500 bp, Zea mays
  misc_feature: Ceres CLONE 312251-F
  misc_feature: Encodes the peptide sequence at SEQ ID NO. 4916
  misc_feature (333)..(333): n is a, c, t, g, unknown, or other
ggtcctccattcaagctccactactccacctagacttcccaatcctccattgggcaacctgtcacacagtacgccgtcgcctgtggtttggtttgtggagtgagagagaaagagagagagagacatagactcggactcggagagaaggakattgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagatcgcctgcgcgcaggacgntgagacacaagtcatcatcatcctatcccacggtgaccgtggaagccctaggagtgcaggggtcgtcgttcctggtgaacgtgttctccgacaagagctkcccggggctgctcgtcgccgttgctggaggccttcgacgagctggggctcagcgtgctccaggccac

SEQ ID NO: 4916 - protein, 115 aa, Zea mays
  misc_feature: Ceres CLONE 312251-F
  misc_feature (60)..(60): Xaa is any aa, unknown, or other
MSRERKKAAALQEKLKILRSITHSHALSNTSIIMDASAYIKELKQKVVRLNQEIACAQDXETQVIIILSHGDRGSPRSAGVVVPGERVLRQELPGAARRRCWRPSTSWGSACSRP

SEQ ID NO: 4917 - DNA, 518 bp, Zea mays
  misc_feature: Ceres CLONE 312280-F
  misc_feature: Encodes the peptide sequence at SEQ ID NO. 4918
cacctgtgagtgactcggtcgcatcttccccattctccatcgacgcaccggcggcggcgcaagtgaagcragaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaactgtccgcacagaatcggatgactaagggctggcgccatggcgacatagtccttcctacagatgatttgaagcgtcgttgcaagtttctgggacttgttatttagttggcttgatttgtaatcaatgctgaagaataaatactttttgcgacaatggtctttttacaatgtcgtgttgttttcgttgctaattgcacttgccctaccctaatcaagcatgttgaactaatgggaatgcttc

SEQ ID NO: 4918 - protein, 70 aa, Zea mays
  misc_feature: Ceres CLONE 312280-F
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPFKSEAASREKVHFSISKWTDGKQEKPTVRTESDD

SEQ ID NO: 4919 - DNA, 507 bp, Zea mays
  misc_feature: Ceres CLONE 312317-F
  misc_feature: Encodes the peptide sequence at SEQ ID NO. 4920
tcgcttctccaagaagtcacgcaccaaacaccaccaccaaagaaggcgagaacgctccccttcccctccagtctccaggaccgtctcctcgcctgctcatctaccgctgctccccttctctgcgctcggagaatcggagagaagcgcgcgcgaccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtssccgttgttttgg

SEQ ID NO: 4920 - protein, 117 aa, Zea mays
  misc_feature: Ceres CLONE 312317-F
  misc_feature (10)..(117): Pfam Name: Ras Pfam Description: Ras family
  misc_feature (114)..(114): Xaa is any aa, unknown, or other
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVXVVL

SEQ ID NO: 4921 - DNA, 487 bp, Zea mays
  misc_feature: Ceres CLONE 312337-F
  misc_feature: Encodes the peptide sequence at SEQ ID NO. 4922
  misc_feature (92)..(92): n is a, c, t, g, unknown, or other
  misc_feature (93)..(93): n is a, c, t, g, unknown, or other
  misc_feature (96)..(96): n is a, c, t, g, unknown, or other
tcacccacctccgccagccactccaaacacttgcgccgccgctgcctcacaggtaaggccgccatggtctccggttcgggcgtgtgcgcganncgntggtcgacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccgccaagatcctgtggcgcaccatccgcgggatgattccgcacaagaccaagaggggggaggcggctctggcgaggctcaagacgtacaagggcgtcccgcgccgtacgacaagaccaagcgtatggtcatccctgacgctcttaaggttctgaggctacagctgggacacaagtactgcctcctc

SEQ ID NO: 4922 - protein, 112 aa, Zea mays
  misc_feature: Ceres CLONE 312337-F
  misc_feature (1)..(106): Pfam Name: Ribosomal_L13 Pfam Description: Ribosomal protein L13
MLGRLSSIIAKELLNGQKVVVVRCEEICMSGGLVRQKMKYLRFLRKRMNTKPSHGPIHFRAPAKILWRTIRGMIPHKTKRGEAALARLKTYKGVPRRTTRPSVWSSLTLLRF

SEQ ID NO: 4923 - DNA, 126 bp, Zea mays
  misc_feature: Ceres CLONE 312343-F
aagccgccaaccatttcccccaatcccgcctgccagccctagggtttctgctacgccatggcgggaaccgccgccgctcccatggacatcgacgcagccgcgccgcctcccccgccgcctggtgcg

SEQ ID NO: 4924 - DNA, 191 bp, Zea mays
  misc_feature: Ceres CLONE 312360-F
agagtttccgtgccgtagcaacagacaagggagagtgggagactagcgcaacaggacagcgcacggaaccgaggggaggggagacggagagggcgcatcggacggcggcgagatgctggcggtgttcgatcccacggtggccaagtgcccggagtctccgcagccccccggtcgccgggkcggccgctgga

SEQ ID NO: 4925 - DNA, 477 bp, Zea mays
  misc_feature: Ceres CLONE 312370-F
  misc_feature: Encodes the peptide sequence at SEQ ID NO. 4926
  misc_feature (237)..(237): n is a, c, t, g, unknown, or other
acgtgtcgatgcagtccgtgactratagaacatcctggccaacaccggtgagcgaagagaaacgattccatagtcgaagcgtagatcgcagcggassagaggcatggatggaaagagctttagcaacgaacagcaagcccaacaaaagaacccagacgcagtgacaaacagtgttccgagccaaggccaggagcccttgaacacgtttccagattcagacgatggaaacacgaacancggtccgttgaatggccatgcagcagctcatgtgaacatggaagctgccatctctacggaggacgtcatacgggctggcgggttcggagcgaaggatgacattggcagcctcctcccgacggcaattgattccaccgattttgaggcctcgctgcgggatgcccgtggtttcgagggcgagaaagcggcgccgtcgcatcctggactagggtgggaagggggagaagctgatggtggaac

SEQ ID NO: 4926 - protein, 124 aa, Zea mays
  misc_feature: Ceres CLONE 312370-F
  misc_feature (45)..(45): Xaa is any aa, unknown, or other
MDGKSFSNEQQAQQKNPDAVTNSVPSQGQEPLNTFPDSDDGNTNXGPLNGHAAAHVNMEAAISTEDVIRAGGFGAKDDIGSLLPTAIDSTDFEASLRDARGFEGEKAAPSHPGLGWEGGEADGG

SEQ ID NO: 4927 - DNA, 325 bp, Zea mays
  misc_feature: Ceres CLONE 312380-F
  misc_feature (130)..(130): n is a, c, t, g, unknown, or other
  misc_feature (236)..(236): n is a, c, t, g, unknown, or other
  misc_feature (259)..(259): n is a, c, t, g, unknown, or other
atccaatccatcagtacccaaccttcccctacaccagaaaaatccccagttctttggtccgcgtcagagaggcggcggcgatgtctgggcgcggcaagggcggcaagggtctgggcaagggcggcgcgancggataggtgctccgcgacaacatccagggcatcaccaagccggcgattccggaggctggctaggaggggtggcgtgaagcattctcggggctcatctacgagganacccgcggcgtgctcaagatctnyctcgagaacktcatccgcgacgccgtcacytacaccgagcacgcgcgccgcaataccgtgaccgc

SEQ ID NO: 4928 - DNA, 491 bp, Zea mays
  misc_feature: Ceres CLONE 312446-F
  misc_feature: Encodes the peptide sequence at SEQ ID NO. 4929
ggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacacttattatgtttggtccagataaatgtggggtcaaccaacaag

SEQ ID NO: 4929 - protein, 136 aa, Zea mays
  misc_feature: Ceres CLONE 312446-F
  misc_feature (24)..(137): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTYYVWSR

SEQ ID NO: 4930 - DNA, 896 bp, Zea mays
  misc_feature: Ceres CLONE 312476
  misc_feature: Encodes the peptide sequence at SEQ ID NO. 4931
acatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgatggaggaggcggacgcggacggcgacggctgcatcagcctgcccgagttcgccgcgctcatggagtccgcgtccgccgacgccgccgccgtcgaggaggacctgcgccacgccttcatggtcttcgacgccgacggcaacggcctcatcacgcccgccgagctcgcgcgcgtcctgcgcggcctcggggagtccgccaccgtcgcccagtgccgccgcatgatccagggcgtcgaccgcaacggcgacggcctcgtctccttcgacgagttcaagctcatgatggccgcgggcggcggcggcggattcggcaggatcggtgcctaggaacaaggatcctgtgcctgtcctgctctgcctctgccccgctccgctccgctcccacaaattggatttctttcattttattatgtatgtacatatactacactggaatcacacggacagcgccacgtaaaaaagccccctttttcatttggtttttgtgtactatacaatgcaaatctgcatccattgtactgctatggatgttcaatggaattgtttcggctttcaaaaaaaaaaaaaaaa

SEQ ID NO: 4931 - protein, 204 aa, Zea mays
  misc_feature: Ceres CLONE 312476
  misc_feature (92)..(120): Pfam Name: efhand Pfam Description: EF hand
  misc_feature (166)..(194): Pfam Name: efhand Pfam Description: EF hand
  misc_feature (56)..(84): Pfam Name: efhand Pfam Description: EF hand
  misc_feature (130)..(158): Pfam Name: efhand Pfam Description: EF hand
  misc_feature: SWISSPROT Homolog: EC 2.7.11.1 Non-specific serine/threonine protein kinase
MGKVRSFFSRSRSGKRGSARRAGSSSPHSSAASAPPSPSPLPRRSPSSSSTTTRDETERVFRKFDANGDGQISRSELAALFEGVGHAVTDDEVSRMMEEADADGDGCISLPEFAALMESASADAAAVEEDLRHAFMVFDADGNGLITPAELARVLRGLGESATVAQCRRMIQGVDRNGDGLVSFDEFKLMMAAGGGGGFGRIGA

SEQ ID NO: 4932 - DNA, 420 bp, Zea mays
  misc_feature: Ceres CLONE 312567-F
  misc_feature: Encodes the peptide sequence at SEQ ID NO. 4933
  misc_feature (342)..(342): n is a, c, t, g, unknown, or other
gtgctctctcagaggtgggctggcttctcctccccctcttatcaagtcctcctcgggttagggttccttagggttttgtggaggggcgatggcggcggctgatgtggagtaccgtttkcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggccnagtcccgtggcggcggcggcggcggcggcggcggtggctacggcggcggtcgcggcggcggcggctatggtggcgggc

SEQ ID NO: 4933 - protein, 106 aa, Zea mays
  misc_feature: Ceres CLONE 312567-F
  misc_feature (6)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (6)..(6): Xaa is any aa, unknown, or other
  misc_feature (81)..(81): Xaa is any aa, unknown, or other
MWSTVXFVGGLAWATSNESLENAFASYGEILDSKVITDRETGRSRGFGFVTFSSENSMLDAIENMNGKELDGRNITVNQAXSRGGGGGGGGGGYGGGRGGGGYGGG

SEQ ID NO: 4934 - DNA, 112 bp, Zea mays
  misc_feature: Ceres CLONE 312689-F
acacgcacaccgcgacccagtccagagccagtacgtgcgamggcaacgcacgctgctggtccgcgtacssagacgacggtcaggtcggccggtgcttttcagtttggaataa

SEQ ID NO: 4935 - DNA, 363 bp, Zea mays
  misc_feature: Ceres CLONE 312708-F
  misc_feature: Translation starting site: 31
  misc_feature (216)..(216): n is a, c, t, g, unknown, or other
ttgcctcccacgccgccgccggatcccgcgatggccgaccctcggctgtaccccacggagtccgggtccgacgaccggcgcgatgccgcctatcccggctccgagcgccgcctctacaacccgtaccaggacctcaacctcccctatcggcagctctacgatcttcccacctccccggagttcctcttccaggaggaggccgtcgcgcagscggtncctggggcgagaacctcacctactacaccggcgtgggatacctcggcggcgssttggccggggcccgcgctggggctccgcgacgccgcccggkgsgccgagcctcggggagcccgccaagatccgggccaaccgcgtcctcaactc

SEQ ID NO: 4936 - DNA, 633 bp, Zea mays
  misc_feature: Ceres CLONE 312744
  misc_feature: Encodes the peptide sequence at SEQ ID NO. 4937
atcccaaagcacaagagcacgcactgcagcaccacttcctgcgctgctgctcatcacacaccgtagtactaacactccatcgccacaatggctcccaaggttgcgctcttccttgccctcagcctcctcttcgctgccgccgcgcatggctgcgaaccctactgtcccggcccagtcgtcccaacgccgcccgtcgtgccgtcgcacagccacgggcgctgcccgatcgacgcactaaagctcaaggtgtgcgccaacgtgctggacctcgtcaaggtcggcctaccccagcacgagcaatgttgcccgctgctggaggggctggtggacctcgacgccgcactgtgcctctgcaccgccatcaaggctaacgtcctcggcatccacctcaacgtgccccttagcctcaacctcatcctcaacaattgcggcaagatttgcccaaaagactttacttgccccaactaattgagctgaatatggagataaagccagcatccaaggaatgtaccccttagtgtttcatctcgcgattccgattgttacttgatcatcatcgctgtttatctatttttatatttaattatcaataaaaaacattcacattttttgtttcgaaaaaaaaaaaaaaaa

SEQ ID NO: 4937 - protein, 126 aa, Zea mays
  misc_feature: Ceres CLONE 312744
  misc_feature (45)..(124): Pfam Name: Tryp_alpha_amyl Pfam Description: Protease inhibitor/seed storage/LTP family
MAPKVALFLALSLLFAAAAHGCEPYCPGPVVPTPPVVPSHSHGRCPIDALKLKVCANVLDLVKVGLPQHEQCCPLLEGLVDLDAALCLCTAIKANVLGIHLNVPLSLNLILNNCGKICPKDFTCPN

SEQ ID NO: 4938 - DNA, 123 bp, Zea mays
  misc_feature: Ceres CLONE 312753-F
gttcccgtgcggccgtgtcccccttcctttcctgttttcccctcctcttcctttccccccacccccactactctctctcgccccaaaaccagatcgccacgacaagggcagagggccccggac

SEQ ID NO: 4939 - DNA, 410 bp, Zea mays
  misc_feature: Ceres CLONE 312758-F
  misc_feature: Encodes the peptide sequence at SEQ ID NO. 4940
  misc_feature (108)..(108): n is a, c, t, g, unknown, or other
  misc_feature (192)..(192): n is a, c, t, g, unknown, or other
ctagcgccgcaccctcccgcccaccgccgtcgccgcccaaccgcagtaaggdggaaggagcaggaagatgccggcggggcacgggctgcggtcgcggacccgcscatngttcgcgcggcccttccgcaagaaggggtacatcccactcaccacgtacctgcgcacctacaagatcggcgactacgtsasstncaaggttaacggcgccgtgcacaagggcatgccgcacaagttctaccacggccgcaccgggagcgtctggaacgtcaccaagcgcgccatcgstccggagatcaacaagcaggttaatggccgcatcatcaggaagcggattccatgtccgcgtggagcatgttgcagccctcccgttggcacgaaggagttccgcttgaggaaakccaakaatgacc

SEQ ID NO: 4940 - protein, 114 aa, Zea mays
  misc_feature: Ceres CLONE 312758-F
  misc_feature (2)..(94): Pfam Name: Ribosomal_L21e Pfam Description: Ribosomal protein L21e
  misc_feature (13)..(13): Xaa is any aa, unknown, or other
  misc_feature (14)..(14): Xaa is any aa, unknown, or other
  misc_feature (41)..(41): Xaa is any aa, unknown, or other
  misc_feature (42)..(42): Xaa is any aa, unknown, or other
  misc_feature (73)..(73): Xaa is any aa, unknown, or other
  misc_feature (111)..(111): Xaa is any aa, unknown, or other
  misc_feature (112)..(112): Xaa is any aa, unknown, or other
MPAGHGLRSRTRXXFARPFRKKGYIPLTTYLRTYKIGDYVXXKVNGAVHKGMPHKFYHGRTGSVWNVTKRAIXPEINKQVNGRIIRKRIPCPRGACCSPPVGTKEFRLRKXXND

SEQ ID NO: 4941 - DNA, 318 bp, Zea mays
  misc_feature: Ceres CLONE 312767-F
  misc_feature: Encodes the peptide sequence at SEQ ID NO. 4942
ctctccttctccccctacttccctacgtaccaggaggctaccactcccccagagtgaaggaagagagagctctccgcctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcggccccgagcgccccgcagcaccgggaaggtgatgccggacgagtacgacgagcggtcctactgcctatacgacactgacgcctcctcggtgtacggcgtctccgc

SEQ ID NO: 4942 - protein, 40 aa, Zea mays
  misc_feature: Ceres CLONE 312767-F
MGGFGTSRPASVALCAFLTFLNLFAVLLAVGPERPAAPGR

SEQ ID NO: 4943 - DNA, 215 bp, Zea mays
  misc_feature: Ceres CLONE 312814-F
  misc_feature: Encodes the peptide sequence at SEQ ID NO. 4944
  misc_feature (190)..(190): n is a, c, t, g, unknown, or other
agtggtgctagaagcaactgaaaacagccgagcgatctcctctccctctccctctccggatccattctccagcgcagagtaaacatgtctgaccgggcaaagatgtcgtggcaggcgtacgtggacgagcacctgatgtgcgagatcgagggccaccacctcgcggcggcggccatcgtcggccacgrgntgccgcctgggcgcagagcacggcg

SEQ ID NO: 4944 - protein, 43 aa, Zea mays
  misc_feature: Ceres CLONE 312814-F
  misc_feature (35)..(35): Xaa is any aa, unknown, or other
  misc_feature (36)..(36): Xaa is any aa, unknown, or other
MSDRAKMSWQAYVDEHLMCEIEGHHLAAAAIVGHXXPPGRRAR

SEQ ID NO: 4945 - DNA, 274 bp, Zea mays
  misc_feature: Ceres CLONE 312850-F
  misc_feature: Encodes the peptide sequence at SEQ ID NO. 4946
  misc_feature (57)..(57): n is a, c, t, g, unknown, or other
atccctctgtccgttcgctgcattgctcccctaaccgttcggccaggagacagcggngaagggcagagatggcggccgcgtccttcaccgccgccaagttcctggcgccggtggccgcgagatccggcggagagagggcgcccccgctccccgccggcgcctcgtcctcctccttcgccaggaccctgcgccgcggcggttgcaccacccgcgcttgcgcaccgcgtcgccgtctcctccgacctgctcgctgggaacaaggccgcgcaggcgc

SEQ ID NO: 4946 - protein, 68 aa, Zea mays
  misc_feature: Ceres CLONE 312850-F
MAAASFTAAKFLAPVAARSGGERAPPLPAGASSSSFARTLRRGGCTTRACAPRRRLLRPARWEQGRAG

SEQ ID NO: 4947 - DNA, 211 bp, Zea mays
  misc_feature: Ceres CLONE 312869-F
  misc_feature: Encodes the peptide sequence at SEQ ID NO. 4948
gcaacctcccttcctttccctcccccacccctcctgctgcagtctctcctcctcagcgggaccggtctggatggccgccttcttcgctgctgctccgccgccgggggttggctctcgcgtcgttccaccacgaggagcagcagcgtcaggacgccgccgaggagctgtaccacgtggacgacgacgtcggcggccagcaggggaagctgtg

SEQ ID NO: 4948 - protein, 69 aa, Zea mays
  misc_feature: Ceres CLONE 312869-F
NLPSFPSPTPPAAVSPPQRDRSGWPPSSLLLRRRGLALASFHHEEQQRQDAAEELYHVDDDVGGQQGKL

SEQ ID NO: 4949 - DNA, 264 bp, Zea mays
  misc_feature: Ceres CLONE 312895-F
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (175)..(175): n is a, c, t, g, unknown, or other
aaaaagaaagaaaaaatcgagaggacgccagggccgattctctgcgtgacttggggcgtcgtcgcgagttttctccggccgagggcggcgcgaccggacaaccagcgtgasscgaccggcgacatgactcgcggcaaccagcgtgaccgcgaccgtgagckcgcggtcggnnnanagcccaacgccaagaactcccaggtacgggctcaccccggtagcagcgccgcgagtagggacaagaaagctctggaggagaaggcggcc

SEQ ID NO: 4950 - DNA, 370 bp, Zea mays
  misc_feature: Ceres CLONE 312905-F
  misc_feature: Encodes the peptide sequence at SEQ ID NO. 4951
  misc_feature (144)..(144): n is a, c, t, g, unknown, or other
ctcgtctcctgttcgccagagccacctcgctccagaagctttcctcccctagatctccctcccgtgcccggtcgcgctgccgacccggccatggccaccaaggggaagctcggggagctagtgtgggagcaccgggtgcaggcngccgcagcggtggctttcgtggccgcggccgsscgtctcgatctccgccgtcgggcccaggctcggcgccgtggtgtcattcttctggccgctgctcgtctccacgggcctcttcctggtggcggtcgcgtgctgctccggatctcgccgccgcccgckgcatcgacgacgagtccggcaaggagctcatcgacttcgtssccgggtgccgcccgagcacctcgtc

SEQ ID NO: 4951 - protein, 93 aa, Zea mays
  misc_feature: Ceres CLONE 312905-F
  misc_feature (29)..(29): Xaa is any aa, unknown, or other
  misc_feature (85)..(85): Xaa is any aa, unknown, or other
MATKGKLGELVWEHRVQAAAAVAFVAAAXRLDLRRRAQARRRGVILLAAARLHGPLPGGGRVLLRISPPPAASTTSPARSSSTSXPGAARAPR

SEQ ID NO: 4952 - DNA, 260 bp, Zea mays
  misc_feature: Ceres CLONE 312941-F
awagaaaagagaaggaacaatgaagcataccaaaacccaatcagaatcagggtgggtaagcssgaagaaaggaaggggaaaggcgacgagctggtgacgacgaggagcaactagcgtcgcgamscgccgtgccccaggcgaagtcacaggccgccgcagcgccggcgcccacccgatccgccgccgccgccgacctcgtgctcacgcytccggtcggaaggagggtgtgtcaaacccattggagcagccttgccgctccc

SEQ ID NO: 4953 - DNA, 719 bp, Zea mays
  misc_feature: Ceres CLONE 312945-R
  misc_feature: Translation starting site: 229
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
tttttttcgcccgcgcccgccccctgatccccagcacccccttccttggtgnnnnncccgattgggtaccgggccccccctcgaggtcgacggtatcgatattttttttttttttttttgaggacttgatatgatctttatataaccaaatgttaacactgtacaaagagctaaaacagcagacagcaagcatcaactagagatggtgccttcttgaatattacacagatgagacactcagctaaatgtaccatgcatagcaccaacaagctcgataccaagatggacaagattcctagaagccattcatctccagaaggtaagtgcgtctcttcatcagcgtcttcacagcagctttaaatggcccatcgaatgctccaaagacgaatccttcggcttccttgcggttagggtggcttccattgcttccctcatgtaaacgtttgatagccaccaaagtagcgccttgcaaccccccaccaccaggcagttcaacatatggagcgtaattgagcttcatgttgcaggctgggacctgagtcctgttggaacatgccgaggccgacaactgggtctctctgaactcctccagctgctttgcccccatgcacaatgtggccttggccatcagcatctgtcattaccaagctctgtagtgtgggatgggcattgatgattgatccggagaaaataatgcccttgttgatacccccgattaa

SEQ ID NO: 4954 - DNA, 459 bp, Zea mays
  misc_feature: Ceres CLONE 312963-F
  misc_feature: Encodes the peptide sequence at SEQ ID NO. 4955
atatcagccattttaagtttgataatggatccaagatatgttactttattcatcttagtacttgccttacatggagatactactttggcagaaacttgcaggcagtttgttaaagtgcatccattctgctttaaagcaatgtgcaaggcaaattgtgctatagagggaaaattctctgatggttcctatgtaaaggattacagatgtgaatcaggtggatttcactcagtgtgcgtttgcattttgtgcaaacattagttatctaaagacaagcggagatatcttcttgtattcctatatgttatttaggagtattgtccaaataattatacggtagcttagttaactagctagtttgtttatttatagacatatgtagcactagttaactagttgttgtttcttaaattctcagctatataccagtaaacatgttttcagcgcttcaataatatatat

SEQ ID NO: 4955 - protein, 77 aa, Zea mays; identical to SEQ ID NO: 1262
  misc_feature: Ceres CLONE 312963-F

SEQ ID NO: 4956 - DNA, 311 bp, Zea mays
  misc_feature: Ceres CLONE 313015-F
  misc_feature: Encodes the peptide sequence at SEQ ID NO. 4957
  misc_feature (67)..(67): n is a, c, t, g, unknown, or other
  misc_feature (68)..(68): n is a, c, t, g, unknown, or other
aaaaaagacgcggcccagccgtaggagggttctgttgtctctttcacttgctccgcgccggcatcynncccccttcgccgccaccgcgatcttgttctcagttctacggcggcgatacccccctccactccccaccctgtcacccccacaaaataagttctgcggcggcgatggcgctctcctcctcccggccgaagcacctcctgcgccccatcctgcggggtttccacgcctcagcgcgggcyctggcgcgggtggagccgcacgagttctccaagcccagcgagtacctgggcagctgggagcccgcg

SEQ ID NO: 4957 - protein, 47 aa, Zea mays
  misc_feature: Ceres CLONE 313015-F
MALSSSRPKHLLRPILRGFHASARALARVEPHEFSKPSEYLGSWEPA

SEQ ID NO: 4958 - DNA, 199 bp, Zea mays
  misc_feature: Ceres CLONE 313034-F
  misc_feature (81)..(81): n is a, c, t, g, unknown, or other
atcactccaccatgtccgccgccacctcggcgsagcggccgtctcctcgtcgcgcccgtatcccctcctccaacccgcctnagccccaccctcgtttccttccctcggcgacassttccatccacctcggttgccctgtccgcgccctcccagctgttcgtcgcggggctcgccgctggssccggcggccaacccgaag

SEQ ID NO: 4959 - DNA, 244 bp, Zea mays
  misc_feature: Ceres CLONE 313038-F
ttcgcgtgctccgccgtcacgacccaaattattgagagcccaggaagtgagagatgagcctgcagattccggtgagatcaggcgccctgcgcctttctccttctaggtggcgccgagggtctactgcgcacctactccaccggcgaccggcgccgcgggttgatccgcgaggcaaggyaagaggaggaggacgaagcgttcctccgcaccctcaacttcggcgctgaccccgagaacaaccctc

SEQ ID NO: 4960 - DNA, 224 bp, Zea mays
  misc_feature: Ceres CLONE 313040-F
  misc_feature: Encodes the peptide sequence at SEQ ID NO. 4961
  misc_feature (78)..(78): n is a, c, t, g, unknown, or other
aagctcgaagcgamgctccctgactacagagaaccggagactgaggaggaggaggagacgtcacgcctgcgcggctgnccaccatggacgaggaggagttccggcgcatgctcgacctcttcccggtcgtccgctcccgagactactgctgctccgatcttggaacatccagcagaggaaccagacagcgattcacgagttcaggaggcaaytaagggcgataa

SEQ ID NO: 4961 - protein, 43 aa, Zea mays
  misc_feature: Ceres CLONE 313040-F
MDEEEFRRMLDLFPVVRSRDYCCSDLGTSSRGTRQRFTSSGGN

SEQ ID NO: 4962 - DNA, 200 bp, Zea mays
  misc_feature: Ceres CLONE 313049-F
  misc_feature: Encodes the peptide sequence at SEQ ID NO. 4963
  misc_feature (108)..(108): n is a, c, t, g, unknown, or other
atggtcaatcgggtgatctgaaggaggaggaggcggcggcactccaaactttagcgacatggcaatgcggttggcggctgcggccacgttcgtgcggcgcctggsgcncgcgccaccagtacgcatcctggcggcggcatctacggcggaassggaggcagtgacgtgcggggcgcggggacaagaaaaccaagcgcggg

SEQ ID NO: 4963 - protein, 47 aa, Zea mays
  misc_feature: Ceres CLONE 313049-F
  misc_feature (16)..(16): Xaa is any aa, unknown, or other
  misc_feature (17)..(17): Xaa is any aa, unknown, or other
  misc_feature (32)..(32): Xaa is any aa, unknown, or other
MAMRLAAAATFVRRLXXAPPVRILAAASTAEXEAVTCGARGQENQAR

SEQ ID NO: 4964 - DNA, 465 bp, Zea mays
  misc_feature: Ceres CLONE 313051-F
  misc_feature: Encodes the peptide sequence at SEQ ID NO. 4965
aagccacctggttctccatccggtcagaccaatcaacaaagtgacgcgagcacgagcatccatcgtttccccttcttccccatcgcgtgccctcgccgcagycatcttccatggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgaaggacaccgactccgaggaggagcttaaggaggcctttcgcgtcttcgacaaggaccagaatggtttcatctcagctgctgagctccgccatgtcatgaccaacctcggtgagaagctgactg

SEQ ID NO: 4965 - protein, 118 aa, Zea mays
  misc_feature: Ceres CLONE 313051-F
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLT

SEQ ID NO: 4966 - DNA, 113 bp, Zea mays
  misc_feature: Ceres CLONE 313094-F
acacgcacaccgcgacccagtccagagccagtacgtgcgamggcacgcacgctgctggtccgcgtacbsagacgacggtcaggtcggccggtgcttttcagtttggaataatg

SEQ ID NO: 4967 - DNA, 244 bp, Zea mays
  misc_feature: Ceres CLONE 313096-F
  misc_feature: Encodes the peptide sequence at SEQ ID NO. 4968
  misc_feature (102)..(102): n is a, c, t, g, unknown, or other
atcaaagcaagccatgtggaggagggctttagcgatggtgctgttcatggctggcgccgcgctgctcgccggggccgccgsskccggccgcascagggcgtngtggagcatcatcacccggcccatgttccagagcatgctgagccaccgcggcgacasgggttgccagggcgccttctacacctacgatgccttcatcgaggccgccagcaagttccccggcttcggcabcaccggcgacgag

SEQ ID NO: 4968 - protein, 77 aa, Zea mays
  misc_feature: Ceres CLONE 313096-F
  misc_feature: SWISSPROT Homolog: EC 3.2.1.14 Chitinase
  misc_feature (23)..(23): Xaa is any aa, unknown, or other
  misc_feature (24)..(24): Xaa is any aa, unknown, or other
  misc_feature (27)..(27): Xaa is any aa, unknown, or other
  misc_feature (30)..(30): Xaa is any aa, unknown, or other
  misc_feature (49)..(49): Xaa is any aa, unknown, or other
  misc_feature (73)..(73): Xaa is any aa, unknown, or other
MWRRALAMVLFMAGAALLAGAAXXGRXRAXWSIITRPMFQSMLSHRGDXGCQGAFYTYDAFIEAASKFPGFGXTGDE

SEQ ID NO: 4969 - DNA, 485 bp, Zea mays
  misc_feature: Ceres CLONE 313106-F
  misc_feature: Encodes the peptide sequence at SEQ ID NO. 4970
aaggaattagaacggccgaagcggcacacaattcgcgcmrgcgtagaaactagaaagtccagtccccaaactccccagcgggtcgagcagaggaggaagagtagccgccgccatgtctgggggaatcgcccgcggccgcctcgccgaggagcgcaaggcctggcgcaagaaccacccgcacggtttcgtcgcgaascgggagtcgctgcccgacggacggtgaacctgatgatctggcagtgcaccatccccggcaagcaagggactgactgggaaggtggatacttccctctcacccttcattttagtgaggattaccctagcaagcctcccaagtgcaagttccctcagggtttcttccacccaaatgtgtatccttctggaacagtctgccttttcgatccttaatgaggacagtggttgggagaccagctattactgttaagcagattctcgtcggggatccaggacttgctagatcagcc

SEQ ID NO: 4970 - protein, 59 aa, Zea mays
  misc_feature: Ceres CLONE 313106-F
  misc_feature (1)..(59): Pfam Name: UQ_con Pfam Description: Ubiquitin-conjugating enzyme
  misc_feature: SWISSPROT Homolog: EC 6.3.2.19 Ubiquitin--protein ligase
MIWQCTIPGKQGTDWEGGYFPLTLHFSEDYPSKPPKCKFPQGFFHPNVYPSGTVCLFDP

SEQ ID NO: 4971 - DNA, 252 bp, Zea mays
  misc_feature: Ceres CLONE 313115-F
  misc_feature: Encodes the peptide sequence at SEQ ID NO. 4972
  misc_feature (225)..(225): n is a, c, t, g, unknown, or other
atcccttgataaaaaacccacaggccacaacaccaagaaactagcatcttctgcagctctgaagaaaactcgatcaccatggacatgccttctcttgttctcctcctgctcgtcttcattacagcaggcagccgcgccgcggcgcaggtgttctgccgctcgcagttcaacctggccaacgaggcctgcagcctgcgcacctwctccgggcccaacccggcgcantgacagctgcacatcaacggctcctcg

SEQ ID NO: 4972 - protein, 48 aa, Zea mays
  misc_feature: Ceres CLONE 313115-F
  misc_feature (42)..(42): Xaa is any aa, unknown, or other
MDMPSLVLLLLVFITAGSRAAAQVFCRSQFNLANEACSLRTXSGPNPA

SEQ ID NO: 4973 - DNA, 454 bp, Zea mays
  misc_feature: Ceres CLONE 313125-F
  misc_feature: Encodes the peptide sequence at SEQ ID NO. 4974
  misc_feature (322)..(322): n is a, c, t, g, unknown, or other
  misc_feature (323)..(323): n is a, c, t, g, unknown, or other
ttggaggccgcggcacccgggtgctgctgcctggcggcccgcggcgccatccattggcgtcctcttccaaggtctcggtgcaagtctacaccgtcccaagctcagctgctaccggccgtgaagcccgaggtcaaggtgttgcaccaatgatgcatgcgtctagcgtcgctggccatggcggccgcgctgctgatctagaccccgtcaaggccaagatcgtctcccaccctagctaccaccgcctgctcgccgccttcttggactgccacaakgtcggctgcccgccggaagcgccgaggagatcgcggcggtggcgcgggannatggcgtggcagcgtgcagccgcgggcgacgtcgcgcacacaaggccggacccggagctcgaccagttcatggagtcctactgcgagctgcttgtgacgtggaaggaggagctgacccggccgctccggga

SEQ ID NO: 4974 - protein, 150 aa, Zea mays
  misc_feature: Ceres CLONE 313125-F
  misc_feature (66)..(110): Pfam Name: KNOX1 Pfam Description: KNOX1 domain
  misc_feature (117)..(150): Pfam Name: KNOX2 Pfam Description: KNOX2 domain
  misc_feature (90)..(90): Xaa is any aa, unknown, or other
  misc_feature (107)..(107): Xaa is any aa, unknown, or other
GGRGTRVLLPGGPRRHPLASSSKVSVQVYTVPSSAATGREARGQGVAPMMHASSVAGHGGRAADLDPVKAKIVSHPSYHRLLAAFLDCHXVGCPPEAPRRSRRWRGXMAWQRAAAGDVAHTRPDPELDQFMESYCELLVTWKEELTRPLR

SEQ ID NO: 4975 - DNA, 445 bp, Zea mays
  misc_feature: Ceres CLONE 313135-F
  misc_feature: Encodes the peptide sequence at SEQ ID NO. 4976
  misc_feature (116)..(116): n is a, c, t, g, unknown, or other
atcaccaagttttggattccagcagcggcgcccccaggccaggccccacccgctcagcctccycagctgcccaaccttctccccatctgctcagcctcagctgtcattcccgcgancgtctcccggctctatcgatggaccgagtcgccgccctcgtcgtcgcgctcctcgccctcttcttcgccgccggggccacggcgcaggccccggcctcgtcgcccaagcgcactccagcgccassccacccaggacggccttcctcccgccgccgccggccagggcgcctatggcctccccgccctcgcctcccgcgatggcgccggtgcccgcgccctccgccggcgtgccgccaacgagccccgtcggcgcgggagctggtgacgacgcgatggcccccgccggakccgcggcgtctctgactccggctgccgcgcccgttcacgga

SEQ ID NO: 4976 - protein, 53 aa, Zea mays
  misc_feature: Ceres CLONE 313135-F
  misc_feature (40)..(40): Xaa is any aa, unknown, or other
MASPPSPPAMAPVPAPSAGVPPTSPVGAGAGDDAMAPAGXAASLTPAAAPVHG

SEQ ID NO: 4977 - DNA, 277 bp, Zea mays
  misc_feature: Ceres CLONE 313163-F
  misc_feature: Encodes the peptide sequence at SEQ ID NO. 4978
  misc_feature (88)..(88): n is a, c, t, g, unknown, or other
  misc_feature (135)..(135): n is a, c, t, g, unknown, or other
  misc_feature (267)..(267): n is a, c, t, g, unknown, or other
  misc_feature (268)..(268): n is a, c, t, g, unknown, or other
gcagattagcaggccgcctgcgctccttgcccctaagcctcgtttccggtgtacgactccaacgacgacgagatggcgctccgtcggnttcccctccctcggccgcgcgcttctcacgccggcccggsccggccnggacgctctccgcggaggcctccgatgccctcgttgagatcaagcccggggagattgggatggtctccggcatccccgaggagcacctccgccgtaagttgtaatttattcaccagctaggactgcatctcnncaaggttca

SEQ ID NO: 4978 - protein, 78 aa, Zea mays
  misc_feature: Ceres CLONE 313163-F
  misc_feature (29)..(29): Xaa is any aa, unknown, or other
  misc_feature (45)..(45): Xaa is any aa, unknown, or other
RLAGRLRSLPLSLVSGVRLQRRRDGAPSXSPPSAARFSRRPGPAXTLSAEASDALVEIKPGEIGMVSGIPEEHLRRKL

SEQ ID NO: 4979 - DNA, 751 bp, Zea mays
  misc_feature: Ceres CLONE 313165-R
ccgattgggtaccgggccccccctcgaggtcgacggtatcgatattcttgatttcgaattcgtcgcagcccgggggatctattagttctagtgaggccgcctccgtggcggtcgtcccgcttttgttccctttagtgacggttactttcgcgcttgctgaagtcctggcggtacatgtttccagttgtcaatggatattgagtgccaatgcatgtgtggtagtatgaataaccaaatcgcttgtcgctcggcgggccttacgtaggagcagactcgcttgtatgtatcgtagtactcacctgccctctttcgcgtccgctaacgtggcgcgcgcgctccccttaatgcaatgctgtacctccgtctgcgatattcgaatcgaaatagtgtctcgatcttctgcttcctctataactggactcggcgtccatccactctttacggctgacttcgagcggatatcgtgctcagtcctaagagcggcaaataaggcttgtagatcagtcactcggggggatgaactggaggcggaccattggtccttagactgaaaggcgcatgcgcctggagcacccggaacctgagaacataggccagctgtttggctcgaggtttttattcttactaagctccggcctcccgctgtaagtcgcattcttaaaaaacgatcggtcacctgaaggtcccggaggttgagccgccatctccgaaaaggggacttttggaagaaattcctccagggggtttttcc

SEQ ID NO: 4980 - DNA, 421 bp, Zea mays
  misc_feature: Ceres CLONE 313183-F
  misc_feature: Encodes the peptide sequence at SEQ ID NO. 4981
  misc_feature (178)..(178): n is a, c, t, g, unknown, or other
  misc_feature (316)..(316): n is a, c, t, g, unknown, or other
attccccaaaaccaaaataatcgccaccgctctccgcaccgaaccgaagcagcggcgatgtcggcggagaagccggctcccgtgcgcgtgctctactgcggcgtctgcggcctcccggccgagtactgcgagttcggccccgacttcgagcgctgcaasscctggctgcgcgcgcacncggcgtctaccccgacgaccttgtcgccgcctcctcctcacccggcggcggcgacaaggacgtcgacaaggtcggggatcgcctccagggcgtcgggatctccgacggctccaccggcgccgcagggattgcttccgngtctaagccccaagaggcgaaacgctgcctggtggtaagctcaakaaaaaggagaagcaagaagtggtcattgagaagattgtccgtaacaagcgcaaatgtgtt

SEQ ID NO: 4981 - protein, 98 aa, Zea mays
  misc_feature: Ceres CLONE 313183-F
  misc_feature (34)..(34): Xaa is any aa, unknown, or other
  misc_feature (35)..(35): Xaa is any aa, unknown, or other
  misc_feature (41)..(41): Xaa is any aa, unknown, or other
  misc_feature (87)..(87): Xaa is any aa, unknown, or other
MSAEKPAPVRVLYCGVCGLPAEYCEFGPDFERCXXWLRAHXASTPTTLSPPPPHPAAATRTSTRSGIASRASGSPTAPPAPQGLLPXLSPKRRNAAWW

SEQ ID NO: 4982 - DNA, 313 bp, Zea mays
  misc_feature: Ceres CLONE 313188-F
  misc_feature (80)..(80): n is a, c, t, g, unknown, or other
  misc_feature (81)..(81): n is a, c, t, g, unknown, or other
  misc_feature (146)..(146): n is a, c, t, g, unknown, or other
  misc_feature (171)..(171): n is a, c, t, g, unknown, or other
  misc_feature (172)..(172): n is a, c, t, g, unknown, or other
acgcatcgccgctgctcgctcgcgttcgssgcgccctcgctccctgtcactccctcgtcccccgccccatccacgccgcnncgccctccgcctccaaataaagtaaatgcgggtgacaggacgccaccaccaaatccacctgcgcncttaacccatcgccgccccgctcgnncccctccgccttcttcgccgccggcccccggactgcgamsstcccaggagcctagaaggacccggcgccatggggttctgggagttttttcttaactggctccgcagcctcttcttcaagcaagagatggagctttcattg

SEQ ID NO: 4983 - DNA, 190 bp, Zea mays
  misc_feature: Ceres CLONE 313200-F
tcacttcctctccctccctcactcggccaaagctgactacagcctacaagcgavsgtcagaagagctcttcccgatagccatggccaagcccccgcttcaaacggstgcgatcatcctcctcgtactcctctcggccgcgtcgtgsctcccacaccgtcgatgccgccactttagggttctgttggggca

SEQ ID NO: 4984 - DNA, 491 bp, Zea mays
  misc_feature: Ceres CLONE 313223-F
  misc_feature: Encodes the peptide sequence at SEQ ID NO. 4985
  misc_feature (162)..(162): n is a, c, t, g, unknown, or other
  misc_feature (163)..(163): n is a, c, t, g, unknown, or other
atccatcgagctgcccgcgcgcktcagttaagctcacacatcagctagctcaccttggacggccgaccaggtacgttgcgagckatggcgggatacaaagcgtcgggcggcaggcgctcggcgtcgtcctggctgttgccgcgctcctcgccgcggggssannggcggtggackacgagcacatgtaccactggaagtgcttcaactcgtgcacggggaagtgccgcgacgaggacgcctttgacgacggccaccgttccgggattcgaacgtctcttccgtcgtctctggcggcaagtgcamaacaggtgcctcagcgagtgcttcgaggacctgccggccatctgctaccaccagtgcgtcgtcagcaagtgcctctgcttcccaccctttagcaaagagaaaacgatgtgcattgaagagctgctgcaacaagtgcttccaccacggcccgccagcgcctggtcctggcccgaagccgatgccgccaa

SEQ ID NO: 4985 - protein, 135 aa, Zea mays
  misc_feature: Ceres CLONE 313223-F
  misc_feature (26)..(26): Xaa is any aa, unknown, or other
  misc_feature (27)..(27): Xaa is any aa, unknown, or other
  misc_feature (73)..(73): Xaa is any aa, unknown, or other
MAGYKASGGRRSASSWLLPRSSPRGXXRWTTSTCTTGSASTRARGSAATRTPLTTATVPGFERLFRRLWRQVXNRCLSECFEDLPAICYHQCVVSKCLCFPPFSKEKTMCIEELLQQVLPPRPASAWSWPEADAA

SEQ ID NO: 4986 - DNA, 354 bp, Zea mays
  misc_feature: Ceres CLONE 313225-F
  misc_feature: SWISSPROT Homolog: EC 5.5.1.6 Chalcone isomerase
atccgttgcgctgctcccggttccatcgcgcggtgssgaatttaacatggccgtgcggaggtggtgctcgacggcgtsstcttcccgccggtggcccgcccgccgggtccgccggctcgcacttcctcggcggcgcaggcgtgcgaggcctcgagatcggaggcaacttcatcaagttcacggccatcgggtgtacctggaggacgcggccgtgccgccttggccaagaagtggggcggcaagacggccgacgagctcgcctccgacgccgccttcttccgcgacgtcgtcacgggcgacttcgagaagttcacgagggtgacgatgatcctcccgctgacgggcgagcagtac

SEQ ID NO: 4987 - DNA, 217 bp, Zea mays
  misc_feature: Ceres CLONE 313245-F
  misc_feature: Encodes the peptide sequence at SEQ ID NO. 4988
  misc_feature (130)..(130): n is a, c, t, g, unknown, or other
gaacgcattcctcccatctcccaagacctcctcagacccgagaagcgcmbgcgggccatggacgccaccggcactggagctggagggaaggcgaagaagggagcggccggtcgcaaggccgcgggccganggaagaagtcggtgacgaggtccgtgaaggccgggctccagttccccgtcggccgcatcgggcgctacctcaagaagggccgctacg

SEQ ID NO: 4988 - protein, 53 aa, Zea mays
  misc_feature: Ceres CLONE 313245-F
  misc_feature (25)..(25): Xaa is any aa, unknown, or other
MDATGTGAGGKAKKGAAGRKAAGRXKKSVTRSVKAGLQFPVGRIGRYLKKGRY

SEQ ID NO: 4989 - DNA, 185 bp, Zea mays
  misc_feature: Ceres CLONE 313248-F
  misc_feature (59)..(59): n is a, c, t, g, unknown, or other
acttccgcccaaatccaccaccgccataccagcgtgtccgcgattccgtcgagtagacnggggcgagagagtagtctcggacgagaagaggcgaatatgagttccggcggcggcaggggcaagcccaaggtggtccaaggctttgtcgcggtcgaccaakkccgggctgcagttccccgtcggcc

SEQ ID NO: 4990 - DNA, 466 bp, Zea mays
  misc_feature: Ceres CLONE 313249-F
  misc_feature: Encodes the peptide sequence at SEQ ID NO. 4991
  misc_feature (353)..(353): n is a, c, t, g, unknown, or other
agatcacactcgtagaagaaggaaaaatatccccaaaccctagctcccgatctcgatggcgaaccctcgcgtcttcttcgacatgaccgtcggcggcgcccagcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtctatctacggcgagaaggttccccgacgagaagttcgtgcgcaasatcncgcccccggtgystcctccatggccaacgccgggcccaacaccaacggctcccagttcttcatctgcaccgtcgcgaccccttggctcgacggcaagcacgtcgttcttcggc

SEQ ID NO: 4991 - protein, 116 aa, Zea mays
  misc_feature: Ceres CLONE 313249-F
  misc_feature (1)..(116): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (78)..(78): Xaa is any aa, unknown, or other
  misc_feature (79)..(79): Xaa is any aa, unknown, or other
  misc_feature (83)..(83): Xaa is any aa, unknown, or other
MELYANEVPKTAENFRALCTGEKGVGKSGKPLHYKGSTFHRVIPEFMCQGGDFTRGNGTGGESIYGEKVPRREVRAQXXAPGXSSMANAGPNTNGSQFFICTVATPWLDGKHVVLR

SEQ ID NO: 4992 - DNA, 502 bp, Zea mays
  misc_feature: Ceres CLONE 313251-F
ctagcttcgatagctgctgattctttactaatgtaattctaagtgattgtttagtaaaaataaatctatttgatgaaaaccgtttgtacaaataagatgtgaagcgattcttgaaggttagagagtgaggagtaggttgagacttggaagcggtgggaagctgatttttttggttctcactgtatagtacaaaatagaaactagattcaatttactcccatcatagagtaattttagatttttagcggtttgggagtgattctgggagcggatgtgagctctgcaaaacgcctcctgtgtgcccaagtgatccagtccacagactcagactcaggctctaggaggagtgatgagctctgcagccagtgacccctgtcggcggcggtassttaaattggccaccatgtcgccacgatccatcggactcctctgcaaataaagccatcgggggagtgactgactgagtcagtagagtgggtgtgaggagagctttgaggggagg

SEQ ID NO: 4993 - DNA, 1300 bp, Zea mays
  misc_feature: Ceres CLONE 313261
  misc_feature: Encodes the peptide sequence at SEQ ID NO. 4994
gcgctctgtgcacagacgaccttcttcccatcccttcccttccctctgctagtctgcttcgttcctcggccatggtggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcgtgcgaggagcacgggttcttccgggtgacgggccacggcgtgccggccagactcgtgcgcgccgcggaggccgcggcggccgggttcttcgcgcggccacagggcgagaaggaggaggagggccccacgctcgggtacggaagcaagcgcatcggcggcaacggcgacctcggctgggtcgagtacctcctgctcggtggcacacccgccgccgccgcgtcctcctcggcattattgccctgcgccgccgccccgtcgccgtccgcgccggccgggccgttacgggaccttctggacgagtacacggtggcggtgcggcggatggcgtgcgcggtgctggagctgatggcggaggggctgggcatcgccggggacgcgccgcagctggcgcggctggtggcgcgcgcggacagcgactgcatgctgcgggtgaaccactacccgccgcggccggcgctcaaccccagcctcacggggttcggcgagcacaccgacccgcagatcatctcggtgctccgcgccaacggcacctccggcctggagatcgcgctgcgggacggcgcctgggcctccgtcccgcccgacggggacgccttcttcgtcaacgtcggcgacaccctgcaggtgttgacgaacgggaggttcaggagcgtgaggcacagggtggtggtgaacagcgagaagtcccgggtgtccatggtcttcttcggcggcccgccgcccggcgagaggctgggcccgctgccgcagctcctgggcgacggcggccggagccggtaccgggacttcacctggagcgagttcaagaccagcgggtgcaggaccaggctcgcggaagaccgcctgtcccgcttcgagaagaagtagctagaggctacgtcatttgcatgaccggcggtaggatcgattaccatgtatgcttctctgtatatgtcagttgcattgccacagctctagctactggcgcccgtacgtgtatattagtggccatgctcgtattgtacgtgcacgtgtatgcacgcatatacatggtggcaccacacagggtatcatgcatccattgttatctatacaaaaaaaaaaaaaaa

SEQ ID NO: 4994 - protein, 335 aa, Zea mays
  misc_feature: Ceres CLONE 313261
  misc_feature (185)..(286): Pfam Name: 2OG-FeII_Oxy Pfam Description: 2OG-Fe(II) oxygenase superfamily
  misc_feature: SWISSPROT Homolog: EC 1.14.11.13 Gibberellin 2-beta-dioxygenase
  misc_feature: The sequence is a functional homolog of SEQ ID NO 2 in US patent 7262340
MVVLAKGELEQIALPAAEPPPADVRSVDLSAPAGPAREAAARALVAACEEHGFFRVTGHGVPARLVRAAEAAAAGFFARPQGEKEEEGPTLGYGSKRIGGNGDLGWVEYLLLGGTPAAAASSSALLPCAAAPSPSAPAGPLRDLLDEYTVAVRRMACAVLELMAEGLGIAGDAPQLARLVARADSDCMLRVNHYPPRPALNPSLTGFGEHTDPQIISVLRANGTSGLEIALRDGAWASVPPDGDAFFVNVGDTLQVLTNGRFRSVRHRVVVNSEKSRVSMVFFGGPPPGERLGPLPQLLGDGGRSRYRDFTWSEFKTSGCRTRLAEDRLSRFEKK

SEQ ID NO: 4995 - DNA, 547 bp, Zea mays
  misc_feature: Ceres CLONE 313291-F
  misc_feature: Encodes the peptide sequence at SEQ ID NO. 4996
agggtttcgcacccaacacccggcagacgaggtgcagagggcagcggtgagcagttggaacgagcttgactatgaggcggaagcgcgtttggtggcggaggcgagggcgtcgtgggataggaaggcaaggggggaggaggaggatgaagaagaacatgatcctgagatgaccttggactactacgcctaccaggctaaaaagtttcgcaacacctggaacatcctctatttcggccacttcggtcgcttcgaggacaccacaaggatccctcctatgcgctttacagagaagccgcctgactccccggcgtacccgcgcactacactgcaggtcttttcgatcaaagttgcagggatagaggggggtttacagtggccactccatgtgtttgggaaggttgccctacgcgacgcagttgatcacaatcgcaatatggtcttcgatcgcactagagacaactgccaaatccttacaaaagaggttccaaatttgaaacttgacaggtcttagccgtgctgttctgcyggtggaacctgtgactattga

SEQ ID NO: 4996 - protein, 169 aa, Zea mays
  misc_feature: Ceres CLONE 313291-F
GFRTQHPADEVQRAAVSSWNELDYEAEARLVAEARASWDRKARGEEEDEEEHDPEMTLDYYAYQAKKFRNTWNILYFGHFGRFEDTTRIPPMRFTEKPPDSPAYPRTTLQVFSIKVAGIEGGLQWPLHVFGKVALRDAVDHNRNMVFDRTRDNCQILTKEVPNLKLDRS

SEQ ID NO: 4997 - DNA, 410 bp, Zea mays
  misc_feature: Ceres CLONE 313323-F
tccaacatccctccattgtcctaccaaaaatcgcagcgccgcccgcaccaatctcgaagtgttcgaaagtttccagacccccaaaaggcgamggcgatgagttccaccggagcggcggccgcgggaaggcgavsagcgaccaagtcggtgtcgcggtcctccaaggctgggcttcagttccccgtcggtcgcatcgcgcggtacctcaaggccgggaaatatgccgagcgcgtcggcscgtgtgkcccccgttgtacctctccgctgttctcgagtatctcgccgccgaggtgctcgagctggccgkgaacgctgctcgggacaacaagaagaaccgtwtcgtgccgcgccacatccagctggcggtgcggaacgacgaggagctgagcaagctgctgggcactgtgacg

SEQ ID NO: 4998 - DNA, 455 bp, Zea mays
  misc_feature: Ceres CLONE 313325-F
  misc_feature: Encodes the peptide sequence at SEQ ID NO. 4999
  misc_feature (153)..(153): n is a, c, t, g, unknown, or other
accgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggcgnggcctacacaaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcgcaccctcctcgtcggcc

SEQ ID NO: 4999 - protein, 92 aa, Zea mays
  misc_feature: Ceres CLONE 313325-F
  misc_feature (1)..(92): Pfam Name: Ribosomal_S9 Pfam Description: Ribosomal protein S9/S16
MIKVNGVPIELLRPEMLRLKAMEPVLLAGRSRFKDIDMRIRVRGGGKTSQIYAIRQAVAKGLVAYYQKYVDEAAKKEIKDIFMRYERTLLVG

SEQ ID NO: 5000 - DNA, 175 bp, Zea mays
  misc_feature: Ceres CLONE 313353-F
  misc_feature (93)..(93): n is a, c, t, g, unknown, or other
acaccaagaaagaatcacacaacagcagctcaaaaacctaacacacctcaacaagcagagcaaagacccgggattcgccggcgcggtassagnagcrgtagatggacgggaggatgttctgtctcgagacccccctgatggtggcgctgcagcaccttctggacgtgcccgacgg

SEQ ID NO: 5001 - DNA, 511 bp, Zea mays
  misc_feature: Ceres CLONE 313371-F
  misc_feature: Translation starting site: 207
  misc_feature: SWISSPROT Homolog: EC 2.3.1.74 Naringenin-chalcone synthase
  misc_feature (202)..(202): n is a, c, t, g, unknown, or other
  misc_feature (203)..(203): n is a, c, t, g, unknown, or other
atcttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgcmwtcccgcagcagnngtcatgcaggactacgtcgtcgacggcttcatgaagaacaccaactgtgacgacccggagctcaaggagaagctcaccagactctgcaagacgacgaccgtgagactcggtacgtggtgatgtcggatgagatcctcaagaactacccggagctggcgcaggaggggctgccgacgatgaatcagcgtctggacatctcgaacgcggcgggtgacssagatggcgacggaggcgtccctgtcgtgcgtccgctcgtggggcggcgcgctctcgtccatcacccacctcgtgtacgtctcgtcgagcga

SEQ ID NO: 5002 - DNA, 635 bp, Zea mays
  misc_feature: Ceres CLONE 313406-R
ccgattgggtaccgggccccccctcgaggtcgacggtatcgatattttttttttttttttttgaatgacgccataattattaattaatatgggtccgattaccaaatttcacacaacaatacaatcgaaaccaccacgaaaacatggaatgcatatcatacctcgtgtacatgtaataacgaggacatatctggtgtacatggaagcttagtatatatggtgcacatattaaatcatcactatttattttagatttaacgtctctagttgatcattgcaatttataaataatattttccaccgctatacttcaccacgtcggagggtgttcttagcaaaatataccaacaactagagacattatatctaaaatgagtgatgctgatttaatatatgcaccatgtacactaaatttatatatgcaccagatatgttccctataataattatgtatacgtataggagggtgcgagcgatatcaggcggagccgcccttgagcctcttggcgatgccggcgaaatacttgcccttggtgaaagcgtgctccaactccagtttcggtccggcaaacgcgacccgtcccccgcgaacatgcccccgccctaacgggcttgcgccgtgcaaccttcttcag

SEQ ID NO: 5003 - DNA, 306 bp, Zea mays
  misc_feature: Ceres CLONE 313409-F
  misc_feature: Encodes the peptide sequence at SEQ ID NO. 5004
  misc_feature (284)..(284): n is a, c, t, g, unknown, or other
aaggcaaggcaacgcgccgtcatctcattctccctcgcaccgacgaggtcaggtcagagacttcgagtactactagtcatggcccgcatctagaaggcagcaagawagggggcggatggggcgcgcgttcgtgtacgtgatcctgggcggcggcgtggccgggctacgcggctcgagttcgcccgccgcggtgggtactcccgcggagagctctgcatcatctccgaagagggccgttgctccttatgaacgtcctgcactaagcaaaggctatttactcccanaakgtgctgctcgtcttccagg

SEQ ID NO: 5004 - protein, 63 aa, Zea mays
  misc_feature: Ceres CLONE 313409-F
  misc_feature: SWISSPROT Homolog: EC 1.6.5.4 Monodehydroascorbate reductase (NADH)
  misc_feature (57)..(57): Xaa is any aa, unknown, or other
  misc_feature (58)..(58): Xaa is any aa, unknown, or other
MGRAFVYVILGGGVAGLRGSSSPAAVGTPAESSASSPKRAVAPYERPALSKGYLLPXXAARLP

SEQ ID NO: 5005 - DNA, 105 bp, Zea mays
  misc_feature: Ceres CLONE 313428-F
acgcacaccgcgacccagtccagagccagtacgtgcgamgtcacgcacgctgctggtccgcgtacgagacgacggtcaggtcggccggtgcttttcagtttggaa

SEQ ID NO: 5006 - DNA, 183 bp, Zea mays
  misc_feature: Ceres CLONE 313445-F
  misc_feature (25)..(25): n is a, c, t, g, unknown, or other
aattaatcaatccttcaagcgcaangcctcctcctcgtcgtccggtcgtgagaagggatggcgggccgtggcaaggctatcggcgctggcgccggaagaaggcaacgtcgaggagctccaaggccggactccagttccccgtcggcaggattgccaggttcctcaaggcgggcaagtacgcgg

SEQ ID NO: 5007 - DNA, 518 bp, Zea mays
  misc_feature: Ceres CLONE 313455-F
  misc_feature: Encodes the peptide sequence at SEQ ID NO. 5008
  misc_feature (176)..(176): n is a, c, t, g, unknown, or other
actttcgatcgacacagaaaattccccaccaaaatctcctccccctgaagtcccgaagctcgcggaassccgagatgtaccatcccacgagaggcggcgtccgcggcggcagagatcaattcaaatgggacgatgtgaaggttgacaagcatcgggagaattaccttggtcatagngttaaggctccaggttggtagatggcagaaaggaaaggatctttactggtatactcgggataagaaatccgacacgggagatgctcttaaggaagaaatcaggagagtgaaggaagaggaggaacaggctatgcgtgaggctcttggcttagctcctaagcgcmssaatcgaactcagggtaatcgcttggataagcatgaatatgctgagctgatttaagagaggatcaactgcggaggacttgggagcakgacacgcttgaagcaggcacaagtgcagggtctaggattgtacaaggcccctcgcgatgaggtggatcagttctttgagcttgacctcct

SEQ ID NO: 5008 - protein, 40 aa, Zea mays
  misc_feature: Ceres CLONE 313455-F
  misc_feature (34)..(34): Xaa is any aa, unknown, or other
MYHPTRGGVRGGRDQFKWDDVKVDKHRENYLGHXVKAPGW

SEQ ID NO: 5009 - DNA, 270 bp, Zea mays
  misc_feature: Ceres CLONE 313460-F
  misc_feature: Encodes the peptide sequence at SEQ ID NO. 5010
  misc_feature (139)..(139): n is a, c, t, g, unknown, or other
acgaaacccaatcctgcttcgatcccgtcggccggcgatggagggccggcggcggtgcgcgcccgtgggsggcctgcccatcggcttccgcttccgtcccaccgacgaggagctgctgctgcactacctccgccgcaantggccctgcccgctccccgccggcgtcatccccgacgccgacctcgcgcgcctccacccgtgggacctcctccccgccgcckycgccgcaccagggggatccggagccgacgccgacggggagcgctttct

SEQ ID NO: 5010 - protein, 77 aa, Zea mays
  misc_feature: Ceres CLONE 313460-F
  misc_feature: The sequence is a functional homolog of SEQ ID NO 1012 in the 11/435,388 US patent application
  misc_feature: The sequence is a functional homolog of SEQ ID NO 853 in the 10/374,780 US patent application
  misc_feature (34)..(34): Xaa is any aa, unknown, or other
  misc_feature (62)..(62): Xaa is any aa, unknown, or other
MEGRRRCAPVGGLPIGFRFRPTDEELLLHYLRRXWPCPLPAGVIPDADLARLHPWDLLPAAXAAPGGSGADADGERF

SEQ ID NO: 5011 - DNA, 471 bp, Zea mays
  misc_feature: Ceres CLONE 313484-F
  misc_feature: Translation starting site: 84
  misc_feature (238)..(238): n is a, c, t, g, unknown, or other
  misc_feature (243)..(243): n is a, c, t, g, unknown, or other
  misc_feature (259)..(259): n is a, c, t, g, unknown, or other
aatcacaattcacagcgctcaagttctcgcgcccacagccaaatttttctccactcaatcgcggcataagctgcactgcmsscatggacgccagcggasscggtagcaaggcgaagaagggggcggctgggcgcaaggctggcggccccaggaagawgtcggtgtbsgcggtccgtcaaggccgggctgcagttccccgtvsggccggatcgggcgctacctcaagaaggggcggtanvscancgttggvscaccggcncccccgtctatctcgccgccgtgcttgagtacctcgccgccgagtgctggagctggcctgggtwwygcggcgaaggacaacaagaagacgcgcattcgtcccgcgacacttgctcctggcgattcgtaacgacgttgagctcggcaagctgctgttctggcgtcaccatcgcgcacggsgttkktcctccccaacatcaacccggttctcct

SEQ ID NO: 5012 - DNA, 503 bp, Zea mays
  misc_feature: Ceres CLONE 313502-F
  misc_feature: Translation starting site: 104
  misc_feature (444)..(444): n is a, c, t, g, unknown, or other
gtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgssacgcagaacgtgctcggcgagaagggccgcagatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgcknccgcaggctttgctatggtgttcttcgttatgttatggagagtggtgccaagggttgtg

SEQ ID NO: 5013 - DNA, 489 bp, Zea mays
  misc_feature: Ceres CLONE 313606-F
  misc_feature: Translation starting site: 125
  misc_feature: SWISSPROT Homolog: EC 1.3.1.33 Protochlorophyllide reductase
atccccccgcgtagaggagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgccgtctggcaagaagaccctccgcaaggcacagcggtcatcaccggcgcgtcgtccggcctcggcctcgccacggcgaaggccctcgcggagacaggcaagtggcacgtcatcatggccctgccgcgacttcctcaaggcgtc

SEQ ID NO: 5014 - DNA, 485 bp, Zea mays
  misc_feature: Ceres CLONE 313618-F
  misc_feature: Encodes the peptide sequence at SEQ ID NO. 5015
  misc_feature (15)..(15): n is a, c, t, g, unknown, or other
  misc_feature (59)..(59): n is a, c, t, g, unknown, or other
  misc_feature (434)..(434): n is a, c, t, g, unknown, or other
aaaaccctagcgccncccacccacccacccactcgcttcagccgcctccgccgcgcgtntcaagcaggtggagacaggatgccggctggccacggcctgcgctcgcggacgscgaccctcttcgcgcccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggtccgaggtcaacaagcaggtcaatgggcgcatcatcaggaagcgtatccatgtccgtgtggagcatgtgcagccgtcccgctgcacagaagagttccgcctgaggaagggcgaagaatgaccagctgaaggcggatgcnaaawagcgcggcgaggttatcagcaccaagaggcagccattgggtcccaag

SEQ ID NO: 5015 - protein, 131 aa, Zea mays
  misc_feature: Ceres CLONE 313618-F
  misc_feature (40)..(102): Pfam Name: Ribosomal_L21e Pfam Description: Ribosomal protein L21e
  misc_feature (5)..(5): Xaa is any aa, unknown, or other
  misc_feature (37)..(37): Xaa is any aa, unknown, or other
NPSAXHPPTHSLQPPPPRVSSRWRQDAGWPRPALADXDPLRAPFRKKGYIPLTTYLRTYKIGDYVDVKVNGAVHKGMPHKFYHGRTGRVWNVTKRAIGPRSTSRSMGASSGSVSMSVWSMCSRPAAQKSSA

SEQ ID NO: 5016 - DNA, 128 bp, Zea mays
  misc_feature: Ceres CLONE 313630-F
  misc_feature (94)..(94): n is a, c, t, g, unknown, or other
acacgcacaccgcgacccagtccagagccagtacgtgcgamgcacgcacgctgctggtccgcgtacssagacgacggtcaggtcggccggtgcnttttcagtttggaataatgacggcgacgacgacg

SEQ ID NO: 5017 - DNA, 498 bp, Zea mays
  misc_feature: Ceres CLONE 313646-F
  misc_feature (32)..(32): n is a, c, t, g, unknown, or other
  misc_feature (305)..(305): n is a, c, t, g, unknown, or other
  misc_feature (307)..(307): n is a, c, t, g, unknown, or other
  misc_feature (308)..(308): n is a, c, t, g, unknown, or other
atagccttatagccacataccggccagccgcngcaagtgcccagaaggccagaaccagaaccaagcagctcgttgcaacctcatatcatcccctgccacgcacctccgtccgccgcgccatggaatcgaggaggagggccgtgccaccgtgacggcggttgcggtggcgacgctgctgctgacgatgatgacgtcgtcgggcgtgggcggcgacttcgcggcggaccgggcggagtgctcggagcagttggcggggctggcgacgtgcctgacgtacgktgcaggagcaggcgacggcgacggcnanncgcccgactgctgcgcgggcctcaaggcggtgctgcagagcagccggcaagtgcctgtgcgtgctggtcaaggaccgggacgaccccaatctaggcctcaagctcaacgtcgacaaggcgctcggcctccccgccgtctgccacgcgcccgccaacatctccgactgccccaggctgctggacctgccgg

SEQ ID NO: 5018 - DNA, 352 bp, Zea mays
  misc_feature: Ceres CLONE 313666-F
  misc_feature: Encodes the peptide sequence at SEQ ID NO. 5019
  misc_feature (314)..(314): n is a, c, t, g, unknown, or other
ctgcccaactgcccgctgaaaaacaaactcacccaacaaagtgacctgaaactgggagcaagcaaccgagggcgagagcatggcgaacstccgcggcggcggcggcctcctggacttagaggggcactacgccttctacggcgcctaccacagcaaccccgtcaacgtgggcatccacgagctcttcgtctggcccatcttcctcaccgcgctcatgctcctccacctcaccgccccctccacgcacgccgccggyrtcagcgccgcagtctacgcggcctactacttcctcctcgaccgccgcgcggccgctncgccgccctcttctgctacctctgctgggccgccagcg

SEQ ID NO: 5019 - protein, 91 aa, Zea mays
  misc_feature: Ceres CLONE 313666-F
  misc_feature (10)..(89): Pfam Name: DUF962 Pfam Description: Protein of unknown function (DUF962)
  misc_feature (4)..(4): Xaa is any aa, unknown, or other
  misc_feature (60)..(60): Xaa is any aa, unknown, or other
  misc_feature (79)..(79): Xaa is any aa, unknown, or other
MANXRGGGGLLDLEGHYAFYGAYHSNPVNVGIHELFVWPIFLTALMLLHLTAPSTHAAGXSAAVYAAYYFLLDRRAAAXPPSSATSAGPPA

SEQ ID NO: 5020 - DNA, 111 bp, Zea mays; identical to SEQ ID NO: 4888
  misc_feature: Ceres CLONE 313668-F

SEQ ID NO: 5021 - DNA, 132 bp, Zea mays
  misc_feature: Ceres CLONE 313688-F
gtttgatttggatgagaggagcgcggcggcggtgatggggacccttcgcagggctcggcgaccgtgacggcggcccgggtcgacctctgcgcgctcgacctcatgcccgtctttgccaaggagatgatcgcc

SEQ ID NO: 5022 - DNA, 496 bp, Zea mays
  misc_feature: Ceres CLONE 313737-F
  misc_feature (287)..(287): n is a, c, t, g, unknown, or other
acccatcttgcagcaggcggaccgacccaatccgtgcgtgtgttggtcgagatggctacaacagcttacgctcccatggcgagccaggtgatgaagagcagcccggtgcactcgaggccgaggggctgttcaggcgctgcgctcacgcggccccggccccggtttcagcgtcgtcaaggccgccatccagcccgagaaggcaacgtaccaggtggtgcagcccawtcaacggcgacccgttcatcggcagcctggagacgcccgtcacctccagcccgctcatcgcntggtacctctccaacctgccggcctaccgcaccgccgtgagcccgctgctgcggcgtccgaggtcggcctcgccacggctacctcctcgtcgggcccttcgcgctcaccggcccgctccgcaacacgcccgtgcacggccaggcgggcgcgctcggcgcgcggccctccgtcgccatcctcagcgtctgcctcaccatgtacggcgtcg

SEQ ID NO: 5023 - DNA, 479 bp, Zea mays
  misc_feature: Ceres CLONE 313746-F
  misc_feature: Encodes the peptide sequence at SEQ ID NO. 5024
ctttcccctcatctcctctccacctcatccgtatctccctccttctcggcggccgtggcggcgcggaggactatgcgcggcctccaccgctgcccgcaccagctcctcctggtctctccaccgccgcggtccgcccccgcgttccgccagtcggccaccgcctcatcgcggggcctcaggagctccctcgccgtcttctccgcccccggggctcgggtagcggcggcggcgcgcgaacagaagtggggccacgtggagggtgatgaagacggtggagaggagggcctcggggaggcgctccacaggacgcgggagctcgtggagtgcgccatgttcgcggccgtcgctgggctcgcctacttcctcagcaattccctcgccattgagaattattttcagttgctttttcccattgccgatagtcatttcctcattaagatggggactagaagccagcaggaaaaccgtggtggctactg

SEQ ID NO: 5024 - protein, 135 aa, Zea mays
  misc_feature: Ceres CLONE 313746-F
MRGLHRCPHQLLLVSPPPRSAPAFRQSATASSRGLRSSLAVFSAPGARVAAAAREQKWGHVEGDEDGGEEGLGEALHRTRELVECAMFAAVAGLAYFLSNSLAIENYFQLLFPIADSHFLIKMGTRSQQENRGGY

SEQ ID NO: 5025 - DNA, 119 bp, Zea mays
  misc_feature: Ceres CLONE 313779-F
  misc_feature (43)..(43): n is a, c, t, g, unknown, or other
acacgcacaccgcgacccagtccagagccagtacgtgcgamgncacgcacgctgctggtccgcgtacgagacgacggtcaggtcggccggtgctttttcagtttggaataatgacggcg

SEQ ID NO: 5026 - DNA, 738 bp, Zea mays
  misc_feature: Ceres CLONE 313783-R
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
ccgattgggtaccgggccccccctcgaggtcgacggtatcgataagcttttttttttttttttttgaacaagctgacatcaaggtactgtagcaaacaaccataatgtattactgtgcaccacggttcacagaacagtttcatcggcagtttcacggatcgaactaacaaaagatagaaaggcatgccacaccagtacatgatagtagtatatttagaggtcgttacaggagtttgtagctcgctttagctgactctctccaagagtttgacagatgacagcagacactggacatggagtcaggggagcagcagtattttgccaatgtgcgtgctagattcgatcaaccgatgagcatcagctgctccggataacgggaacgtcttgtagatcacggggttcaccttgccagcagcgacggcgggccacacgttcttctccacctcactgacgatctgggctttactagcagcgcttctgccgcgcagtccagcagctgcactcacaacagctgccacctcgggtaagccggccgcgtccgcaagggacacgccctccggcaccggcagcagctgtcccgccggcaccaccaccttctcggcgtacccgccgccgctaagcagcgcgcagaccttgtcgccgacggcccaccgtggtggggcgttggggccgagcgcgaggatgggccggacacgccccccccggggaagggggggggggggnnnnnnnnnnnnnnna

SEQ ID NO: 5027 - DNA, 500 bp, Zea mays
  misc_feature: Ceres CLONE 313830-F
  misc_feature: Encodes the peptide sequence at SEQ ID NO. 5028
  misc_feature (165)..(165): n is a, c, t, g, unknown, or other
gaatctctctctacataaacaaaacccagtcctttgttcttcccccggcacgcctagcgccagtcaccaaccttccactccctccctccgtcgccatggcgcgcaagaagatccgggagtacgactccaagcgcctcctcagggagcacctcaagcgcctcgcgngcatcgacctcaccatcctctccgcccagatcacgcaatcaacggacttcgcagagcttgtgagccagcagccatggctgtcaaccatgaagctagtggtgaagcccgatatgctgttcgggaagcgtgggaagagcggcctcgtggctctcaacttggatttcgatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgt

SEQ ID NO: 5028 - protein, 135 aa, Zea mays
  misc_feature: Ceres CLONE 313830-F
  misc_feature: SWISSPROT Homolog: EC 2.3.3.8 ATP citrate synthase
  misc_feature (24)..(24): Xaa is any aa, unknown, or other
MARKKIREYDSKRLLREHLKRLAXIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSEC

SEQ ID NO: 5029 - DNA, 349 bp, Zea mays
  misc_feature: Ceres CLONE 313848-F
  misc_feature: Encodes the peptide sequence at SEQ ID NO. 5030
  misc_feature (64)..(64): n is a, c, t, g, unknown, or other
  misc_feature (229)..(229): n is a, c, t, g, unknown, or other
  misc_feature (296)..(296): n is a, c, t, g, unknown, or other
kgcggcccacacccctcaccgcgtccgcctcccctaccatctagggtttctagggttttcgagnaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgcbscmnatgacaccgtcggcagcggcaacgacggccgcgccaaggccctcgatgtcaccgcgcccggcggcgncccgcttgccggcggggaacgtcccgacggcggcaacggcgttgggcgaggcg

SEQ ID NO: 5030 - protein, 92 aa, Zea mays
  misc_feature: Ceres CLONE 313848-F
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature: The sequence is a functional homolog of SEQ ID NO 468 in the 11/479,226 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature (52)..(52): Xaa is any aa, unknown, or other
  misc_feature (53)..(53): Xaa is any aa, unknown, or other
  misc_feature (75)..(75): Xaa is any aa, unknown, or other
MASDRVLGTVKWFNGTKGFGFITPDDGSEDLFVHQSSIKSDGYRSLNDGDAXXDTVGSGNDGRAKALDVTAPGGXPLAGGERPDGGNGVGRG

SEQ ID NO: 5031 - DNA, 493 bp, Zea mays
  misc_feature: Ceres CLONE 313850-F
  misc_feature: Encodes the peptide sequence at SEQ ID NO. 5032
gacgattccgatcccctcccgtcccgtccatcccgtctcggtctcgccctccacgccggcgaccggagaaggggccgtgcagcgcaggcgacgccacaacgaatccgtccccccgcgccggcttcgccagccccgcggcgacssccaggattgaaggaggcatgawaaggtggacatcgttgctatagccatttgattactggaaatggtgttggtggtaaagcagcaccgcyssacacactctgcgagctgcgtttgcatcaagggccacctcagtgaggatgctctgttcctcgtcttccgccacatgaactggaacccgaggctgattgctatcttgtcgtgtgtgtgcaagtggtttgatgaggttgccaagcaggtgctgtggaaggagttctgtcatgcaagggctccaaagatgatgctggatttgcattcaggtggcagccacattgttgatgggaactggaaggcattggggaagctgctcatc

SEQ ID NO: 5032 - protein, 96 aa, Zea mays
  misc_feature: Ceres CLONE 313850-F
  misc_feature (10)..(10): Xaa is any aa, unknown, or other
MVLVVKQHRXTHSASCVCIKGHLSEDALFLVFRHMNWNPRLIAILSCVCKWFDEVAKQVLWKEFCHARAPKMMLDLHSGGSHIVDGNWKALGKLLI

SEQ ID NO: 5033 - DNA, 442 bp, Zea mays
  misc_feature: Ceres CLONE 313851-F
  misc_feature: Encodes the peptide sequence at SEQ ID NO. 5034
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacggcgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagag

SEQ ID NO: 5034 - protein, 119 aa, Zea mays
  misc_feature: Ceres CLONE 313851-F
  misc_feature (25)..(118): Pfam Name: Ribosomal_60s Pfam Description: 60s Acidic ribosomal protein
MGVYTFVCRNNGGEWTAKQHSGEIEASAATPYELQRRLVAAASAADSAYGVQSSFSMVTPSSAVFQVIVGAVGGGAMMVSGGGGGAAASGGAAAEAPKEEKKEEEKEESDDDMGFSLFD

SEQ ID NO: 5035 - DNA, 408 bp, Zea mays
  misc_feature: Ceres CLONE 313858-F
actttatgagcgcgcgtaacgtgtgctctcaccgtgagatgaccgcgcgtctcacctcacacatgacacatgtaattgcttgaaaatctatggtttagaaagagggaatcagggaagtgaactagcggtccacgatactccgacgcccactttgctacctcggaaccctagccgccgcccatggatatcgccggagaccggcccggtagcgatacgcaaaaggagtggtacgttctttgaccttgtttattgctgcgcccgaggcgtgtggcgcggggggagcaggaaggagaggggaagaacagaaggggaaggcgggcggggccgcgatgtcggtgcggatcaaggcggttgtagaccggttcgtgaaggagctgcaggaggcgctggacgcggacatccaagacc

SEQ ID NO: 5036 - DNA, 509 bp, Zea mays
  misc_feature: Ceres CLONE 313870-F
  misc_feature: Encodes the peptide sequence at SEQ ID NO. 5037
cgttcacttctctttggcccgaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccatttcaatcctttaccgtgtcattcaggacchatcttcttctgctgatgcactgagaacaaaagaagttgcaattacaaatcttacaaactacctcactaaagaaaacagagctgaggagctgcgtaatcttttgacccagctcagaccattttttgcagttattcctaaggcaaagactgcaaaaattgtccgtggaataattgatgctgtcgccaagatacctggaacatcagatcttcaggat

SEQ ID NO: 5037 - protein, 111 aa, Zea mays
  misc_feature: Ceres CLONE 313870-F
  misc_feature (40)..(40): Xaa is any aa, unknown, or other
MSSSMESSYLPATTESLAQAQEAKDASESISILYRVIQDXSSSADALRTKEVAITNLTNYLTKENRAEELRNLLTQLRPFFAVIPKAKTAKIVRGIIDAVAKIPGTSDLQD

SEQ ID NO: 5038 - DNA, 452 bp, Zea mays
  misc_feature: Ceres CLONE 313948-F
  misc_feature: Encodes the peptide sequence at SEQ ID NO. 5039
ataccacactagagccgccgccgccgccgtttcgcgcaccgtaccctagccctcgtcagcggcggcttcgagctcatccagccatgacgttcaagcggaggaatggcagacgcaacaagcacgggcgcggccacgtcaagtacatccgctgctccaactgcgccaagtgctgccccaaggataaggctatcaagctgttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggctggtcagggcccgccgcgcccaggcgttgcagctcctgcag

SEQ ID NO: 5039 - protein, 123 aa, Zea mays
  misc_feature: Ceres CLONE 313948-F
  misc_feature (1)..(114): Pfam Name: Ribosomal_S26e Pfam Description: Ribosomal protein S26e
MTFKRRNGRRNKHGRGHVKYIRCSNCAKCCPKDKAIKLFLVRNIVEQAAVRDVQEACVHDGYVLPKLYAKVHHCVSCAIHAHIVRVRSRENRRNREPPQRFRRRDDGPRLVRARRAQALQLLQ

SEQ ID NO: 5040 - DNA, 207 bp, Zea mays
  misc_feature: Ceres CLONE 313998-F
  misc_feature (93)..(93): n is a, c, t, g, unknown, or other
aactttccggcctccgcttcccaccccgatcatcctgccgcagtgccgctccttccctccctctacccgtcgccgctgctgccatggacgaangtcagccagattttggagaagcaagtgctgtctgccgcgaaggsgggaggacaagctcgatgaggagatcgccgcgctcgaccgcctcgatccggacgacatcgaggcgctccg

SEQ ID NO: 5041 - DNA, 397 bp, Zea mays
  misc_feature: Ceres CLONE 314087-F
  misc_feature: Encodes the peptide sequence at SEQ ID NO. 5042
aaaaacccttcttcggttattcctcgccgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcg

SEQ ID NO: 5042 - protein, 114 aa, Zea mays
  misc_feature: Ceres CLONE 314087-F
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLG

SEQ ID NO: 5043 - DNA, 386 bp, Zea mays
  misc_feature: Ceres CLONE 314091-F
  misc_feature: Encodes the peptide sequence at SEQ ID NO. 5044
  misc_feature (166)..(166): n is a, c, t, g, unknown, or other
atcacacactcgactctcctctctcgcatccgcagcctttcgagctctactccaccccctcgatctcgaagcgcragcagcagtcaggcggccatggacgcgagcgcmsscggagccggcktgwaggcgaagaagggcgcggccgggcgcaaggccggcgggcganggaagaagtcggtgacgaggtccgtcaaggccgggctgcagtttcccgtcggccgcatcgggcggtacctgaagaagggccggtacgcgcrcgtcggcacgggcgcccccgtctacctggccgccgtcctcgagtabsytggccgccgaggtgctggagctggccggcaacgctgccaaggacaacaagaagacccgcatcatcccgcgccacgtgctcc

SEQ ID NO: 5044 - protein, 97 aa, Zea mays
  misc_feature: Ceres CLONE 314091-F
  misc_feature (6)..(6): Xaa is any aa, unknown, or other
  misc_feature (10)..(10): Xaa is any aa, unknown, or other
  misc_feature (11)..(11): Xaa is any aa, unknown, or other
  misc_feature (25)..(25): Xaa is any aa, unknown, or other
  misc_feature (55)..(55): Xaa is any aa, unknown, or other
  misc_feature (70)..(70): Xaa is any aa, unknown, or other
  misc_feature (71)..(71): Xaa is any aa, unknown, or other
MDASAXGAGXXAKKGAAGRKAGGRXKKSVTRSVKAGLQFPVGRIGRYLKKGRYAXVGTGAPVYLAAVLEXXGRRGAGAGRQRCQGQQEDPHHPAPRA

SEQ ID NO: 5045 - DNA, 469 bp, Zea mays
  misc_feature: Ceres CLONE 314108-F
  misc_feature (133)..(133): n is a, c, t, g, unknown, or other
  misc_feature (194)..(194): n is a, c, t, g, unknown, or other
  misc_feature (195)..(195): n is a, c, t, g, unknown, or other
  misc_feature (242)..(242): n is a, c, t, g, unknown, or other
atttccactttcgagcgcagaaacgagagggcaggagcagccgcagtcccggcgatcccgcsgccggtcgccctcatacttcctcgtcactgccttcgtttctcttyycaacaatcaagatgagccgtggcgntagcgcgggtggtggtcaaagttctctgggttasvtctttggaagcgtgtgagccccccannccagcagtggcaccagctgtaagtgctccacctgctgctgcagtgcntccacctsstgagaaaccacctgctgcaaagcctgatggcaccagtcagattgctgctggggttaccagccaaaccaattaaytaccacagggccgacggtcagaacaccggcaacttccttacggaccgcccttcgaccaatgttccacgctgctcctggcggtggctcttccctgggatacctgtttggtggcaactgatggccgctcaccaagctatcaccccc

SEQ ID NO: 5046 - DNA, 174 bp, Zea mays
  misc_feature: Ceres CLONE 314131-F
  misc_feature (126)..(126): n is a, c, t, g, unknown, or other
  misc_feature (127)..(127): n is a, c, t, g, unknown, or other
atccaactcacacacaggctcaccccaccaacagcaagcgaaaatctcccgatcccctctggtctccgcggcgaagatgtcggggcgcggcaagggcgggaagggcctgggcaagggcggcgcgannccggcaaggtgctccgcgataacatccaggggatcacgaagccggcg

SEQ ID NO: 5047 - DNA, 288 bp, Zea mays
  misc_feature: Ceres CLONE 314135-F
  misc_feature: Encodes the peptide sequence at SEQ ID NO. 5048
  misc_feature (142)..(142): n is a, c, t, g, unknown, or other
ggagcagggcaggggttgcgtctcagttcctggttgttgttgtaagctcacaggtttcttctcttcgcgtgasstagctagagtgggatcgcgaggaagaaggatgtcgtgctgcggaggcaactgcgggtgcggcasggantgcaagtgcggcassggctgcggtagggtgcaagatgtacccggacatggttgagcaggtgaccaccaccaccaccacccagactctcatcatgggtgttgsgccatccacgggcgggttcgaggcggcckcgtgagctgagaacg

SEQ ID NO: 5048 - protein, 32 aa, Zea mays
  misc_feature: Ceres CLONE 314135-F
  misc_feature (23)..(23): Xaa is any aa, unknown, or other
MYPDMVEQVTTTTTTQTLIMGVXPSTGGFEAA

SEQ ID NO: 5049 - DNA, 246 bp, Zea mays
  misc_feature: Ceres CLONE 314140-F
  misc_feature: Translation starting site: 55
  misc_feature (89)..(89): n is a, c, t, g, unknown, or other
cttttccctgccacagtcatcagscgccgtaggtagcaggagtgagggagcgcgatggcggagaagaagcagcgcccaggagggtccangaaggacgaggtggwtacccgcgagtacaccatcaassstccassaagssgcctccacggatgcaccttcaagaagaaagcccccaatgctakssaaggaaatcaggaagtttgcacagaaggcaatgggcaccactgacatcaggattgatgtgaa

SEQ ID NO: 5050 - DNA, 436 bp, Zea mays
  misc_feature: Ceres CLONE 314168-F
  misc_feature: Encodes the peptide sequence at SEQ ID NO. 5051
atacaacaggcacgaaacctcgcgccgccaccaaatctccagcgagcgaagaggcggctccggcgagtgcgcggcaacgacgaaggcgtcggggccagtggcgagaggaagagcatgctgaagttcctgtccaaggtggtggtggagtactgccctctggacccgcggaaggcgacggcagtggagctcctcgcgcagtgcaacgtccgcaassratgggactccaacccggcctgctcggtcgagctccgccgcctcccctccccagctccgtccacggacctcaagtcgcagccgactctcccgccttccgagggtcctcgtgacctacttcaccggagctgaagaggccattgtctttgctgatggakctacagcgcaggggcatccgggaccagatcgtcgcacggggccggctcatcgatacggagaagat

SEQ ID NO: 5051 - protein, 76 aa, Zea mays
  misc_feature: Ceres CLONE 314168-F
  misc_feature (33)..(33): Xaa is any aa, unknown, or other
  misc_feature (34)..(34): Xaa is any aa, unknown, or other
MLKFLSKVVVEYCPLDPRKATAVELLAQCNVRXXWDSNPACSVELRRLPSPAPSTDLKSQPTLPPSEGPRDLLHRS

SEQ ID NO: 5052 - DNA, 290 bp, Zea mays
  misc_feature: Ceres CLONE 314186-F
  misc_feature: Encodes the peptide sequence at SEQ ID NO. 5053
  misc_feature (175)..(175): n is a, c, t, g, unknown, or other
  misc_feature (231)..(231): n is a, c, t, g, unknown, or other
aaatatctctcaccagtcaccacctcccctcagcttctccccacctttggtcaggcaggctcaggcaaaggaggcggccaacagggacgagcgatggcgaccaaggtcatctgcttcctggtgctcgcatccctgctcctcgccgtcgcctttcccgtgtctgctctgcggcagngtgaagaaggkcgktcggcggcggaggaggaggcggaggcagtgttagcgtaasgnaggcgccaacctgaatccctgggagtgctcgcccaagtgcgggtcgcggtgctccaaga

SEQ ID NO: 5053 - protein, 57 aa, Zea mays
  misc_feature: Ceres CLONE 314186-F
ISLTSHHLPSASPHLWSGRLRQRRRPTGTSDGDQGHLLPGARIPAPRRRLSRVCSAA

SEQ ID NO: 5054 - DNA, 222 bp, Zea mays
  misc_feature: Ceres CLONE 314202-F
  misc_feature: Encodes the peptide sequence at SEQ ID NO. 5055
acacactcgactctcctctctcgcatccgcrcctttcgagctctactccaccccctcgatctcgaagcgcragcagcagtcaggcggccatggacgcgagcgcmsscggagccggcggaaggcgaagaagggcgcggccgggcgcaatgccggcgggcgaggaagaagtcggtgacgaggtccgtcaaggccgggctgcagtttcccgtcggccgcatcggg

SEQ ID NO: 5055 - protein, 57 aa, Zea mays
  misc_feature: Ceres CLONE 314202-F
  misc_feature (24)..(24): Xaa is any aa, unknown, or other
  misc_feature (35)..(35): Xaa is any aa, unknown, or other
HTRLSSLASAPFELYSTPSISKRXQQSGGHGRERXRSRRKAKKGAAGRNAGGRGRSR

SEQ ID NO: 5056 - DNA, 432 bp, Zea mays
  misc_feature: Ceres CLONE 314237-F
  misc_feature: Encodes the peptide sequence at SEQ ID NO. 5057
  misc_feature (68)..(68): n is a, c, t, g, unknown, or other
attccacgccgcaccgtcctttccagaaccctctggtctccgcgtgcgcgacgcgatttctttgcttntcccttccacttcgagagattgttgattattctagagccagatccgggtaacagattcgagtttgcgcccgccctgttcggcttcagatatggggaacactacatctgtgcaagctgaggcttcagattcagcgcagaaacctgccacaacagctcctgcacctgggtcaaagccgaaawagatctgctgtgcttgcccagatacaaagaagctgagggacgattgcatcgtgcagaatggcgaggatgcctgcggaaagctcatcgaagcccacctgaaatgcctgagagccgaaggttcagcgtctgacgtggtgctccatcatggcaactccacacacctgtttctgcagtaatctgattt

SEQ ID NO: 5057 - protein, 88 aa, Zea mays
  misc_feature: Ceres CLONE 314237-F
  misc_feature (11)..(73): Pfam Name: COX17 Pfam Description: Cytochrome C oxidase copper chaperone (COX17)
  misc_feature (31)..(31): Xaa is any aa, unknown, or other
MGNTTSVQAEASDSAQKPATTAPAPGSKPKXICCACPDTKKLRDDCIVQNGEDACGKLIEAHLKCLRAEGSASDVVLHHGNSTHLFLQ

SEQ ID NO: 5058 - DNA, 437 bp, Zea mays
  misc_feature: Ceres CLONE 314244-F
  misc_feature: Encodes the peptide sequence at SEQ ID NO. 5059
attccacgccgcaccgtcctttccagaaccctctggtctccgcgtgcggcgcgcgatttctttgcttctcccttccacttcgagagattgttgattattctagagccagatccgggtaacagattcgagtttgcgcccgccctgttcggcttcagatatggggaacactacatctgtgcaagctgaggcttcagattcagcgcagaaacctgccacaacagctcctgcacctgggtcaaagccgaaaaagatctgctgtgcttgcccagatacaaagaagctgagggacgattgcatcgtgcagaatggcgaggatgcctgcggaaagctcatcgaagcccacctgaaatgcctgagagccgaaggtttcagcgtctgacgtggtgctccatcatggcaactccacacacctgtttctgcagtaatctgattttgat

SEQ ID NO: 5059 - protein, 73 aa, Zea mays
  misc_feature: Ceres CLONE 314244-F
  misc_feature (11)..(73): Pfam Name: COX17 Pfam Description: Cytochrome C oxidase copper chaperone (COX17)
MGNTTSVQAEASDSAQKPATTAPAPGSKPKKICCACPDTKKLRDDCIVQNGEDACGKLIEAHLKCLRAEGFSV

SEQ ID NO: 5060 - DNA, 128 bp, Zea mays
  misc_feature: Ceres CLONE 314259-F
atcttgctctgaacgcattcctcccatctcccaagacctcctcagacccgagaagcgchbsgcggccatggacgccaccggcactggagctggagggaaggcgaagaagggagcggccggtcgcaagg

SEQ ID NO: 5061 - DNA, 123 bp, Zea mays
  misc_feature: Ceres CLONE 314302-F
acggcacacgcacaccgcgacccagtccagagccagtacgtgcgamggcacgcacgctgctggtccgcgtacssaggacgacggtcaggtcggccggtgcttttcagtttggaataatgacgg

SEQ ID NO: 5062 - DNA, 368 bp, Zea mays
  misc_feature: Ceres CLONE 314319-F
  misc_feature: Encodes the peptide sequence at SEQ ID NO. 5063
  misc_feature (220)..(220): n is a, c, t, g, unknown, or other
aaaaagaaaaaggaaattcctctcaacatcaccagaccacgacctccctgccgagctccctccctctccgttggtgatggcatctcagagctccaagaccgcggacaccgccgcgcctccgccggagttgcagccaccggagaggcggctccgggcgcggcttcttcaacaccggcacaaaaccctaacgctgctgcaaccgcagtggccggggccmggnatctagagaagaagatgcgccgcgcggasskttttggggatgccagtactgatgtcagaggaggaaaakcgcmattcgcgccgagagatttgggactggctcttcaagtgtaaaggwggaagagaagaagaagtccaggggctgagag

SEQ ID NO: 5063 - protein, 110 aa, Zea mays
  misc_feature: Ceres CLONE 314319-F
  misc_feature (74)..(74): Xaa is any aa, unknown, or other
  misc_feature (83)..(83): Xaa is any aa, unknown, or other
  misc_feature (84)..(84): Xaa is any aa, unknown, or other
  misc_feature (97)..(97): Xaa is any aa, unknown, or other
  misc_feature (98)..(98): Xaa is any aa, unknown, or other
KKKKEIPLNITRPRPPCRAPSLSVGDGISELQDRGHRRASAGVAATGEAAPGAASSTPAQNPNAAATAVAGARXLEKKMRRAXXFGDASTDVRGGKXXFAPRDLGLALQV

SEQ ID NO: 5064 - DNA, 130 bp, Zea mays
  misc_feature: Ceres CLONE 314325-F
atcctaatcgaaaaacacgcacaccgcgacccagtccagagccagtacgtgcgavsgcacgcacgctgctggtccgcgtacgcagtacgacggtcaggtcggccggtgcttttcagtttggaataatgac

SEQ ID NO: 5065 - DNA, 505 bp, Zea mays
  misc_feature: Ceres CLONE 314338-F
  misc_feature: Encodes the peptide sequence at SEQ ID NO. 5066
aatccttccactcaaacgatcgcaacacgatccaaagaacgacgtgtgggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcaccggaccgatggagcgctgcccgacctgtgaccgggttcccatcccgttgccctggaagcgga

SEQ ID NO: 5066 - protein, 126 aa, Zea mays
  misc_feature: Ceres CLONE 314338-F
MADPSYWIGMDIETSVTMLVICLAAAVVSVCLFFIFMCIVQWLDSPRMRVFRLGGVTTLRQNLDYTCTLCQNSMEAGEKVRTLSCDHVFHCGGSVKCEGIDHCLRTGPMERCPTCDRVPIPLPWKR

SEQ ID NO: 5067 - DNA, 488 bp, Zea mays
  misc_feature: Ceres CLONE 314350-F
  misc_feature: Encodes the peptide sequence at SEQ ID NO. 5068
  misc_feature (318)..(318): n is a, c, t, g, unknown, or other
aacgtggagactcgttggtctacaacgtaaackataaagggggcggcassagcaagcatgacgaggtcgcgagctgtagtgacgttagtgctcctgctggccgtcgccacggcgagctgcaggctgtcgctcgccgccgacgagaccatcgcggccatcttgggccssacctgcggggttcatcgccagggccggcaacctcttcaggtcggacggcagcgctggcgcgccgcgaacctcaccgcggccgaggcgaagaacctgagggccgccaggaagtcgtcctccggcggcagagcgggctgcgtgasgccgcgncgtgcgggaagaggcgggtgatctgcgkkcaagaggtgctctgacgtcgcctcctcgcgcgccgccagccttcagccacgtcccktcgcgatgcgtcgtcaagtgcagggatgcgtgcccacctgctagatcctcggccccttctcttcggtccgttctgcgatgggtct

SEQ ID NO: 5068 - protein, 93 aa, Zea mays
  misc_feature: Ceres CLONE 314350-F
  misc_feature (37)..(37): Xaa is any aa, unknown, or other
  misc_feature (85)..(85): Xaa is any aa, unknown, or other
MTRSRAVVTLVLLLAVATASCRLSLAADETIAAILGXTCGVHRQGRQPLQVGRQRWRAANLTAAEAKNLRAARKSSSGGRAGCVXPRRAGRGG

SEQ ID NO: 5069 - DNA, 381 bp, Zea mays
  misc_feature: Ceres CLONE 314379-F
  misc_feature (140)..(140): n is a, c, t, g, unknown, or other
atcttgctctgaacgcattcctcccatctcccaagacctcctcagacccgagaagcgcmbgcgggccatggacgccaccggcactggagctggagggaaggcgaagaagggagcggccggtcgcaaggccgcgggcgagngaagaagtcggtgacgaggtccgtgaaggccgggctccagttccccgtcggccgcatcgggcgctacctcaagaagggccgctacgcgcagsgtcggcagcggtgcccccgttctacctcgcggccgtcctggagtacctcgccgctgaggtcctggagctcgccggcaacgctgccaaggacaacaagaagacgcgcattcgtcccgcgccacgtgctgctggcgatccgcaacgacgag

SEQ ID NO: 5070 - DNA, 525 bp, Zea mays
  misc_feature: Ceres CLONE 314380-F
  misc_feature: Encodes the peptide sequence at SEQ ID NO. 5071
aaatcactcccaccgtctccacagcaaccagcacacatttccctttggcggatcgaaggaaggaaggaggagatgggtggcggcatggaggtgcacaaaaaccggtggatcgaagagtggaacgscggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttcctgtaagaggcgtccagggctgcaggatacgtcgattcctcgaccggggctgagaggaggggagtttccattcagtttgtgtcggtattgttttagtctgaatctgatgaagcaatttggaatgctgaattattgtgcctgatccaaatgaataaggtgtaatgactcgtctttcaattactgaaaccgcaacgccgkaaaaacctgaaccccttccggcgccgtgtatctcatttaggaaca

SEQ ID NO: 5071 - protein, 71 aa, Zea mays
  misc_feature: Ceres CLONE 314380-F
  misc_feature (18)..(18): Xaa is any aa, unknown, or other
MGGGMEVHKNRWIEEWNXGRENLEFNFRWTRRSLAVVGLFGLAVPILVYKGIVREFHMQDEDAGRPYRKFL

SEQ ID NO: 5072 - DNA, 518 bp, Zea mays
  misc_feature: Ceres CLONE 314383-F
  misc_feature: Encodes the peptide sequence at SEQ ID NO. 5073
gtctagctgagaacatggtgacctcaagcaagggcaaggtatgtgtaaccggggcctcaggctttgttgcctcttggcttatcaaacggctcctcgagtmctggatatcatgtggtagggactgtcagggacccaggaaatcaccaaaaaacgagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaacccgactctactagcaaggaggaaacgctcgttcctgcggtgaacggtactctgaacgtgctgagatcgtgcaagaagaaccccttcctgaaaagggtcktccttacgtcttcgtcgtctgcggtgaggatcagggacgatggtggccagtccagcagttaacatctcgctggacgaaacgacatgggagctccgtgccactctgcgagaaagatgcacgttgaga

SEQ ID NO: 5073 - protein, 69 aa, Zea mays
  misc_feature: Ceres CLONE 314383-F
  misc_feature: SWISSPROT Homolog: EC 1.3.1.77 Anthocyanidin reductase
  misc_feature (50)..(50): Xaa is any aa, unknown, or other
MACEGVFHTASPVLAKPDSTSKEETLVPAVNGTLNVLRSCKKNPFLKRVXLTSSSSAVRIRDDGGQSSS

SEQ ID NO: 5074 - DNA, 478 bp, Zea mays
  misc_feature: Ceres CLONE 314387-F
  misc_feature: Translation starting site: 85
aagccaccgcagccctagcgcgccgccaccttcaccttcccaggccgccgcgccgccgcctccattgctgctaaacccgcaaccatgggtcccgtgctgaagcgcccgaccccgggcacggtgcagtgcttcgggcgcaagaagacggccgtggcgtgkgcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcggtgaagacgtcgcagatctacgccatccgccagccgtcgccaagggtctcgtgggcctactaccagaagtacgtggacgaggcggcgaaaaaggagawcaaggacatcttcatgcgctacgagcgaccctcctcgtcgccgacccccgccgctgcgagc

SEQ ID NO: 5075 - DNA, 113 bp, Zea mays
  misc_feature: Ceres CLONE 314390-F
acacgcacaccgcgacccagtccagagccagtacgtgcgamggcacgcacgctgctggtccgcgtacssagtacgacggtcaggtcggccggtgcttttcagtttggaataat

SEQ ID NO: 5076 - DNA, 348 bp, Zea mays
  misc_feature: Ceres CLONE 314425-F
  misc_feature (145)..(145): n is a, c, t, g, unknown, or other
gagggatcgtcatccgccccacccacaactgctccagatccaggcacggcacggcacggcagccgggcyaacccaagcccgtcttctcttctctctcgtccgtccctcactcgccgcgacgtgacaagacaacgcgacgsscgcnabswtacgtcgtccwawkgcacgcaggggccagccaaccaatcgcgtccgtccgggtctggtggtggccggaatggggcctcctcgatcagctctgggacgagacggtggccggcccgcgaccggactccggcctcggcaagctccgcaagtacttcctcctgctccccctcctcctcctcgtcgtcgtcbatcctggctccc

SEQ ID NO: 5077 - DNA, 478 bp, Zea mays
  misc_feature: Ceres CLONE 314477-F
  misc_feature: Encodes the peptide sequence at SEQ ID NO. 5078
attgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggacctcttctacggcgagcaggcccccgccgccgccgcccttaagagcgg

SEQ ID NO: 5078 - protein, 88 aa, Zea mays
  misc_feature: Ceres CLONE 314477-F
MSAVAVSSSLNPNAPLFIPAALLQVEDFSPQWWDLITTTAWFRDHWSREHAHLDEIAEQLELVALLAYDEDEDLFYGEQAPAAAALKS

SEQ ID NO: 5079 - DNA, 119 bp, Zea mays
  misc_feature: Ceres CLONE 314492-F
acacgcacaccgcgacccagtccagagccagtacgtgcgamggcacgcacgctgctggtccgcgtacssaggacgacggtcaggtcggccggtgcttttcagtttggaataatgactgg

SEQ ID NO: 5080 - DNA, 337 bp, Zea mays
  misc_feature: Ceres CLONE 314494-F
  misc_feature: Encodes the peptide sequence at SEQ ID NO. 5081
  misc_feature (93)..(93): n is a, c, t, g, unknown, or other
  misc_feature (258)..(258): n is a, c, t, g, unknown, or other
gatctgagatcgacatcgatccaccgaggtttcttgtgcgtgccgccatggccatggcagtagctcaccttcttcctcagctctccgccgaanatggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccatctcgccgccgctcgcgcgtncgggcttctacctggcgccgtccgccacgtccagcatggaccggccgtcgtcggggacatggtccggcacgttgtgggc

SEQ ID NO: 5081 - protein, 96 aa, Zea mays
  misc_feature: Ceres CLONE 314494-F
  misc_feature (16)..(16): Xaa is any aa, unknown, or other
  misc_feature (71)..(71): Xaa is any aa, unknown, or other
MAMAVAHLLPQLSAEXGASRNRMAILLILQLFLLTALGVDGAASFIFTNACKHAVWVGALHGAISPPLARXGFYLAPSATSSMDRPSSGTWSGTLW

SEQ ID NO: 5082 - DNA, 439 bp, Zea mays
  misc_feature: Ceres CLONE 314540-F
  misc_feature: Encodes the peptide sequence at SEQ ID NO. 5083
aaatcaagaaaacagtcgtctccagtttccatgcagagcagaaaagatcagctagcgagagaagcaatggcgtcggctcctgcgttctgcgtcgcgctgctgctggcttccgtcgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggccctcagcaaccccagcacggcccccgatcgccgtcaacatgacgcgcgtgatggccatgctcggctctgsscctcgacctcccgcccgccaccggsccttgcgcagttgccggtcttcttccccatggaccatcaccgccgctgccacc

SEQ ID NO: 5083 - protein, 136 aa, Zea mays
  misc_feature: Ceres CLONE 314540-F
  misc_feature (110)..(110): Xaa is any aa, unknown, or other
  misc_feature (111)..(111): Xaa is any aa, unknown, or other
  misc_feature (119)..(119): Xaa is any aa, unknown, or other
MQSRKDQLAREAMASAPAFCVALLLASVAAVQAVPPQAGTSSTCSTDLLRLLPCLPFIEGTATVPADTCCANLGSMVHDEPQCLCQALSNPSTAPDRRQHDARDGHARLXXSTSRPPPXLAQLPVFFPMDHHRRCH

SEQ ID NO: 5084 - DNA, 227 bp, Zea mays
  misc_feature: Ceres CLONE 314608-F
  misc_feature (121)..(121): n is a, c, t, g, unknown, or other
atcacacactcgactctcctctctcgcatccgcagcctttcgagctctactccaccccctcgatctcgaagcgcagagcagcagtcaggcggccatggacggagcgcmcggtagccggcgngaaggctaagaagggcgcggccgggcgcaaggccgkckggcgaggaagaagtcggtgacgaggtccgtcaaggccgggctgcagtttcccgtcggccgcatcgggc

SEQ ID NO: 5085 - DNA, 109 bp, Zea mays
  misc_feature: Ceres CLONE 314616-F
acacgcacaccgcgacccagtccagagccagtacgtgcgamggcacgcacgctgctggtccgcgtacbsagacgacggtcaggtcggccggtgcttttcagtttggaat

SEQ ID NO: 5086 - DNA, 308 bp, Zea mays
  misc_feature: Ceres CLONE 314623-F
  misc_feature: Encodes the peptide sequence at SEQ ID NO. 5087
  misc_feature (193)..(193): n is a, c, t, g, unknown, or other
acacaaaaacccagcatcagtcaagctcgctcacacgaccatggccgcggcgatgaccggcagtactcgcgccasscggtctccttcctcgtgcttctctttgtcgtgctggccggtgtcgtcgacgtcgcgtccgctgccaccaccgcggcgagtgctactgttgccactaacagcggtgacagcaacgcgncggcgcttctgacgatgccggcgttggcgtccacggggcagctgaatggcatcatccagtgcctgctgggctgcttcacgcaggtgtttcagctgctcgttcgggtgtatgggaa

SEQ ID NO: 5087 - protein, 102 aa, Zea mays
  misc_feature: Ceres CLONE 314623-F
  misc_feature (25)..(25): Xaa is any aa, unknown, or other
  misc_feature (26)..(26): Xaa is any aa, unknown, or other
  misc_feature (65)..(65): Xaa is any aa, unknown, or other
TQKPSISQARSHDHGRGDDRQYSRXXVSFLVLLFVVLAGVVDVASAATTAASATVATNSGDSNAXALLTMPALASTGQLNGIIQCLLGCFTQVFQLLVRVYG

SEQ ID NO: 5088 - DNA, 132 bp, Zea mays
  misc_feature: Ceres CLONE 314656-F
acacgcacaccgcgacccagtccagagccagtacgtgcgamgccacgcacgctgctggtccgcgtacssagacgacggtcaggtcggccggtgcttttcagtttggaataatgacggcgacgacgactacag

SEQ ID NO: 5089 - DNA, 529 bp, Zea mays
  misc_feature: Ceres CLONE 314698-F
  misc_feature: Encodes the peptide sequence at SEQ ID NO. 5090
atctccgcatttccatcttcccgtgggatcccagccgccgccgcawkaagaagagctcggggacttccaggtgtcgcgagaagatgccgaagcagatccacgagatcaaggatttccttctcaccgcgaggaggaaggatgcccgatcagtgaagatcaagaggagcaaggatgttgtcaagttcaaggtccgctgttccaagtacttgtacaccctttgcgtattcgacgctgagaaggcaaacaagttgaagcaatctctccccccaggcttgagcgtccaggaggtttgattggatacatggcaacgtcgggtcgaacctctagggcatctttatcattagcagagcatgctgtttatgtagttttggaccttaagctattagacatgtcagtgttggatttgtggatcttgaatttttggagaaataccaatttgcctcgttcaaggacgcacctttcagttttttcttatttaactgcatgtttccccttcgcaacttagctctgcaaacttactagatttttt

SEQ ID NO: 5090 - protein, 69 aa, Zea mays
  misc_feature: Ceres CLONE 314698-F
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANKLKQSLPPGLSVQEV

SEQ ID NO: 5091 - DNA, 481 bp, Zea mays
  misc_feature: Ceres CLONE 314776-F
  misc_feature: Encodes the peptide sequence at SEQ ID NO. 5092
  misc_feature (330)..(330): n is a, c, t, g, unknown, or other
gctccccctccctcacccgcctccactcccccctcccaggcgctgccaggtaagtcggcggcggcgatgacaacgcgcttcaagaagaaccgcaagaagcgcggccacgtgtccgccgggcacggcgcatcggcaagcacaggaagcacccgggaggtcgcggtaacsscgggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccgccgacaaggccggnaggccggccctcgacaaggccccgcagatcgacgtcacgcaktcgggctacttcaaggtgctcggggaagggggttgctgccgcccaagcccatttgtcgtcaaggccaagctcatctccaaggtcgccgagaagaagatcaaggcagcag

SEQ ID NO: 5092 - protein, 138 aa, Zea mays
  misc_feature: Ceres CLONE 314776-F
  misc_feature (35)..(35): Xaa is any aa, unknown, or other
  misc_feature (102)..(102): Xaa is any aa, unknown, or other
MTTRFKKNRKKRGHVSAGHGASASTGSTREVAVTXGGMHHHRILFDKYHPGYFGKVGMRYFHKLRNKFYCPAVNIERLWSMVPADKAGRPALDKAPQIDVTXSGYFKVLGEGGCCRPSPFVVKAKLISKVAEKKIKAA

SEQ ID NO: 5093 - DNA, 266 bp, Zea mays
  misc_feature: Ceres CLONE 314786-F
  misc_feature: Encodes the peptide sequence at SEQ ID NO. 5094
attcaacataaaacccttccttcgtcttcgattcagcgatttccgatctttccgtcctcggtcttcttgatttttccttcctacctccaccggttataccacctgctagcgccgtccgccgttcctcaggaaaatcctctcacctgagtatggagcagcaccccacttgcgcmcagccgccggcgccggsgcccctggctgggcccgtcgtcccggtggacttcaaggtcgtcaagaagggacccgagatggcgatgcacgacgcg

SEQ ID NO: 5094 - protein, 39 aa, Zea mays
  misc_feature: Ceres CLONE 314786-F
  misc_feature (14)..(14): Xaa is any aa, unknown, or other
MEQHPTCAQPPAPXPLAGPVVPVDFKVVKKGPEMAMHDA

SEQ ID NO: 5095 - DNA, 939 bp, Zea mays
  misc_feature: Ceres CLONE 314826
  misc_feature: Encodes the peptide sequence at SEQ ID NO. 5096
acaggtcctagctccggcctccgccgccgtctctcacctccgctccccttccctgcccccatggcgaaggccgacgcccgtagccgaggccgggccgcctctcacgtccccactcccacatgggcgcagcgcacggaggccctgacccacgtcctgacccacccgtcccacgcgccgtcactccactcgcagctcttcctcgcctcccgcgtcccgtgcccgccgcggggcctcggctccaccacgtcgtacccgccgctcctctgccccggcgcctcgctcctccgctgggctctcgcctccgtgttcctcccgcgcgcggcgagcctctgcctcccgccctcgtcctggcggtcccggtgccccttccagctcccgccgccggtcgtgccctccgcggccatcgagccggcgcccgagcggtgggccgactccgagctcagggcctacgcgcgccggcggcgggagcggaggggcccgctgacggtgcggccgccggtggccgtgctgggagtggtgctcaccaccgtgcccaacgtcgtgatcgtcgtggccttcgtgaaggagtacttctggggcaggaccagccgcatctgaggcgtggtgtctgatgcttcttttgctcttgatgtaaaaaaaaaaaggaaatttggatccataccattaaaagatcaccactttggatccataccattactatctcacttacatgtgggtccacatgagtcaatgacatgtgagatccatggtatatatctaaagtttggatcttttaatggtatagatccatttgttccaaaaaaaaagcggtaaccccagtgtaatcggtgctgactaagacagcttcttgagctttcccttctattaaaagttgggtttcacctccagaagccattgtctgatgcttcttttgctcttgatgcaaaaaaaaaaaaaaaa

SEQ ID NO: 5096 - protein, 178 aa, Zea mays
  misc_feature: Ceres CLONE 314826
MAKADARSRGRAASHVPTPTWAQRTEALTHVLTHPSHAPSLHSQLFLASRVPCPPRGLGSTTSYPPLLCPGASLLRWALASVFLPRAASLCLPPSSWRSRCPFQLPPPVVPSAAIEPAPERWADSELRAYARRRRERRGPLTVRPPVAVLGVVLTTVPNVVIVVAFVKEYFWGRTSRI

SEQ ID NO: 5097 - DNA, 256 bp, Zea mays
  misc_feature: Ceres CLONE 314827-F
  misc_feature: SWISSPROT Homolog: EC 3.4.25.1 Proteasome endopeptidase complex
  misc_feature (52)..(52): n is a, c, t, g, unknown, or other
  misc_feature (53)..(53): n is a, c, t, g, unknown, or other
ggaaatcaacctgcgccgctgccttctccgttctcgccgtcgcctccgcctnngctgccgccgcaggtcagggtcatgtcgatcttcgagtacaacggkgagcgccgtggtggcgatggtggggaagaactgcttckcgatcgccagckaccgccgcctcggttrggcagctgcagacgatcgccaccgacttccgacgggtgttcaaggtccacgacaagctctacatcgggctctcggggctcgccaccgacgc

SEQ ID NO: 5098 - DNA, 411 bp, Zea mays
  misc_feature: Ceres CLONE 314839-F
  misc_feature: Encodes the peptide sequence at SEQ ID NO. 5099
ctcctaatccaaaagtcgcgtgctgtgctctgctctcgcctcgcacggactcgtggtaaaggatgtagaccatgtcggctctcgcgaggacggcgccgcccttgctgggaccattcgccggccgtcctgcgcgctgcggccgacgggtccctctccttcgccgccgcttcaacgacgccccgcgccggctcgggctggggctgagcacggcgccggcggggagcgggagggcggccagggctcgcgccgtcccgcagcgcatcgtcgcctcctcggagttgagcgahkacattatgatcaaaccagatggtgttcagcgtggtctggttggagagattatttctcgctttgagaagaaagggtttttgttgaaaggctaaaracttttccagtgccccaaggacttggcgc

SEQ ID NO: 5099 - protein, 102 aa, Zea mays
  misc_feature: Ceres CLONE 314839-F
  misc_feature: SWISSPROT Homolog: EC 2.7.4.6 Nucleoside-diphosphate kinase
  misc_feature (72)..(72): Xaa is any aa, unknown, or other
  misc_feature (73)..(73): Xaa is any aa, unknown, or other
MSALARTAPPLLGPFAGRPARCGRRVPLLRRRFNDAPRRLGLGLSTAPAGSGRAARARAVPQRIVASSELSXXIMIKPDGVQRGLVGEIISRFEKKGFLLKG

SEQ ID NO: 5100 - DNA, 431 bp, Zea mays
  misc_feature: Ceres CLONE 314850-F
  misc_feature: Encodes the peptide sequence at SEQ ID NO. 5101
  misc_feature (118)..(118): n is a, c, t, g, unknown, or other
  misc_feature (323)..(323): n is a, c, t, g, unknown, or other
aattcgctttcgatccccacagaggcacagacgagacgacagagatgaaggacggaacgygtcggggggaggggcgttcgctgcgggcassattccaaggcagccgtcgackgsgaanatacgcgccgccgaagctgtcgccccaggacctacccatcgactatgcaggcttcctcgccgtcgtcttcggcgtcctcggcgtcatgctccgctacaaggtgtgctcgtggatcgcaatcatcttctgcgctcagtcgtttgcaaacatgaagaactttgagaacgatctgaagcagctttctatggccttcatgtttgctgtnatgggtctggtgacgaactattttggccccgctcgtccaggcagtacaaagcgctaagctgtggaagaacaccatgcgcttcatttcttcataggatatctagccgat

SEQ ID NO: 5101 - protein, 111 aa, Zea mays
  misc_feature: Ceres CLONE 314850-F
  misc_feature (11)..(110): Pfam Name: UPF0139 Pfam Description: Uncharacterised protein family (UPF0139)
  misc_feature (6)..(6): Xaa is any aa, unknown, or other
  misc_feature (16)..(16): Xaa is any aa, unknown, or other
  misc_feature (23)..(23): Xaa is any aa, unknown, or other
  misc_feature (24)..(24): Xaa is any aa, unknown, or other
  misc_feature (25)..(25): Xaa is any aa, unknown, or other
MKDGTXRGEGRSLRAXFQGSRRXXXYAPPKLSPQDLPIDYAGFLAVVFGVLGVMLRYKVCSWIAIIFCAQSFANMKNFENDLKQLSMAFMFAVMGLVTNYFGPARPGSTKR

SEQ ID NO: 5102 - DNA, 247 bp, Zea mays
  misc_feature: Ceres CLONE 314898-F
  misc_feature: Encodes the peptide sequence at SEQ ID NO. 5103
  misc_feature (92)..(92): n is a, c, t, g, unknown, or other
gtaggtggacatattctccgcgtgacttcaggtgtcgtcgccgagttgtctccggccgagggcggcggcgcgaccggtaaccagcgtcabsngaagtgtgacaggcgacatgactcgcggcaaccagcgtgaccgcgagtcgtgagcgcgcggcggcsstaagcccaacggcaaggggccccaggacgggctcaccccggagcagcgccgtgagagggacaagaaagcgctggaggagaaggcggcg

SEQ ID NO: 5103 - protein, 43 aa, Zea mays
  misc_feature: Ceres CLONE 314898-F
  misc_feature (30)..(30): Xaa is any aa, unknown, or other
  misc_feature (31)..(31): Xaa is any aa, unknown, or other
VGGHILRVTSGVVAELSPAEGGGATGNQRXXKCDRRHDSRQPA

SEQ ID NO: 5104 - DNA, 247 bp, Zea mays; identical to SEQ ID NO: 5102
  misc_feature: Ceres CLONE 314898-F2
  misc_feature (92)..(92): n is a, c, t, g, unknown, or other

SEQ ID NO: 5105 - DNA, 241 bp, Zea mays
  misc_feature: Ceres CLONE 314937-F
  misc_feature: Encodes the peptide sequence at SEQ ID NO. 5106
  misc_feature (53)..(53): n is a, c, t, g, unknown, or other
  misc_feature (165)..(165): n is a, c, t, g, unknown, or other
gacatcccatatcgccaagtccccttcgtcgtccccttccctcgcctcggttndgtagcctgcttccgacccgcacatctccctccggttctcgccatgggssccggcgcaacaaccacgaggagtcgagccccctcatcccagctgcggttgccgcccccgcgnacgagaagcccccgcagctccggcgccggasscgccaaatttactatgccgacggggtcccggtcgtgatgggcga

SEQ ID NO: 5106 - protein, 79 aa, Zea mays
  misc_feature: Ceres CLONE 314937-F
  misc_feature (17)..(17): Xaa is any aa, unknown, or other
  misc_feature (18)..(18): Xaa is any aa, unknown, or other
  misc_feature (34)..(34): Xaa is any aa, unknown, or other
  misc_feature (55)..(55): Xaa is any aa, unknown, or other
  misc_feature (65)..(65): Xaa is any aa, unknown, or other
HPISPSPLRRPLPSPRXXSLLPTRTSPSGSRHGXRRNNHEESSPLIPAAVAAPAXEKPPQLRRRXRQIYYADGVPVVMG

SEQ ID NO: 5107 - DNA, 159 bp, Zea mays
  misc_feature: Ceres CLONE 314997-F
  misc_feature: Encodes the peptide sequence at SEQ ID NO. 5108
  misc_feature (49)..(49): n is a, c, t, g, unknown, or other
aacgtggagactcgttggtctacaacgtaaacgataaaggctgcggcanaagcatgacgaggtcgcgagctgtagtgacgttagtgctcctgctggccgtcgccacggcgagctgcaggctgtcgctcgccgccgacgagaccatcgcggccatcttgg

SEQ ID NO: 5108 - protein, 35 aa, Zea mays
  misc_feature: Ceres CLONE 314997-F
MTRSRAVVTLVLLLAVATASCRLSLAADETIAAIL

SEQ ID NO: 5109 - DNA, 406 bp, Zea mays
  misc_feature: Ceres CLONE 315031-F
  misc_feature: Encodes the peptide sequence at SEQ ID NO. 5110
  misc_feature (171)..(171): n is a, c, t, g, unknown, or other
  misc_feature (231)..(231): n is a, c, t, g, unknown, or other
  misc_feature (236)..(236): n is a, c, t, g, unknown, or other
  misc_feature (330)..(330): n is a, c, t, g, unknown, or other
  misc_feature (379)..(379): n is a, c, t, g, unknown, or other
acaagcaaattaaacctatcatcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtngccgccgccgccgccgaggagaagaatgtgcargacaacttctgctcgacgctgtgssanggcangaatgggatggacctggtggtgtgcaaggagtcctgcgacctctcacagcgctccaacctggtgctgtacggccggatccagtkcaaaggcaantgcaccgagcagaagggcatcaccgcgccgcagattaaggtgtkccaanaggcgtgcgacaaggrctacgtggtca

SEQ ID NO: 5110 - protein, 110 aa, Zea mays
  misc_feature: Ceres CLONE 315031-F
  misc_feature (51)..(51): Xaa is any aa, unknown, or other
  misc_feature (52)..(52): Xaa is any aa, unknown, or other
  misc_feature (54)..(54): Xaa is any aa, unknown, or other
  misc_feature (82)..(82): Xaa is any aa, unknown, or other
  misc_feature (85)..(85): Xaa is any aa, unknown, or other
  misc_feature (100)..(100): Xaa is any aa, unknown, or other
  misc_feature (102)..(102): Xaa is any aa, unknown, or other
  misc_feature (107)..(107): Xaa is any aa, unknown, or other
MKKVASSSAVLFVLALTLVCAPLIAEAKKKRVAAAAAEEKNVQDNFCSTLXXGXNGMDLVVCKESCDLSQRSNLVLYGRIQXKGXCTEQKGITAPQIKVXQXACDKXYVV

SEQ ID NO: 5111 - DNA, 383 bp, Zea mays
  misc_feature: Ceres CLONE 315051-F
  misc_feature: Encodes the peptide sequence at SEQ ID NO. 5112
  misc_feature (254)..(254): n is a, c, t, g, unknown, or other
kagtggagtggagtggagcgtcgtcaagtgaaacaaggtcacttaacctcacctcacctcccacggatacccaacacccacacagctctagctggcttgcttggctgccctgctctctcccgcagtctcgctcgctccatgggcgttggccgcggctcttgctccagccactgaagacgcccgcccgcggctcctccccccctgctcatggcaggagctcaatgcgccgccacagctgggccgcgcgccgccgncgccgccgctcctcctcgccctactcctgctgtgcgccttcctctgcgccgtgctcgtgctgctcgcgccggcggctcggcagcacggggacgacagcgacgagacggaggagctccccgccgcgtctt

SEQ ID NO: 5112 - protein, 54 aa, Zea mays
  misc_feature: Ceres CLONE 315051-F
MRRHSWAARRRRRRSSSPYSCCAPSSAPCSCCSRRRLGSTGTTATRRRSSPPRL

SEQ ID NO: 5113 - DNA, 470 bp, Zea mays
  misc_feature: Ceres CLONE 315064-F
  misc_feature: Encodes the peptide sequence at SEQ ID NO. 5114
ctcatttttsstctctcctgckccgcgacgtccctcgccytccggcggcggaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcagcagagaggaattgttcccttctgcaaggktcttgatgtcattcagcaagcacaatctggtacaggaaagacagcaactttctgttctgggatcttgcagcagctggactatggcctggttgaat

SEQ ID NO: 5114 - protein, 109 aa, Zea mays
  misc_feature: Ceres CLONE 315064-F
  misc_feature (78)..(78): Xaa is any aa, unknown, or other
MAGMAPEGSQFDAKHYDSKMQELLSTGETEEFFTSYDEVFESFDDMGLQENLLRGIYAYGFEKPSAIQQRGIVPFCKXLDVIQQAQSGTGKTATFCSGILQQLDYGLVE

SEQ ID NO: 5115 - DNA, 426 bp, Zea mays
  misc_feature: Ceres CLONE 315136-F
  misc_feature: Encodes the peptide sequence at SEQ ID NO. 5116
  misc_feature (180)..(180): n is a, c, t, g, unknown, or other
  misc_feature (210)..(210): n is a, c, t, g, unknown, or other
  misc_feature (211)..(211): n is a, c, t, g, unknown, or other
  misc_feature (247)..(247): n is a, c, t, g, unknown, or other
agaaatcgaccgagcgaatcctcgcttcgcagtcgcagcctttcctgcatcacaccaccgcgaaaccccagcagccgcatcgatggcgcccaaggggagaagaagcccgctgcgaagaagccagcggaggaggagcccgctkccgcaaggccccggcgggaagaagcccaaggccgagangcgcctcccggcgccaagtcgtccggcaannaggcggcgacaagaagggcaagawgaaggcgaagangtcggtggagacctacaagatctacatcttcaaggtgctgaagcaggtccaccccgacatcggcatctcttccaaggccatgtccatcatgaactccttcatcaacgacatcttcgagaagctcgccggcgaggctgccaagcttgcgcgctacaacaagaagcccaccatcacctctc

SEQ ID NO: 5116 - protein, 141 aa, Zea mays
  misc_feature: Ceres CLONE 315136-F
  misc_feature (81)..(141): Pfam Name: Histone Pfam Description: Core histone H2A/H2B/H3/H4
  misc_feature (47)..(47): Xaa is any aa, unknown, or other
  misc_feature (60)..(60): Xaa is any aa, unknown, or other
  misc_feature (70)..(70): Xaa is any aa, unknown, or other
  misc_feature (78)..(78): Xaa is any aa, unknown, or other
  misc_feature (82)..(82): Xaa is any aa, unknown, or other
KSTERILASQSQPFLHHTTAKPQQPHRWRPRGEEARCEEASGGGARXRKAPAGRSPRPRXASRRQVVRQXGGDKKGKXKAKXSVETYKIYIFKVLKQVHPDIGISSKAMSIMNSFINDIFEKLAGEAAKLARYNKKPTITS

SEQ ID NO: 5117 - DNA, 440 bp, Zea mays
  misc_feature: Ceres CLONE 315235-F
  misc_feature: Encodes the peptide sequence at SEQ ID NO. 5118
aaaatcgaatcgagcccatccatctccatttccgccgmcgmmgccgccgagaccccaaccccacccatccaccaccatgtgcgccgctccacaccctagcccccgccttgcgcagggctaccgccgccgccgccggggcccctgcggcgtccgcctcctctgcagcccgcgccgccccgctctcctcggcggccgcgctttccgccgcaccagcccgctcctctcaggggacaagccggcgagtgttgaggacgtcatgcccatcgccacggggctckagcgggagkagctggaggccgagctcaaggggaagaagcggtttgacatggatcccctggtcggccccttcggtaccaatgaggaaccatctgtagttgagtcctactataacaagcggatagtcggctgccctggtggtgagggagatgattaacacgatg

SEQ ID NO: 5118 - protein, 118 aa, Zea mays
  misc_feature: Ceres CLONE 315235-F
  misc_feature (52)..(118): Pfam Name: COX5B Pfam Description: Cytochrome c oxidase subunit Vb
  misc_feature: SWISSPROT Homolog: EC 1.9.3.1 Cytochrome-c oxidase
  misc_feature (68)..(68): Xaa is any aa, unknown, or other
  misc_feature (71)..(71): Xaa is any aa, unknown, or other
MCAAPHPSPRLAQGYRRRRRGPCGVRLLCSPRRPALLGGRAFRRTSPLLSGDKPASVEDVMPIATGLXREXLEAELKGKKRFDMDPLVGPFGTNEEPSVVESYYNKRIVGCPGGEGDD

SEQ ID NO: 5119 - DNA, 106 bp, Zea mays
  misc_feature: Ceres CLONE 315238-F
  misc_feature (61)..(61): n is a, c, t, g, unknown, or other
aacacgcacaccgcgacccagtccagagccagtacgtgcgacrgcacgcacgctgctggtncgcgtaccgagacgacggtcargtcggccggtgcttttcagtttg

SEQ ID NO: 5120 - DNA, 267 bp, Zea mays
  misc_feature: Ceres CLONE 315243-F
  misc_feature: Encodes the peptide sequence at SEQ ID NO. 5121
  misc_feature (201)..(201): n is a, c, t, g, unknown, or other
acaacaccagaatccgcgaatcacagacgcgtctatctcagcttgctgcactgcactaccctgccctgccatcatatcgtacgtgagcccggccgagcgagasmgggaagaggcatggctgctccgaagctcgcgacgctggcgctggccgtgctcctggcggcgaccgtggtggctcccccggccgcggtgcgcgcgggnattgtcgtgctccaccgtgtacagcacgctgatgccgtgcctgccgttcgtccaaatgggcggggc

SEQ ID NO: 5121 - protein, 51 aa, Zea mays
  misc_feature: Ceres CLONE 315243-F
MAAPKLATLALAVLLAATVVAPPAAVRAGIVVLHRVQHADAVPAVRPNGRG

SEQ ID NO: 5122 - DNA, 440 bp, Zea mays
  misc_feature: Ceres CLONE 315256-F
  misc_feature: Translation starting site: 165
  misc_feature: Pfam Name: COX17 Pfam Description: Cytochrome C oxidase copper chaperone (COX17)
gcgtttattccacgccgcaccgtcctttccagaaccctctggtctccgcgtgcggcggcgcgatttctttgcttctcccttccacttcgagagattgttgattattctagagccagatccgggtaacagattcgagtttgcgcccgccctgttcggcttcagatatggggaacactacatctgtgcaagctgaggcttcagattcagcgcagaaacctgccacaacagctcctgcacctgggtcaaagccgaaaaagatctgctgtgcttgcccagatacaaagaagcttgagggacgattgcatcgtgcagaatggcgaggatgcctgcggaaagctcatcgaagcccacctgaaatgcctgagagccgaaggtttcagcgtctgacgtggtgctccatcatggcaactccacacacctgtttcttgcagtaaatctga

SEQ ID NO: 5123 - DNA, 462 bp, Zea mays
  misc_feature: Ceres CLONE 315270-F
  misc_feature: Encodes the peptide sequence at SEQ ID NO. 5124
  misc_feature (73)..(73): n is a, c, t, g, unknown, or other
  misc_feature (94)..(94): n is a, c, t, g, unknown, or other
  misc_feature (139)..(139): n is a, c, t, g, unknown, or other
  misc_feature (197)..(197): n is a, c, t, g, unknown, or other
  misc_feature (384)..(384): n is a, c, t, g, unknown, or other
acaactcacatcgaggtctcagcttcaggaaagggaaggaagcatgttcgggcacaccacggccacggcgggnaccaccaggccccgccgccgncgagcagacgctgttcaggatcttctgccgcgccgacgagsstanctgcctcaccgtgcgtcacgacgccgtcgtcctcgcgcccaccaacccccgcgacganaccagcactggtacaaggacatgaggcacagcacgaaggtgaaggacgcggagggccmgccagcgtkcgcgctcatcaacagggccaccggctcgccatcaagcakctcgctcggccagtcccatcccgtgaagctggtgccctacaacgcggagtacctggacgagtcggtgctgtggacggaganccacgacgtgggcaagggcttccgctgcatccgcatggtcaacaacatccacctcaacttcgacgccttccacggcga

SEQ ID NO: 5124 - protein, 81 aa, Zea mays
  misc_feature: Ceres CLONE 315270-F
  misc_feature (13)..(13): Xaa is any aa, unknown, or other
  misc_feature (16)..(16): Xaa is any aa, unknown, or other
  misc_feature (29)..(29): Xaa is any aa, unknown, or other
  misc_feature (56)..(56): Xaa is any aa, unknown, or other
MRHSTKVKDAEGXPAXALINRATGSPSSXSLGQSHPVKLVPYNAEYLDESVLWTEXHDVGKGFRCIRMVNNIHLNFDAFHG

SEQ ID NO: 5125 - DNA, 371 bp, Zea mays
  misc_feature: Ceres CLONE 315285-F
  misc_feature: Encodes the peptide sequence at SEQ ID NO. 5126
  misc_feature (299)..(299): n is a, c, t, g, unknown, or other
  misc_feature (320)..(320): n is a, c, t, g, unknown, or other
acaacaccagaatccgcgaatcacagacgcgtctatctcagcttgctgcactgcactaccctgccctgccatcatatcgtacgtgagcccggccgagcgagassmgggkatkatggcatggctgctccgaagctcgcgacgctggcgctggccgtgctcctggcggcgaccgtggtggctcccccggccgcggtgcgcgcgsgaatgtcgtgctccaccgtgtacagcacgctgatgccgtgcctgccgttcgtccagatgggcggggccatgccgccccagccgtgctgcggcgcatnccgcagcctgctgcagyassncdacaacacccccgaccgccgcaccatctgcggctgcctcaagaacgtcgc

SEQ ID NO: 5126 - protein, 84 aa, Zea mays
  misc_feature: Ceres CLONE 315285-F
  misc_feature (29)..(29): Xaa is any aa, unknown, or other
  misc_feature (61)..(61): Xaa is any aa, unknown, or other
  misc_feature (67)..(67): Xaa is any aa, unknown, or other
  misc_feature (68)..(68): Xaa is any aa, unknown, or other
  misc_feature (69)..(69): Xaa is any aa, unknown, or other
MAAPKLATLALAVLLAATVVAPPAAVRAXMSCSTVYSTLMPCLPFVQMGGAMPPQPCCGAXRSLLQXXXNTPDRRTICGCLKNV

SEQ ID NO: 5127 - DNA, 431 bp, Zea mays
  misc_feature: Ceres CLONE 315320-F
  misc_feature: Encodes the peptide sequence at SEQ ID NO. 5128
agaatctctcgtgttcgcatggtcacgcccacggccgcaccaaccaccagccccgatttcctcctcaatcacacccccaaaccaaaaccgaaacagcacttctcctgcaatcgccgacgtcgccggassttcgccggccggagcagcgccgacggttgttttgcccctccctcgtccggcccagcagcccaagcgagcatgccttcgattgcgccaccgtcttcctccgtcgctgccctcacccgccaacctgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgc

SEQ ID NO: 5128 - protein, 143 aa, Zea mays
  misc_feature: Ceres CLONE 315320-F
  misc_feature (43)..(43): Xaa is any aa, unknown, or other
ESLVFAWSRPRPHQPPAPISSSITPPNQNRNSTSPAIADVAGXSPAGAAPTVVLPLPRPAQQPKRACLRLRHRLPPSLPSPANLQFFKGCSVSKETKGPVRSFFTANSKSTKVKSAGLKVASSFKNDGGYPAGGVSWKDDTLL

SEQ ID NO: 5129 - DNA, 511 bp, Zea mays
  misc_feature: Ceres CLONE 315327-F
  misc_feature: Encodes the peptide sequence at SEQ ID NO. 5130
ctttccggttcgttcccctacgcccgtttctctctcgtcgcgcaacatcagagcacaagcgaggaacccagtccagtcccgggaatggagtgcgtattgggcgtggttggccgcgacttcgcgctggtggcggccgacacctccgccgtgcagagtattctcgtccacaagaccgacgaggacaaggtgatggtgctcgactcgcaaaagctgatgggcgcttcaggggagcctggtgatcgggtgcaatttacggagttcatacagaagaacctccacctgtaccagttccggaacaccatcccgctctcaaccgccgccgccgccaacttcacacgcggcgaactcgccacagcccttcgcaagaatccatatatggtcaatattattcttggtggttatgataaggatgttggtgcttccctctactacatcgactacattgcaaccttgcacaaaatttgacaaagtagatcttgttgacaagtgcatcaaggagattcggctgcga

SEQ ID NO: 5130 - protein, 126 aa, Zea mays
  misc_feature: Ceres CLONE 315327-F
  misc_feature (1)..(127): Pfam Name: Proteasome Pfam Description: Proteasome A-type and B-type
  misc_feature: SWISSPROT Homolog: EC 3.4.25.1 Proteasome endopeptidase complex
MECVLGVVGRDFALVAADTSAVQSILVHKTDEDKVMVLDSQKLMGASGEPGDRVQFTEFIQKNLHLYQFRNTIPLSTAAAANFTRGELATALRKNPYMVNIILGGYDKDVGASLYYIDYIATLHKI

SEQ ID NO: 5131 - DNA, 375 bp, Zea mays
  misc_feature: Ceres CLONE 315397-F
  misc_feature: Encodes the peptide sequence at SEQ ID NO. 5132
acacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggstgctgctcctgctgatcccgaggagcttcccgcggccgagcagcaggcagccgccgaggcgtaggccgcggctcctgctggtgccgaggagcccgtcgc

SEQ ID NO: 5132 - protein, 63 aa, Zea mays
  misc_feature: Ceres CLONE 315397-F
  misc_feature (43)..(43): Xaa is any aa, unknown, or other
MATAEVQTPTVVAAEEAPVVETPPPAVVPEESAPAEAEAEAEXAAPADPEELPAAEQQAAAEA

SEQ ID NO: 5133 - DNA, 432 bp, Zea mays
  misc_feature: Ceres CLONE 315423-F
  misc_feature: Encodes the peptide sequence at SEQ ID NO. 5134
  misc_feature (394)..(394): n is a, c, t, g, unknown, or other
aaaaacgagcagttcactacccatccgccatagtccgaaagttaccaaatcctcctgcgaggccccagcaccgaatgccccagcacaacaaggcggcgtcgtttgagaggaagcggctagaggacctgctgccgggctagatgacggaagtggcgggacssccgggacgtcgggcggcctggcgctgcgggcgggccagttcgtcttcgccgccgcgtccatctgcgccatggcctccgcgcccgggttcaccaactacacagccttctgctacttggttgcatctatgggactacaagcactatggagcttggggcttggatgtcttgattactatgccttgacattgagaagagatcttcagcaagctcttctcatgagcttatttgtkgtnggcgattgtgtgacagcaattctttcgtttgctgctgc

SEQ ID NO: 5134 - protein, 67 aa, Zea mays
  misc_feature: Ceres CLONE 315423-F
MASAPGFTNYTAFCYLVASMGLQALWSLGLGCLDYYALTLRRDLQQALLMSLFVVGDCVTAILSFAA

SEQ ID NO: 5135 - DNA, 114 bp, Zea mays
  misc_feature: Ceres CLONE 315438-F
  misc_feature (65)..(65): n is a, c, t, g, unknown, or other
acgcacaccgcgacccagtccaaagccagtacgtgcgaagcacgcacgctgctggtccgcgtacnagacgacggtcaggtcggccggtgcttttcagtttggaataatgacggc

SEQ ID NO: 5136 - DNA, 405 bp, Zea mays
  misc_feature: Ceres CLONE 315442-F
  misc_feature (75)..(75): n is a, c, t, g, unknown, or other
  misc_feature (76)..(76): n is a, c, t, g, unknown, or other
aacagccctacaacttactgcttgctctagctagctagctgctcccggcccatatccactacacaagtaggctannagcagcagcagcaatggcctcggtgacgagtttcccggccgtggcctcgtcctgctgctcgccgccagcgccttcctggccagcgaggtggcggcgtgcggcggctgcccgawaccaactcctcctcctccatcgccaccaccgccgtcgcccavstagcacgccgtgcctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgcgacctggaggccgccgtct

SEQ ID NO: 5137 - DNA, 408 bp, Zea mays
  misc_feature: Ceres CLONE 315451-F
  misc_feature: Translation starting site: 69
  misc_feature (98)..(98): n is a, c, t, g, unknown, or other
attccacccgcttcccccagccgcacgaaaccctaacgccgccgccgctwcacaggtaagccgccgtcatggtctccggttccggcgtatgcgcgahncgtggttggacgcgcgccaccacatgctgggccgcctgtcgtcgattatcgccaaggaactgctcaattgggcagaaggwggtcgtcgtccgctgcgaggagatctgtatgtcgggtggactcgtacgccagaagatgaagtacctccgctttctccgcaagcggwtgaacaccaagccatcccatgggcccatccacttccgcgccccgttccaagatcctgtggcgcaccatccgcgggatgattccgcacaagaccaagakgggggaggcggctctggcgaggctcaagacgtacgagggcgtcccg

SEQ ID NO: 5138 - DNA, 482 bp, Zea mays
  misc_feature: Ceres CLONE 315453-F
  misc_feature: Encodes the peptide sequence at SEQ ID NO. 5139
ctttattcactcgccctaggtttccaatcacaggatgcttccgccccgcttccctcccctactcccccacctctcccaccctttttatatcagctcgctcctcagcaccagcatacatacctactagtctactaccccttcacctaccttcacctggcaactggcattggtcccgtatagtgccttgctgtcagttgcatggacgggctgacggacgagcagaggctcgcgttccaggaggccttctcgctcttcgacaagaacggcgacggatgcatcaccatggaagagctggccgcagtcacccgttccctcggtctcgacccgagcgatcaggagctcaatgatatgatgagcgaggtcgatacggacggcaatgggatcatcgatttccaggagttcttaagcctcattgcccggaagatgaaggatggcgacggcgacgaagagctcaaggaagcctttgaggtcctggacaaaga

SEQ ID NO: 5139 - protein, 94 aa, Zea mays
  misc_feature: Ceres CLONE 315453-F
  misc_feature (47)..(75): Pfam Name: efhand Pfam Description: EF hand
  misc_feature (11)..(39): Pfam Name: efhand Pfam Description: EF hand
  misc_feature: SWISSPROT Homolog: EC 2.7.11.1 Non-specific serine/threonine protein kinase
MDGLTDEQRLAFQEAFSLFDKNGDGCITMEELAAVTRSLGLDPSDQELNDMMSEVDTDGNGIIDFQEFLSLIARKMKDGDGDEELKEAFEVLDK

SEQ ID NO: 5140 - DNA, 496 bp, Zea mays
  misc_feature: Ceres CLONE 315485-F
  misc_feature: Encodes the peptide sequence at SEQ ID NO. 5141
aaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcgatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggca

SEQ ID NO: 5141 - protein, 57 aa, Zea mays
  misc_feature: Ceres CLONE 315485-F
MLCRLISDCWIRQTRVGSCIDLEKSRSRRRSVRSGSEATIDGGGGISRSAVLLHLDG

SEQ ID NO: 5142 - DNA, 400 bp, Zea mays
  misc_feature: Ceres CLONE 315511-F
  misc_feature: Translation starting site: 101
  misc_feature (75)..(75): n is a, c, t, g, unknown, or other
aaaaatagagttcacacgcacaacccgccgccgcacgccgggatctcgatagactctggctgccgcggaaagssnaaagaaggcagggatcgtggccaagatgcagatcttcgtgaagacgctgtcgtcgacaaggacgatcacgctggaggttgagccttcggacacggtggcggacgtgaaggccaaggtgtacgagtcggagggcgtcccgcggccgagcagcgcctcatcttcgcggggaagcagctgcgcgacggctgcacgctggctgactacaacatccccaaggagacgatgctgtccttgtgctgccgcctcctcggagsscccycaaaggaagcgcaattaggaagacgttcaccactcctaagaaggggcacgcacgatcacaagaacc

SEQ ID NO: 5143 - DNA, 452 bp, Zea mays
  misc_feature: Ceres CLONE 315518-F
  misc_feature (31)..(31): n is a, c, t, g, unknown, or other
  misc_feature (349)..(349): n is a, c, t, g, unknown, or other
gctagcacccatcgtcttgcagcaggcgganccgacccgatccgtgcgtgtgttggtcgagatggctacaacagcttacgctcccatggcgagccaggtgatgaagagcagcccggtgcactcgaggccgaggggctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcrtggtacctctccaacctgccggcctaccgcaccgccgtgagcccgctgctgcggngcgtccgaggtcggcctcgccacggctacctcctcgtcgggcccttcgcgctcaccggcccgctccgcaacacgcccgtgcacggccaggcgggcgcgctcgg

SEQ ID NO: 5144 - DNA, 172 bp, Zea mays
  misc_feature: Ceres CLONE 315520-F
ttccccagtattctgctcaagccgagcaccgcagaaaaagaaaaagaaaagccaaagssaaaggcaaaggaatcccaatcaggcaagcaaaaggaagaaccagctgctgcggccggagatgtcgtcgcagctgatcgakgagcaccggtcgggcgcggaggtgcacgtcggg

SEQ ID NO: 5145 - DNA, 332 bp, Zea mays
  misc_feature: Ceres CLONE 315573-F
  misc_feature: Encodes the peptide sequence at SEQ ID NO. 5146
gttttcctcctccactccctcccccccgcctccactaccccactcccaggcgccgcacaggtacgtcgccggcggattgaacgacgcgcttcaagaagaaccgcaagaagcgcggccacgtgtccgccgggcacgscgcatcggcaagcacaggaagcatcccggagtcgcggtaacsscggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaa

SEQ ID NO: 5146 - protein, 48 aa, Zea mays
  misc_feature: Ceres CLONE 315573-F
MHHHRILFDKYHPGYFGKVGMRYFHKLRNKFYCPAVNIERLWSMVPAE

SEQ ID NO: 5147 - DNA, 412 bp, Zea mays
  misc_feature: Ceres CLONE 315607-F
  misc_feature: Translation starting site: 55
  misc_feature (172)..(172): n is a, c, t, g, unknown, or other
  misc_feature (342)..(342): n is a, c, t, g, unknown, or other
agttcgttccctcctctgtgtaccggccagtaaaatccgaacccacagcgagaaatggcggcggcassgctccgtccggcgatcctccgccgcatccgcctctccccctcccctttgctcgccctcgccgccgctgggacaggtgcatcccacccgcacgcgctggggcggnggamtcgcgcggcccatgtcctcccacgacgcgcacctcacccgcgacgaakyattcgaccggatcctcgacgtcatcagccaccccaagatcgacccctccaaggtgaccccggagcgcacttcgagaaggatctggggctcgacagcctggacaccktcgaggtggtncatggccatcgaggaggagttcaagctcgagatcccagacattggaggctgacaagatcgactcactccc

SEQ ID NO: 5148 - DNA, 449 bp, Zea mays
  misc_feature: Ceres CLONE 315617-F
  misc_feature: Encodes the peptide sequence at SEQ ID NO. 5149
aaatcaagaaaacagtcgtctccagtttccatgcagagcagaaaagatcagctagcgagagaagcaatggcgtcggctcctgcgttctgcgtcgcgctgctgctggcttccgtcgctgccgtccaagckgtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggccctcagcaaccccagcacggcccccgtcgccgtcaacatgacgcgcgtgatggccatgcctcggctctgsscctcgacctcccgcccgccaccggscctgcgcagttgccggtcttcttccccatggaccatcaccgccgctgccaccgccgccgccgc

SEQ ID NO: 5149 - protein, 139 aa, Zea mays
  misc_feature: Ceres CLONE 315617-F
  misc_feature (44)..(114): Pfam Name: Tryp_alpha_amyl Pfam Description: Protease inhibitor/seed storage/LTP family
  misc_feature (110)..(110): Xaa is any aa, unknown, or other
  misc_feature (111)..(111): Xaa is any aa, unknown, or other
  misc_feature (119)..(119): Xaa is any aa, unknown, or other
MQSRKDQLAREAMASAPAFCVALLLASVAAVQAVPPQAGTSSTCSTDLLRLLPCLPFIEGTATVPADTCCANLGSMVHDEPQCLCQALSNPSTAPVAVNMTRVMAMPRLXXSTSRPPPXLRSCRSSSPWTITAAATAAA

SEQ ID NO: 5150 - DNA, 473 bp, Zea mays
  misc_feature: Ceres CLONE 315719-F
  misc_feature: Translation starting site: 132
actagggtttatttccaaaccaggcgcctataaacacttctctcacgctcacggccgccgcctccacccgtcgccgcttcctcccgttagactaggttaggctaggctagggtgtcgaccagctcgcggtaatggtggccttcaggttccatcagtaccaggtggtggggcgcgcgctgccgacgcccggcgacgagcaccccaagatctaccgcatgaagctctgggccaccaacgaakccgcgccaagagcaagttctggtacttcctgaggaagttgaagaaggttaagaagagcaacggtcaggtcctggccatcaacgagatcttcgagcgtaacccgacgacgatcaagaactatggcatctggctgcgctaccagagcagaaccggctaccacaacatgtacaaggagtaccgcgacacaaccctgaacggcgctgtagagcagatgtacaatgagatggctctcg

SEQ ID NO: 5151 - DNA, 498 bp, Zea mays
  misc_feature: Ceres CLONE 315762-F
  misc_feature: Encodes the peptide sequence at SEQ ID NO. 5152
ctgtcgccttcgcccctccaaggttctctgattccagacgcaaacccccgcgggkccaaggagccagagggggggtgcacagcgatcgttctgccggagatcgaaaccctaaggtagggtttgaggcgccgggctgcggccgccgagatgtcgacgccggcgaggaagcggctgatgcgggacttcaggcgcctgcagcaggacccgcccgccgggatcagcggcgcgccggacgacaacaacatcatgctctggaacgccgtcatattcgggccggatgatacgccttgggacggaggcacgttcaagcttaccttgcagtttacagaagattacccaaacaagccaccaactgttcggtttgtctctaggatgtttcatccaaacatatatgctgatggaagcatctgcttggatatcctacagaaccagtggagtcctatatatgatgttgctgcaatcttgacttctattcagtccctgctgtgtgatccaaac

SEQ ID NO: 5152 - protein, 117 aa, Zea mays
  misc_feature: Ceres CLONE 315762-F
  misc_feature (8)..(116): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPDDNNIMLWNAVIFGPDDTPWDGGTFKLTLQFTEDYPNKPPTVRFVSRMFHPNIYADGSICLDILQNQWSPIYDVAAILTSIQSLLCDPN

SEQ ID NO: 5153 - DNA, 340 bp, Zea mays
  misc_feature: Ceres CLONE 315773-F
  misc_feature: Encodes the peptide sequence at SEQ ID NO. 5154
  misc_feature (257)..(257): n is a, c, t, g, unknown, or other
aactccaaattccccatctcgcttgctgtgtactcgcgctccagctcaccatttctcctctcccttcccttccctaagcatctcagcgaatccaatcgatccgaagcgatggaccagcagggtgcgggcggggacgtggaggtgccggcggggctggggctgacggcggcggagtacgagcagctgcgtccgacggtggacgcgcaccaccgctacgccgtggggaaggccaatgctcctcgctgctggcgcmscantccacgcgccgccggccgccgtctgggccatcgtccgccgcttcgactgcccgcagtgttacaagcacttcatccgcagctgc

SEQ ID NO: 5154 - protein, 77 aa, Zea mays
  misc_feature: Ceres CLONE 315773-F
  misc_feature (49)..(49): Xaa is any aa, unknown, or other
  misc_feature (50)..(50): Xaa is any aa, unknown, or other
MDQQGAGGDVEVPAGLGLTAAEYEQLRPTVDAHHRYAVGKANAPRCWRXXPRAAGRRLGHRPPLRLPAVLQALHPQL

SEQ ID NO: 5155 - DNA, 439 bp, Zea mays
  misc_feature: Ceres CLONE 315783-F
  misc_feature: SWISSPROT Homolog: EC 2.7.7.6 DNA-directed RNA polymerase
  misc_feature (64)..(64): n is a, c, t, g, unknown, or other
  misc_feature (233)..(233): n is a, c, t, g, unknown, or other
  misc_feature (234)..(234): n is a, c, t, g, unknown, or other
agcagccgcaagccaaaaccctagcaagcaaaccaccggagcagcggcgctcgcgsgggcgganattggcggacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgannaaaacaacaaaatatatgacgaakatgaacgtgcgcgcattcttggtacacgagccttgcagataagcatgaatgctccagtcatggttgagcttgaggggagaaactgaccctcttgagattgcgatgaaggagcttagagcgcgcaagatacccttcacgatcagacggtacctacctgatggaagttatgaagactggggag

SEQ ID NO: 5156 - DNA, 209 bp, Zea mays
  misc_feature: Ceres CLONE 315828-F
  misc_feature: Encodes the peptide sequence at SEQ ID NO. 5157
  misc_feature (61)..(61): n is a, c, t, g, unknown, or other
  misc_feature (107)..(107): n is a, c, t, g, unknown, or other
  misc_feature (183)..(183): n is a, c, t, g, unknown, or other
tcctgccgcagtgccgctccttccctccctctacccgtcgccgctgctgccatggacgaangtcagccagattttggagaagcaagtgctgtctgccgcgaagggtnggaggacaagctcgatgaggagatcgccgcgctcgaccgcctcgatccggacgacatcgaggcgctccgssagssnaatcccagcagatgcgccgcgccgcc

SEQ ID NO: 5157 - protein, 52 aa, Zea mays
  misc_feature: Ceres CLONE 315828-F
  misc_feature (4)..(4): Xaa is any aa, unknown, or other
  misc_feature (19)..(19): Xaa is any aa, unknown, or other
  misc_feature (43)..(43): Xaa is any aa, unknown, or other
  misc_feature (44)..(44): Xaa is any aa, unknown, or other
MDEXQPDFGEASAVCREGXEDKLDEEIAALDRLDPDDIEALRXXNPSRCAAP

SEQ ID NO: 5158 - DNA, 482 bp, Zea mays
  misc_feature: Ceres CLONE 315838-F
  misc_feature: Encodes the peptide sequence at SEQ ID NO. 5159
agccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggasacaattgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgaggggccttaacatag

SEQ ID NO: 5159 - protein, 100 aa, Zea mays
  misc_feature: Ceres CLONE 315838-F
  misc_feature (1)..(90): Pfam Name: Ribosomal_L7Ae Pfam Description: Ribosomal protein L7Ae/L30e/S12e/Gadd45 family
  misc_feature (50)..(50): Xaa is any aa, unknown, or other
MKKSSAHDGLVKGLREAAKAIEKHAAQLCVLAEDCDQPDYVKLVKALCAXTIVHLVTVPAAKTLGEWAGLCKIDSEGKARKVVGCSCVVVKDYGEESEGP

SEQ ID NO: 5160 - DNA, 439 bp, Zea mays
  misc_feature: Ceres CLONE 315847-F
  misc_feature: Encodes the peptide sequence at SEQ ID NO. 5161
  misc_feature (115)..(115): n is a, c, t, g, unknown, or other
  misc_feature (183)..(183): n is a, c, t, g, unknown, or other
accggagcgcgtctcggggaggagagagaaagtcagatccgtgttccgtgtccgcgtccagtgtgtccgctactccgctccccctcagtcctcagttcctcacctagcggtasbngtcgckykgagacgtagatggcggcttcggaggcggcassggcggcggcaacaccggtgacgcgacanaggggacggtgatcgcgatccacagcctggaggagtggagcatccagatcgaggaggccaacagcgccaagaagctggtggtgattgacttcactgcaacatggttgtcctccgtgccgcgccatggctccaatttttgctgatatggccaagaagtccccaaatgttgttttcctgaaagttgatgtcgatgaaatgaagaccattgctgagcaattcagcgtagaggccattgccaacattcctgtttcatgag

SEQ ID NO: 5161 - protein, 43 aa, Zea mays
  misc_feature: Ceres CLONE 315847-F
MAPIFADMAKKSPNVVFLKVDVDEMKTIAEQFSVEAIANIPVS

SEQ ID NO: 5162 - DNA, 454 bp, Zea mays
  misc_feature: Ceres CLONE 315872-F
  misc_feature: Encodes the peptide sequence at SEQ ID NO. 5163
aaatccccaggtcctcatcggcctcctctctctcggtctcgccagatctccccacggaaccctacccgagcatcagccatggcaatcgcggcgsscgccctgcgcgctcccgcttcacctctccccctcgatctcccgctccttctgcgcggtttccccggccgccgcctcggctacctcggcccccgcgccgcgtccgccaaggtcgytgaccgcatcgtgcgcgtcctcgccatcgatcccgacgkggcgcgccgcattgtggtcggcctctcggggcagacaytccttcgcgctctggccaacgcggggctccatcgagcgkgcctcccaccgcctcgaggatatcgacgcgtgctccgccgattgcgaggtccacatcgcgcaggagtggcttgacaagcttgccaccaccggtcctacgaggagcgatwcgtgctcacgcgcgcktcca

SEQ ID NO: 5163 - protein, 106 aa, Zea mays
  misc_feature: Ceres CLONE 315872-F
  misc_feature (6)..(6): Xaa is any aa, unknown, or other
  misc_feature (44)..(44): Xaa is any aa, unknown, or other
  misc_feature (57)..(57): Xaa is any aa, unknown, or other
  misc_feature (70)..(70): Xaa is any aa, unknown, or other
  misc_feature (83)..(83): Xaa is any aa, unknown, or other
MAIAAXALRAPASPLPLDLPLLLRGFPGRRLGYLGPRAASAKVXDRIVRVLAIDPDXARRIVVGLSGQTXLRALANAGLHRAXLPPPRGYRRVLRRLRGPHRAGVA

SEQ ID NO: 5164 - DNA, 471 bp, Zea mays
  misc_feature: Ceres CLONE 315901-F
  misc_feature: Encodes the peptide sequence at SEQ ID NO. 5165
  misc_feature (220)..(220): n is a, c, t, g, unknown, or other
attctctgtcgccttcgcccctccaaggttctctgattccagacgcaaccccgcggggtccaaggagccagagggggggtgcacagcgatcgttctgccggagatcgaaaccctaaggtagggtttgaggcgccgggctgcggccgccgagatgtcgacgccggcgaggaagcggctgatgcgggacttcaggcgcctgcagcaggacccgcccgccggnatcagcggcgcgccggacgacaacaacatcatgctctggaacgccgtcatattcgggccggatgatacgccttgggacggaggcacgttcaagcttaccttgcagtttacagaagattacccaaacaagccaccaactgttcggtttgtctctaggatgtttcatccaaacatatatgctgatggaagcatctgcttggatatcctacagaaccagtggagtcctatatatgatgttgctgcaatcttgac

SEQ ID NO: 5165 - protein, 106 aa, Zea mays
  misc_feature: Ceres CLONE 315901-F
  misc_feature (8)..(106): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPDDNNIMLWNAVIFGPDDTPWDGGTFKLTLQFTEDYPNKPPTVRFVSRMFHPNIYADGSICLDILQNQWSPIYDVAAIL

SEQ ID NO: 5166 - DNA, 455 bp, Zea mays
  misc_feature: Ceres CLONE 315910-F
  misc_feature (181)..(181): n is a, c, t, g, unknown, or other
  misc_feature (216)..(216): n is a, c, t, g, unknown, or other
  misc_feature (223)..(223): n is a, c, t, g, unknown, or other
  misc_feature (232)..(232): n is a, c, t, g, unknown, or other
  misc_feature (275)..(275): n is a, c, t, g, unknown, or other
  misc_feature (277)..(277): n is a, c, t, g, unknown, or other
acccaggccgcggcgcatcctctccccatcggcagtcttcccccaagacgtctaaaccccaatccctaaatccccgacgcagaccacacgacgcgcacctccgttcacgaggcggaagcatgagtcgccacccgatcactaagtgggcacagaggtccgacaggtgttcttgacgataganctgcccgabgcccaggatgtgaagctgaacttgangcctganggccatttnaacttctcagctaagggctcagatgamttgcgctatgagtwtnanattvsavsctgtttgahgcwgtgaatgtggaggagagcaaagcagctattgccccaaggaccatatgctacctgataaagaaagctaagagcgggtgggtggccaaggctgctgaagcaggagggcaaaccacctgtgttcttgaaggttgactgggacaaatggcaggacgaggatg

SEQ ID NO: 5167 - DNA, 238 bp, Zea mays
  misc_feature: Ceres CLONE 316005-F
acaacaccagaatccgcgaatcacagacgcgtctatctcagcttgctgcactgcactaccctgccctgccatcatatcgtacgtgagcccggccgagcgagavsgggtatgaggcatggctgctccgaagctcgcgacgctggcgctggccgtgctcctggckgckaccgtggtggctccccckkccgcggtgcgcgcgkgatgtcgtgctccaccgtgtacakcacgctgatgccgt

SEQ ID NO: 5168 - DNA, 172 bp, Zea mays
  misc_feature: Ceres CLONE 316016-F
  misc_feature (51)..(51): n is a, c, t, g, unknown, or other
aaatcgaatcgagcccatccatctccatttccgccgccgccgccgccgatngaycccaaccccacccatccaccaccatgtggcgccgctccacaccctagcccccgccttgcgcagggctaccgccgccgccgccgggtgcccctgcggcgtccgcctcctctgcagcccg

SEQ ID NO: 5169 - DNA, 184 bp, Zea mays
  misc_feature: Ceres CLONE 316078-F
atctccctgtttaatcaatccttcaagcgcaakgcctcctcctcgtcgtccggtcgtgagaagggatggcgggccgtggcaaggctatcggcgctggcgsscgaagaaggcaacgtcgaggagctccaaggtccggactccagtttccccgtcggcaggattgccaggkttcctcaaggcgggc

SEQ ID NO: 5170 - DNA, 149 bp, Zea mays
  misc_feature: Ceres CLONE 316169-F
  misc_feature (66)..(66): n is a, c, t, g, unknown, or other
  misc_feature (67)..(67): n is a, c, t, g, unknown, or other
agtctcctctagccgtctcgcgcgcttcaccttccccaccccgccgccgccatcgcacgcccgcanncgcatccgctatgggtgcgtacaagtacgtctcggagctatggcgtaggaagcagtccgatgtgatgcggttcgtgcagcgc

SEQ ID NO: 5171 - DNA, 164 bp, Zea mays
  misc_feature: Ceres CLONE 316201-F
atctccctgtttaatcaatcyttcaagcgcaatgccctcctcctcgtcgtccggtcgtgagaaggkattgcgggccgtggcaaggctatcggcgctggcgccgaagtaaggcaacgtcgaggagctccaaggccggactccagttccccgtssggcaggattgc

SEQ ID NO: 5172 - DNA, 145 bp, Zea mays
  misc_feature: Ceres CLONE 316210-F
agtcgcctccttcctgcgccgccgccgccgccgccgccgccgctaccaccgcctcgssccgcctgckgtccggtttccgcacggaagttggtgaaggtttcttgaggctgagaacatggtgctgaagacggaactttgccgcttc

SEQ ID NO: 5173 - DNA, 489 bp, Zea mays
  misc_feature: Ceres CLONE 316261-F
  misc_feature (79)..(79): n is a, c, t, g, unknown, or other
  misc_feature (235)..(235): n is a, c, t, g, unknown, or other
  misc_feature (236)..(236): n is a, c, t, g, unknown, or other
aaacaacagccctacaacttactgcttgctctagctagctagctgctcccggcccatatccactacacaagtaggctancagcagcagcagcaatggcctcggtgacgagtttcccggccgtggcctcgtcctgctgctcgccgccagcgccttcctggccagcgaggtggcggcgtgcggcggctgcccgaaaccaactcctcctcctccatcgccaccaccgccgtcgcccannagcacgccgtsscctccgccaccgtccagctccggcggcaagtgccccaagaacgcgctgaaactgggcgtgtgcgcaacgtgctgggcctcgtcaaggtgtccatcggcaaggtgcccaccgactcgtgctgcccgctgctggacggcctcgsgacctggaggccgccgtctgcctctgcaccgcgctcaaggccaacgtgctcggcatcaacctcgacgtccccgtcaagctcaccctgctcctcaactac

SEQ ID NO: 5174 - DNA, 431 bp, Zea mays
  misc_feature: Ceres CLONE 316269-F
  misc_feature: Encodes the peptide sequence at SEQ ID NO. 5175
  misc_feature (144)..(144): n is a, c, t, g, unknown, or other
cctaatcaaaaactaagtgcagctgctaattacaaaaaggcagctcaccacgcccacggatcctctctcacctgcagtcccgctccccaccccgccaccaccgacgctgggatgaaggccgtgcagccgacagcgccgcgcccncggtgccgatgccgatgccgatgccggcgaccaagatcaccattcccgtttccgcggtgggcgcacggaggcggcgctcctcgggaaggggcggtacaaggtctgggccttggcgccatcgcgctcctcgcgctctggtccatgtccgccgcctccgtctcactccgctggtcctcctcgggtgacctcgcctccgtctacggggacctggacgtcccgctcgccgacgacctcgattcccttgagatggaggagagggagaaattagtgggacgaatgtgggacat

SEQ ID NO: 5175 - protein, 106 aa, Zea mays
  misc_feature: Ceres CLONE 316269-F
MKAVQPTAPRPRCRCRCRCRRPRSPFPFPRWAHGGGAPREGAVQGLGLGAIALLALWSMSAASVSLRWSSSGDLASVYGDLDVPLADDLDSLEMEEREKLVGRMWD

SEQ ID NO: 5176 - DNA, 162 bp, Zea mays
  misc_feature: Ceres CLONE 316284-F
  misc_feature: Encodes the peptide sequence at SEQ ID NO. 5177
  misc_feature (53)..(53): n is a, c, t, g, unknown, or other
aaaacaacacacgaacaccgcaccgcaacgtagccggctaggggaagagctcntccttcagctgtgccgtgcaaacgcacsaccttggttttggtttgcatcgcccccgcyaagaawgacgctgccgtgagcgggctgagcgggcgggaagcagcagcaggc

SEQ ID NO: 5177 - protein, 42 aa, Zea mays
  misc_feature: Ceres CLONE 316284-F
  misc_feature (18)..(18): Xaa is any aa, unknown, or other
  misc_feature (27)..(27): Xaa is any aa, unknown, or other
  misc_feature (37)..(37): Xaa is any aa, unknown, or other
  misc_feature (39)..(39): Xaa is any aa, unknown, or other
KQHTNTAPQRSRLGEELXLQLCRANAXPWFWFASPPXRXTLP

SEQ ID NO: 5178 - DNA, 345 bp, Zea mays
  misc_feature: Ceres CLONE 316314-F
  misc_feature: Encodes the peptide sequence at SEQ ID NO. 5179
  misc_feature (76)..(76): n is a, c, t, g, unknown, or other
  misc_feature (151)..(151): n is a, c, t, g, unknown, or other
  misc_feature (155)..(155): n is a, c, t, g, unknown, or other
  misc_feature (189)..(189): n is a, c, t, g, unknown, or other
aaaaaacccagcatcagtcaagctcgctcacacgaccatggccgcggcgatgaccggcagtactcgcgccagcggnctccttcctcgtgcttctmtttgtcgtgttggccggtgtcgtcgacgtcgcgtccgctgccaccactgcggckantgcnactgttgccactaacagcggtgacagcaacgsgncggcgcttctgacgatgccggcgtcggcgtccacagggcagctgaatggcatcatccagtgcctgctgggctgcttcacgcaggtgttcagctgctcgttcgggtgtatgggaaakcakgtgcgccgacctgccgctctgcatcatcggctgcgac

SEQ ID NO: 5179 - protein, 47 aa, Zea mays
  misc_feature: Ceres CLONE 316314-F
  misc_feature (34)..(34): Xaa is any aa, unknown, or other
  misc_feature (35)..(35): Xaa is any aa, unknown, or other
MPASASTGQLNGIIQCLLGCFTQVFSCSFGCMGXXVRRPAALHHRLR

SEQ ID NO: 5180 - DNA, 380 bp, Zea mays
  misc_feature: Ceres CLONE 316323-F
  misc_feature: Encodes the peptide sequence at SEQ ID NO. 5181
atcgattcatccagcagaagcaagcatcacacaaaaccgatcaatctcgcagaggagaaccaaccaatccatcatctgtctcgactctctcgcgtctccgccggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtgcagsggtccaggccgaccgcgccggcgccgcaaccctacctggaacgccacgctccgcttcgccgtcccggcaaccggcgcctcctcctccctccacatcctcctccgcgccgag

SEQ ID NO: 5181 - protein, 78 aa, Zea mays
  misc_feature: Ceres CLONE 316323-F
  misc_feature (41)..(41): Xaa is any aa, unknown, or other
MATTRPLELTLISAKDLKDVNLLSKMEVYAVASLSGDPRCXGPGRPRRRRNPTWNATLRFAVPATGASSSLHILLRAE

SEQ ID NO: 5182 - DNA, 476 bp, Zea mays
  misc_feature: Ceres CLONE 316359-F
  misc_feature: Encodes the peptide sequence at SEQ ID NO. 5183
agccgcagtaccaccagtccagcctccagctaggggaagggggcgaggaaggagccagagcagacccaaaccctcaatggcttcctctcgcgctctcgctttcttcctcctctgcgccctgctgcccgcgcccccagtctcggccacattgctgttcggcggcggcaagtcggccaagaaggcgggcgtcgacgcggagtggcggccggccaccgcgacgtggtacggcgaggccgagggcgacggcagcgacggcggcgcgtgcggctacgggacgctggtggatgtggtgccgatgaaggcgcgggtggggtcggtgagccccgtgctgttcaaggacggcgagggctgcggcgcctgctacaaggtcaggtgcctggaccgcggcgtgtgctcgckccgggccgtcacggtggtcgtcacggacgagtgccccggcggctgtgcgcgttcggccgcacccacttcgacctcag

SEQ ID NO: 5183 - protein, 133 aa, Zea mays
  misc_feature: Ceres CLONE 316359-F
  misc_feature (78)..(132): Pfam Name: DPBB_1 Pfam Description: Rare lipoprotein A (RlpA)-like double-psi beta-barrel
  misc_feature (108)..(108): Xaa is any aa, unknown, or other
MASSRALAFFLLCALLPAPPVSATLLFGGGKSAKKAGVDAEWRPATATWYGEAEGDGSDGGACGYGTLVDVVPMKARVGSVSPVLFKDGEGCGACYKVRCLDRGVCSXRAVTVVVTDECPGGCARSAAPTSTS

SEQ ID NO: 5184 - DNA, 237 bp, Zea mays
  misc_feature: Ceres CLONE 316363-F
  misc_feature: Encodes the peptide sequence at SEQ ID NO. 5185
  misc_feature (128)..(128): n is a, c, t, g, unknown, or other
  misc_feature (129)..(129): n is a, c, t, g, unknown, or other
  misc_feature (131)..(131): n is a, c, t, g, unknown, or other
  misc_feature (132)..(132): n is a, c, t, g, unknown, or other
acctccgcacaaactcgtcgcttccgctccacaggatcctctgcgccacccacaaccgtgcgaccgtccgtgctgccvsvcgaccccgatccgccgacccgtcccgtcccaccacaccctaccgccgnncnnagctatgtcgccgtcggagccgacgcgggaggagagcgtgtacatggccaagctggcagagcaggcggacgggtacgaggagatggtcgagttcatggagcgcgt

SEQ ID NO: 5185 - protein, 33 aa, Zea mays
  misc_feature: Ceres CLONE 316363-F
MSPSEPTREESVYMAKLAEQADGYEEMVEFMER

SEQ ID NO: 5186 - DNA, 125 bp, Zea mays
  misc_feature: Ceres CLONE 316381-F
  misc_feature: Encodes the peptide sequence at SEQ ID NO. 5187
gagctgttctattttacggacatgcgatgctttatggatggtctagatcacgcgcttctactgacccgactcactctctctgaaaagtgaaaactaggaaccccactccccctcccgaaactacc

SEQ ID NO: 5187 - protein, 29 aa, Zea mays
  misc_feature: Ceres CLONE 316381-F
ELFYFTDMRCFMDGLDHALLLTRLTLSEK

SEQ ID NO: 5188 - DNA, 331 bp, Zea mays
  misc_feature: Ceres CLONE 316398-F
  misc_feature (61)..(61): n is a, c, t, g, unknown, or other
  misc_feature (128)..(128): n is a, c, t, g, unknown, or other
  misc_feature (187)..(187): n is a, c, t, g, unknown, or other
  misc_feature (188)..(188): n is a, c, t, g, unknown, or other
aatccaacgaactgaccacaaccacctaagctaaaagctaaccaccagacccccggccatngcgctcgcgccacttccgctgccgtgctcaagaccccgttcctcgggccaggcgcgcgctcgccaantgccgccgccaagcccgcgcctcgccgccgctggtcgtcgccgccgcgccgccgccaannmgtcgtggatcccggccatcaagagcgacgccgatatcgtgaacccgccctggctcgacggctcgctccccggcgacttcgggttcgacccgctgggggctgggcaaggacccggcgttcctcaagtggtaccgggaggcgga

SEQ ID NO: 5189 - DNA, 467 bp, Zea mays
  misc_feature: Ceres CLONE 316405-F
  misc_feature: Translation starting site: 87
gaaaaacgcgaatcctccaatctgcccttgccgccgccgcccgatccaggtctgtagactgctcactcctctccgctccggtccgaatggcccgcacgaagcagacggcgcgcaagtcgaccggcggcaaggcgccgcggaagcagctggccaccaaggcggcgcgcaagtcggccccggccacggggtgcgtgaagaagccgcaccgcttccgccccggcaccgtcgcgctccssagatccgcaagtaccagaagagcacggagctgctcatccgcaagctccccttccagcgcctggttcgcgagatcgcgcaggacttcaagacggacctgcggttccagtcgtcggcggtggcggcgctgcaggaggccgcggaggcgtaacctggtggggctcttcgaggacaccaacctctgcgccatccacgccaagagggtcaccatcatgcccaaggacatccagctc

SEQ ID NO: 5190 - DNA, 495 bp, Zea mays
  misc_feature: Ceres CLONE 316410-F
  misc_feature: Translation starting site: 227
atgttctttggcaaacacacacacacacacatcgtttgctgttgcaacaaagctctacacgggaagacaggctgcttctttcttgcagtctctggtccagaagcctgaagaaatggcgtcacccaacgtcacattcctcgccttcttcgtggccctcgcactattggcgcttcacaccaccgacgcagcggcggssgcaagaaaccttgcgccataggagcgacacatggtgcgtggccaagccgtcgacgcaggaggcgcgctgcggggcaacctggagttcgcctgctccgagagcgactgcggcgccatccagggcaccgtcggctgcgccagcccgacagcctgctgtcacgggcgtcggtggccatgaacgcctactaccaggcccgggggaggaactcgtgggaactgcttcttcaacggcaccggcctaatcaccattcactggaccccagcctttggcaccttgcaaatattgctttgacacgacgg

SEQ ID NO: 5191 - DNA, 458 bp, Zea mays
  misc_feature: Ceres CLONE 316467-F
  misc_feature: Encodes the peptide sequence at SEQ ID NO. 5192
  misc_feature (133)..(133): n is a, c, t, g, unknown, or other
  misc_feature (241)..(241): n is a, c, t, g, unknown, or other
attttcgactttcgagcgcagaaacgagagggccggagcagccgcagtcccggcgatcccgcgccggtcgccctcatacttcctcgtcactgccttcgtttctctttccaacaatcaagatgagccgtggcgntassgcgggtggtggtcaaagttctctgggttacctctttggaagcggtgagccccccabvaccagcagtggcaccagctgtaagtgctccacctgctgctgcagtcntcccacctssttgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgttttggtggcaactgatgccgctcaccaagc

SEQ ID NO: 5192 - protein, 107 aa, Zea mays
  misc_feature: Ceres CLONE 316467-F
  misc_feature (5)..(5): Xaa is any aa, unknown, or other
  misc_feature (6)..(6): Xaa is any aa, unknown, or other
  misc_feature (25)..(25): Xaa is any aa, unknown, or other
  misc_feature (41)..(41): Xaa is any aa, unknown, or other
  misc_feature (44)..(44): Xaa is any aa, unknown, or other
MSRGXXAGGGQSSLGYLFGSGEPPXTSSGTSCKCSTCCCSXPTXLRNHLLQSLMAPVRLLLGLPAKPITTTGPTVRTPETSLRTVLRPRSTLLLAVALPWDTCFGGN

SEQ ID NO: 5193 - DNA, 286 bp, Zea mays
  misc_feature: Ceres CLONE 316475-F
  misc_feature (139)..(139): n is a, c, t, g, unknown, or other
atcttgctctgaacgcattcctcccatctcccaagacctcctcagacccgagaagcgcmbsgcggccatggacgccaccggactggagctggagggaaggcgaagaagggagcggccggtcgcaaggccgcgggccganggaagaagtcggtgacgaggtccgtgaaggccgggctccagttccccgtcggccgcatcgggcgctacctcaagaagggccgctacgsscasscgtcggcagcggtgcccccgtctacctcgcggccgtcctggagtacctcgccgc

SEQ ID NO: 5194 - DNA, 369 bp, Zea mays
  misc_feature: Ceres CLONE 316525-F
  misc_feature (254)..(254): n is a, c, t, g, unknown, or other
aaaaattaaaatccaagtcttacgcgagtccccttcccgaatcggccggcsgatccacccaccgccgccatgccggssttcaaggccccggcgccgggcttcgcgtgcgcttcagccccttccacgagaaccgcctcctcgccgccacgtcccagcacttcggtctcgtgggtaacggtcacctcatcgtcctcgacctagccggcggcgggcctggggcgcccggcgccggtcttctccttcccgacttccgntgcgctcttcgactgcgcgtggtccgagtcccacgactccctctgcgccgccgcctccggggacgctccgtgcgccttttcgacgccgctctcccgccggcgcagaaccccgtgc

SEQ ID NO: 5195 - DNA, 408 bp, Zea mays
  misc_feature: Ceres CLONE 316554-F
  misc_feature: Encodes the peptide sequence at SEQ ID NO. 5196
  misc_feature (295)..(295): n is a, c, t, g, unknown, or other
gtcgatggccctcatgaaaatcacaaattgagagagagggagaagggggtgggggttacgtaacacggcgattcaggaggggatagcatcgtcatcgcaaaatgcaggctctcctgctccccgcgcgggccgsscgccgacgccggsgatgcttcggcagcgtgcggtttctgcctccgcgtgtgcgtcgcaggtctgccgccccctattcggtgccgccaattgcatctcctgtggggtctacggaagcgttcggcgtcacctcacagtggcggtggcggcggtcctccgcctncgccttcgtcctcaccttcgtcgggaccgctctacccgacgccttccacccaccgagcaggaggtggagagggtcaagctcgagcaggttatgaggagactagagaaaacagc

SEQ ID NO: 5196 - protein, 86 aa, Zea mays
  misc_feature: Ceres CLONE 316554-F
MLRQRAVSASACASQVCRPLFGAANCISCGVYGSVRRHLTVAVAAVLRLRLRPHLRRDRSTRRLPPTEQEVERVKLEQVMRRLEKT

SEQ ID NO: 5197 - DNA, 329 bp, Zea mays
  misc_feature: Ceres CLONE 316555-F
  misc_feature: Encodes the peptide sequence at SEQ ID NO. 5198
gtttttcctcctccactccctcccccccgcctccactaccccactcccaggcgccgcacaggtacgtcgccggcggatgacgacgcgcttcaagaagaaccgcaagaagcgcggccacgtgtccgccgggcacgccgcatcggcaagcacaggaagcatcccggagtcgcggtaacscggttggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaa

SEQ ID NO: 5198 - protein, 48 aa, Zea mays; identical to SEQ ID NO: 5146
  misc_feature: Ceres CLONE 316555-F

SEQ ID NO: 5199 - DNA, 482 bp, Zea mays
  misc_feature: Ceres CLONE 316557-F
  misc_feature: Translation starting site: 127
  misc_feature (160)..(160): n is a, c, t, g, unknown, or other
aawaccgtcatcgtcctccctcgtgctagcctcgctcgttgcgcgdtcaaatttcgaaccacctccgccttcgacgccccaaaccctagcccgacccctcctcctccacctgcgccaccgcccaccatgagctccgccgccgcgccasstgccgtcggcncaagggagcttgccaacccgcccgccgacggaatcaccaacctccgcttctccaaccacagcaacaacctcctcgtctcctbsatgggacaagacggtgcggctctacgacgccgacgccaacgtgctcaagggggagttcatgcaccccggggccgtcctcgactgctgcttccacgacgactcctcgggcttagcgccggtgccgaccacaccgbscggaggttkggtatttatgctcgtccaaggaagwtgttttgkggcggcatgatggtccggttcgttgcgtggaatactcttatgctgyaggtcaagtcatcacc

SEQ ID NO: 5200 - DNA, 1572 bp, Zea mays
  misc_feature: Ceres CLONE 316601
  misc_feature: Encodes the peptide sequence at SEQ ID NO. 5201
acgaaataaggcacccaaccaccttcccctccgccccaatcgcttgctcccgcacggccgcaccgccgccgacctcgccgccggcaatggcgtggctcgcgcgctccatcgccaactccctcatcgctactgaggaagaacccgaagcaaccgaccggggcccctcggcctccccgggctcgtcctctcccccgcgcggcgtccgcgaggacctctccgagctaaccggcgcgctcgcgaaccgcttccagggcatcgcctccttcctcgcgcccgcggcgcctgggggcggaggcgccctgcgccggccggacccggccgagatcgcgggccggttccgcgccggcctcgcgcggctcccgggccgccaggccgtagcggatctcgccaggatcgcgtcctcgctcctgccccctgagggcgatgcagactgggcggaggaggcagcgggggtcaccgaagaggtggtcgcgttcgcgcgggacgcggcatcgcggcccgagctatggctcgacttccccctcctccccgacgacgcggactcggatgattttgacatgactgatgcgcagcaagatcaccccctggccgtggaaagcttggcgcccgagctggctgatctgaggatcgagctctgccccagccacatgagcgaggactgcttctggaagatatacttcgtactgctgcatcctaagctcaggaaggatgatgccgacattttatccactccacagattctggaagctagggacaagttgtcgcaggaggtgcggtaccggacggagttacaaggcagccacggcgacaccgtacctgtggctctcggcgatgaaggtggcgtttcaggttctcttgtagagggtttgggcgtattgaagggccaagacgactccgccatgctcacgtctttcagcaacacggactacggcaagccacaaccgatcgaacaggacaaggatattgtatcggttcatacgatcggcgagactggagctgtttcttcggataataccggtagcagcggtgtacctgtacagctagtgcccgtgtcgagagacaccaccaccgtggcgccactatctaggacggaagaaagtacgcacgatctctctacggaagacgaagcagcagcagaagaagaagaggagcagggtctgcagatgtctgagatacctttgacggacagctctccccctaaagatggtcaacagaaacaaccactggctgccatcagtgagcgatcaggagctgactatcagaaaagtgataatgttgaggatggcggcgacggcgtcgaagatgacgacggggatgaatggttggaagaggaagcatgggacccgggaaacacgcaaattccgatagcagatgatgaagacgtgtctttcagtgatctggaggaagaagacgatggtgcggcctgacatcgcctgtaggcttggcttgaccgtactgcttacgtagtctgtgcttcctgttccgttatacgattggtacaattgtcttggttgatgtctaatacacgctctcatagtctcattgcttcctgttccgaaaaaaaaaaaaaaa

SEQ ID NO: 5201 - protein, 446 aa, Zea mays
  misc_feature: Ceres CLONE 316601
  misc_feature (145)..(211): Pfam Name: BSD Pfam Description: BSD domain
MAWLARSIANSLIATEEEPEATDRGPSASPGSSSPPRGVREDLSELTGALANRFQGIASFLAPAAPGGGGALRRPDPAEIAGRFRAGLARLPGRQAVADLARIASSLLPPEGDADWAEEAAGVTEEVVAFARDAASRPELWLDFPLLPDDADSDDFDMTDAQQDHPLAVESLAPELADLRIELCPSHMSEDCFWKIYFVLLHPKLRKDDADILSTPQILEARDKLSQEVRYRTELQGSHGDTVPVALGDEGGVSGSLVEGLGVLKGQDDSAMLTSFSNTDYGKPQPIEQDKDIVSVHTIGETGAVSSDNTGSSGVPVQLVPVSRDTTTVAPLSRTEESTHDLSTEDEAAAEEEEEQGLQMSEIPLTDSSPPKDGQQKQPLAAISERSGADYQKSDNVEDGGDGVEDDDGDEWLEEEAWDPGNTQIPIADDEDVSFSDLEEEDDGAA

SEQ ID NO: 5202 - DNA, 436 bp, Zea mays
  misc_feature: Ceres CLONE 316613-F
  misc_feature: Encodes the peptide sequence at SEQ ID NO. 5203
  misc_feature (278)..(278): n is a, c, t, g, unknown, or other
  misc_feature (287)..(287): n is a, c, t, g, unknown, or other
  misc_feature (288)..(288): n is a, c, t, g, unknown, or other
  misc_feature (313)..(313): n is a, c, t, g, unknown, or other
aggccagccaccatggctccaccacctctgttcccgctcccgcctctcctcatcctcctcgtcatcgtgcctctgttccccaccgccgcgccgacgsscacgacgctgccgctgtaccgccacctaccgcacgtagccgaggccgtggcatcgcaccaccaccacccgctgtcccgcctggccgccgcgtcgctggcccgcgcgttgcacctcaagcgccgggaccccaaccaccacagccagaaaggahcaggcggccacccgtcagtaccagccwncgccgcgcnntacccgcactcctacggcggctacnttcacggcgtcgctcggcacgccgccgcagccgctcccckgctgctcgacaccggcagccacctcacgtgggtgccatgcactccgagctacgagtgccgcaactgctcctccccatccgcct

SEQ ID NO: 5203 - protein, 141 aa, Zea mays
  misc_feature: Ceres CLONE 316613-F
  misc_feature (29)..(29): Xaa is any aa, unknown, or other
  misc_feature (80)..(80): Xaa is any aa, unknown, or other
  misc_feature (89)..(89): Xaa is any aa, unknown, or other
  misc_feature (92)..(92): Xaa is any aa, unknown, or other
  misc_feature (101)..(101): Xaa is any aa, unknown, or other
  misc_feature (114)..(114): Xaa is any aa, unknown, or other
MAPPPLFPLPPLLILLVIVPLFPTAAPTXTTLPLYRHLPHVAEAVASHHHHPLSRLAAASLARALHLKRRDPNHHSQKGXGGHPSVPAXAAXYPHSYGGYXHGVARHAAAAAPXLLDTGSHLTWVPCTPSYECRNCSSPSA

SEQ ID NO: 5204 - DNA, 429 bp, Zea mays
  misc_feature: Ceres CLONE 316693-F
  misc_feature: Encodes the peptide sequence at SEQ ID NO. 5205
ctatccctccactccctcttatctgctgcgccatcctccccggcctccaccatggccacagcgccgcgccaccgcctcctcctccctcctcgcgccggcggccagcagcacggcgccggcctcgtcaaacgcgctgctgttcccctcctccgtgccgtcgctgcgtgcgtacccgcggctcctcctcgcgttccgccgccccgccgcgtcgccgtcgccgacccgcagggccgtgctcgaagagaggcggaggtcgaccagcagggccagtacgacgacgacgacgggtatgagggcgggcgcggcccgcgttcacggcccccacgcgcccgsscaccggcaagccgcgctactgcttaagcgcgaccgcacgakggtcgaaagagggttcctcgagatacagaagctgcggkagagcaagaaggacta

SEQ ID NO: 5205 - protein, 142 aa, Zea mays
  misc_feature: Ceres CLONE 316693-F
  misc_feature (111)..(111): Xaa is any aa, unknown, or other
  misc_feature (125)..(125): Xaa is any aa, unknown, or other
  misc_feature (138)..(138): Xaa is any aa, unknown, or other
YPSTPSYLLRHPPRPPPWPQRRATASSSLLAPAASSTAPASSNALLFPSSVPSLRAYPRLLLAFRRPAASPSPTRRAVLEERRRSTSRASTTTTTGMRAGAARVHGPHAPXHRQAALLLKRDRTXVERGFLEIQKLRXSKKD

SEQ ID NO: 5206 - DNA, 252 bp, Zea mays
  misc_feature: Ceres CLONE 316695-F
  misc_feature: Encodes the peptide sequence at SEQ ID NO. 5207
  misc_feature (132)..(132): n is a, c, t, g, unknown, or other
  misc_feature (133)..(133): n is a, c, t, g, unknown, or other
  misc_feature (142)..(142): n is a, c, t, g, unknown, or other
  misc_feature (229)..(229): n is a, c, t, g, unknown, or other
gaactacacggctgaggcagtaggcagcaggcaggatacgcactaagcgacggccgccatgtacgcggcggctccgagcagcagcagggtggccgccgccgccgccgccttcttcatcgtcatcwccmhcannccgcagctntcgtccgccccttcggcgcatcgacgacggtccactgggcagcggcgcaggagctcgacgaggaggacttcagctaccggcggaagnaawcgggccggcgcggtggggct

SEQ ID NO: 5207 - protein, 64 aa, Zea mays
  misc_feature: Ceres CLONE 316695-F
  misc_feature (23)..(23): Xaa is any aa, unknown, or other
  misc_feature (24)..(24): Xaa is any aa, unknown, or other
  misc_feature (25)..(25): Xaa is any aa, unknown, or other
  misc_feature (57)..(57): Xaa is any aa, unknown, or other
  misc_feature (58)..(58): Xaa is any aa, unknown, or other
MYAAAPSSSRVAAAAAAFFIVIXXXPQLSSAPSAHRRRSTGQRRRSSTRRTSATGGXXRAGAVG

SEQ ID NO: 5208 - DNA, 245 bp, Zea mays
  misc_feature: Ceres CLONE 316700-F
  misc_feature: Encodes the peptide sequence at SEQ ID NO. 5209
aaagaagaatcccaaccccgaccgacctaccctaatcggcgatggcgacggtggcgatggacatctcgaagcccactccagtgcgtccggcgacgaggccgcggcggcgsaaaggggaggakcggcgkatggggcgaggggctgcggcagtactacctgcagcacatccacgacctgcagctccagatccggcagaagacccacaacctcaaccgtctcgaggcccagcgcaatggacctcaact

SEQ ID NO: 5209 - protein, 81 aa, Zea mays
  misc_feature: Ceres CLONE 316700-F
  misc_feature (37)..(37): Xaa is any aa, unknown, or other
  misc_feature (41)..(41): Xaa is any aa, unknown, or other
  misc_feature (43)..(43): Xaa is any aa, unknown, or other
KEESQPRPTYPNRRWRRWRWTSRSPLQCVRRRGRGGXKGRXGXWGEGLRQYYLQHIHDLQLQIRQKTHNLNRLEAQRNGPQ

SEQ ID NO: 5210 - DNA, 479 bp, Zea mays
  misc_feature: Ceres CLONE 316771-F
  misc_feature: Encodes the peptide sequence at SEQ ID NO. 5211
  misc_feature (187)..(187): n is a, c, t, g, unknown, or other
  misc_feature (348)..(348): n is a, c, t, g, unknown, or other
aaaggtgaaacgtcatggcgacggtcgcwkcccgccgctcctccagccgcgatgggtggccggtgggcggtgccggctgctgggcacgagcggaggcttctccgggcggagagggcgcgcgaggagggggaggtggatccggcgacgcgatctttgtgaagaagccggcggccgcsscggcssttgnatgacgagggacgagacgtcggtggcgatgccgacgtcgttcatgaccgggtctgtggtcggtaagcgcttctaccgcgacgccaccgtacggcgcgccgacgatggcaatgggtggaccgtgatgctggacttaccgcacgctcaagttcgccggccaancgggtcctcaagctgccctcgcgcgccctcgccatggccatcgccgccgagtgggagtaccatgaatcagatggaattcgacctttcacaatgcctcttatgaagcttgctgcactgcattggagagagtt

SEQ ID NO: 5211 - protein, 149 aa, Zea mays
  misc_feature: Ceres CLONE 316771-F
  misc_feature (10)..(10): Xaa is any aa, unknown, or other
  misc_feature (59)..(59): Xaa is any aa, unknown, or other
  misc_feature (61)..(61): Xaa is any aa, unknown, or other
  misc_feature (62)..(62): Xaa is any aa, unknown, or other
  misc_feature (116)..(116): Xaa is any aa, unknown, or other
KVKRHGDGRXPPLLQPRWVAGGRCRLLGTSGGFSGRRGRARRGRWIRRRDLCEEAGGRXGXXMTRDETSVAMPTSFMTGSVVGKRFYRDATVRRADDGNGWTVMLDLPHAQVRRPXGSSSCPRAPSPWPSPPSGSTMNQMEFDLSQCLL

SEQ ID NO: 5212 - DNA, 479 bp, Zea mays; identical to SEQ ID NO: 5210
  misc_feature: Ceres CLONE 316771-F2
  misc_feature: Pfam Name: ATP12 Pfam Description: ATP12 chaperone protein
  misc_feature (187)..(187): n is a, c, t, g, unknown, or other
  misc_feature (348)..(348): n is a, c, t, g, unknown, or other

SEQ ID NO: 5213 - DNA, 224 bp, Zea mays
  misc_feature: Ceres CLONE 316775-F
atcacacactcgactctcctctctcgcatccgcrcctttcgagctctactccaccccctcgatctcgaagcgcragcagcagtcaggcggccatggacgcgagcgcmcggagccggcgtgaaggcgaagaagggcgcggycgggcgcaaggccggcgggcgaggaagaagtcggtgagaggtccgtcaaggccgggctgcagtttcccgtcggccgcatcgggc

SEQ ID NO: 5214 - DNA, 345 bp, Zea mays
  misc_feature: Ceres CLONE 316804-F
  misc_feature: Encodes the peptide sequence at SEQ ID NO. 5215
aaaccctagtgcttcccaccgatccatttcagccgccgccgsscgtassaagcaggagcagcaaggatgccggctggccacgggctgcgctcgcggacgsscgacctgttcgsscccctttccgcaagaagggctacatcccgctcaccacctacctccgcacctacaagatcagcgactacgtssacgtcaaggtgaacggcgccgtccacaaggggatgccgcacaagttctaccacggccgcaccggtcgcgtctggaacgtcaccaagcgcgccatcggtccgagataaacaagcaggtgaatggtcgcatcatcaggaagcgtatccatgtccgcgtgga

SEQ ID NO: 5215 - protein, 96 aa, Zea mays
  misc_feature: Ceres CLONE 316804-F
  misc_feature (37)..(97): Pfam Name: Ribosomal_L21e Pfam Description: Ribosomal protein L21e
  misc_feature (14)..(14): Xaa is any aa, unknown, or other
  misc_feature (16)..(16): Xaa is any aa, unknown, or other
  misc_feature (33)..(33): Xaa is any aa, unknown, or other
  misc_feature (38)..(38): Xaa is any aa, unknown, or other
  misc_feature (62)..(62): Xaa is any aa, unknown, or other
TLVLPTDPFQPPPXVXSRSSKDAGWPRAALADXRPVRXPFRKKGYIPLTTYLRTYKISDYVXVKVNGAVHKGMPHKFYHGRTGRVWNVTKRAIGPR

SEQ ID NO: 5216 - DNA, 461 bp, Zea mays
  misc_feature: Ceres CLONE 316805-F
  misc_feature: Translation starting site: 12
acccgtcggcaatggcctctcactcgccgtctcactcctctcgcactagcgctcgcttkctcccaaaccctagctcctcctccgtagctctcagctccagctccagctccggcgatggcctccgtcccgcactcgccgccggtgatccgcaagtcgggcaacctaatggtgttcgtcacgccaccgsssatgccgagagcccgaggtccgagttctctacgcccccgacgagtccccgcgccgaggaatcccctgaatcgccgccggccagatggcccctccgcccacgcctatttattcggcttcggtctccacgccgccacttgtcaagacggtctctccgccayttcatgcggagaagctctcccgsaccctcgctggtccaggtaccgccgccgcttgtcaaaacggtgtctccacctcttcccgcggagaagctctccygacccccgcttgtccag

SEQ ID NO: 5217 - DNA, 420 bp, Zea mays
  misc_feature: Ceres CLONE 316847-F
  misc_feature: Translation starting site: 138
  misc_feature (60)..(60): n is a, c, t, g, unknown, or other
  misc_feature (65)..(65): n is a, c, t, g, unknown, or other
atcttgctctgaacgcattcctcccatctcccaagacctcctcagacccgagaagcgcangcggnccatggacgccaccggactggagctggagggaaggcgaagaagggagcggccggtcgcaaggccgsggtgcgatggaagaagtcggtgacgaggtccgtgaaggccgggctccagttccccgtcggccgcatcgggcgctacctcaagaagggccgctacgsscasscgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctycgggaagctgctgaccggcgtgaccatcgcccac

SEQ ID NO: 5218 - DNA, 353 bp, Zea mays
  misc_feature: Ceres CLONE 316879-F
  misc_feature: Translation starting site: 101
  misc_feature (241)..(241): n is a, c, t, g, unknown, or other
actctcctccttcctccaccgccgccaacgtcgcctggcggccgtctgcagctccgcgcctctgctcggaagttggtgaaggtttcttgaagctgagaagatggtgctgaagacagaactctgccgcttcagcgcaggaagatttatcctgggaaaggcatccgatttatccgtgctgattctcaggttttcctttttgccaactcaaaatgcarkcgcwacttccacaaccgccaagccncaaagcttacctggacagcaatgtacaggaagcagcacaagaaggatatccatgctgaggctgttcaagaagaggtcgccgcgccaccaagaagccatactcgaggttccat

SEQ ID NO: 5219 - DNA, 115 bp, Zea mays
  misc_feature: Ceres CLONE 316890-F
accgcgacccagtccagagccagtacgtgcgamggcacgcacgctgctggtccgcgtacssagaacgacggtcaggtcggccggtgcttttcagtttggaataatgacggcgacg

SEQ ID NO: 5220 - DNA, 496 bp, Zea mays
  misc_feature: Ceres CLONE 316899-F
  misc_feature: Translation starting site: 77
  misc_feature (188)..(188): n is a, c, t, g, unknown, or other
  misc_feature (233)..(233): n is a, c, t, g, unknown, or other
  misc_feature (234)..(234): n is a, c, t, g, unknown, or other
acagacacatacacacatccgtcaaagaaacaagtgcacacaaataaatacctcgctcgctagattgccaagaacaatggcctttaggtcatccatcctgctcgccacggtggcgctggctacgctattcgtgatcggttcgtgcaccaccccgctcaccttccaggtcggcaagggctccaagccgnccacttgatcctcacccccaacgttgccaccatctctgacgtggnntcaaggagcacggtggcgacgacttctcctttacgctcaaggagggtccgactggcacctggacgcttgacaccaagaccccgctcaagtaccccctctgcattcgcttcgccgttaagtctggtggctaccgcatcgccgacgacgtcatccccgccaatttcaaggccggcaccacctacaagaccaccctcagcatctgattagcctcttatgacgaataatattttgagagagctcatctggaccatgtttccagcga

SEQ ID NO: 5221 - DNA, 491 bp, Zea mays
  misc_feature: Ceres CLONE 316916-F
  misc_feature: Encodes the peptide sequence at SEQ ID NO. 5222
  misc_feature (108)..(108): n is a, c, t, g, unknown, or other
actcctgcagtccttctccacctagctcccccgcgccaagaacacgccagctagcaagcgcgctcgatcgaataccgttaccgtgtcgccatssgccgccaccgcgtntctatcagccgtcgcggcgccgctgtcggtgcccgggctcaggaagccgctcggcgcgtcgtcgctccggcccctgcagccgagggcgcgaggatgacgacgacggccgtgcgggcgtcggcgtcgccctcgtccacgtccatcaaggagaaggctgcggccgtgctgaccgcggcggccctggcggccgcctgggtgctgccggacgtcgcggaggccgcgcagtccggcgggctcacgcgttcgctcaagaacttcctcctcagcatcgtgtccggtggggtcgtgctcgttgggtattgtcggcgccgtcgtcgccgtctccaactttcgaccccgtcaagagggccttgatcggaatccatcgtatcgatcgtctcgcc

SEQ ID NO: 5222 - protein, 86 aa, Zea mays
  misc_feature: Ceres CLONE 316916-F
MTTTAVRASASPSSTSIKEKAAAVLTAAALAAAWVLPDVAEAAQSGGLTRSLKNFLLSIVSGGVVLVGYCRRRRRRLQLSTPSRGP

SEQ ID NO: 5223 - DNA, 461 bp, Zea mays
  misc_feature: Ceres CLONE 316926-F
  misc_feature (116)..(116): n is a, c, t, g, unknown, or other
  misc_feature (127)..(127): n is a, c, t, g, unknown, or other
  misc_feature (163)..(163): n is a, c, t, g, unknown, or other
  misc_feature (197)..(197): n is a, c, t, g, unknown, or other
  misc_feature (242)..(242): n is a, c, t, g, unknown, or other
atataatagtcagtctgccacatcccaaaacgcaacacacaagctaaaataaagcaagcaccagaactcttttttccccaaactcgcaagtcgcaacggccatgtctccgctgccncgccgccgccncgtggtcctcgtcctcctcgccgccgccgtcgcgcnacggcgtccgcsscgtccctcagcggcgcggcgnaacgacctgctgcccaagtacggcctcccgarggctcatcccggnactccgtcacctcctacagcttcgacgaggccacgggcgcctttcgagatccacctcgccagcacctgctacgtccactttcggctcccacctcgtctacttacgagaggaccataaccggcaagctctccaggggcgccatctcggacctctccggcgtccaggccaagaagctcttcctctgggtctacgtcacggggatggtcgcgcaccccgacc

SEQ ID NO: 5224 - DNA, 471 bp, Zea mays
  misc_feature: Ceres CLONE 316944-F
atgatgagtttgttcaaacaatctattcattttattatcttttttttttgataaacatggcattcctggtatgaatatgcagtcacttcattcattgttattttggctcagctaaccattaggaggtctggaggatcacaagtgccttggagaaccacaagtatgaaattgctgactgggaccttggtgccggaatatacatagacttctacgttctgaagaactcaatgcaagaaagaaatgccatggatgattcgggttcactcgaggagatgagtgaatcatgcagaagtttctttggccgattaaacgagtcgttgttagtctggggaagcaaattacctgttgagtcaagggcatgctactcgaagatggcagaggagctatgcgcgcttctggtggacaccccaagcgagacgttgaatctacccatggggtkgtcttctaacgatgctcaacgctccacttccg

SEQ ID NO: 5225 - DNA, 464 bp, Zea mays
  misc_feature: Ceres CLONE 316961-F
  misc_feature (166)..(166): n is a, c, t, g, unknown, or other
gattttgcttgagatgcagtatatacgtgcaagacagatatcagcagattatatatatagcagcgtagaagtcctgtggttgcccgattatctgattctgtgatcgagatcgaggccgatcggcaggtttcttgtgcgtgcgctctgctactgccatggcagtasnccaaccttcttctccaactctctgccggagtcaatggagctagcaggaacaggatgctcattccagccattctttcgattcttcagcttattcacctcgcagcgctaggcgtggacggagcggcgtcgttcaggttcaccaacgcttgccagcacccggtgtgggtgggcgcgctccacggcgccagctcgccgccgctcgcaagctcgggcttctacctggcgcggtccgcacgttcccgcctggacgcgccgtcgtcagggacatggtcggcacgttctgggcgcgcacgggctgc

SEQ ID NO: 5226 - DNA, 167 bp, Zea mays
  misc_feature: Ceres CLONE 316968-F
acrgcatctcaagccaccatcgaccttcaagtctcgctacgtagcagtgcaataaaaaaagcagccgcaatggcgagcagcaccatggccctctcctccacggccttcgccaaggcstttatacgtgccgtcgtcgtccgccttcgssaggcccgcgtgacgatgcg

SEQ ID NO: 5227 - DNA, 330 bp, Zea mays
  misc_feature: Ceres CLONE 316985-F
  misc_feature: Encodes the peptide sequence at SEQ ID NO. 5228
ctcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgagsscgagsstgctgctcctgctgatcccgaggagcttcccgcggccgagcagcaggcagc

SEQ ID NO: 5228 - protein, 59 aa, Zea mays
  misc_feature: Ceres CLONE 316985-F
  misc_feature (41)..(41): Xaa is any aa, unknown, or other
  misc_feature (43)..(43): Xaa is any aa, unknown, or other
MATAEVQTPTVVAAEEAPVVETPPPAVVPEESAPAEAEAEXEXAAPADPEELPAAEQQA

SEQ ID NO: 5229 - DNA, 442 bp, Zea mays
  misc_feature: Ceres CLONE 316993-F
  misc_feature: Translation starting site: 124
  misc_feature (46)..(46): n is a, c, t, g, unknown, or other
tcggcctggcttcctcctcctcgaggaccgccgtgcaggagcggancgccgcttctctctccgccgtccgagaggctcgacccctgataccacgctgagggcggtggtattaggagattagcgatggcgaggtggcggycggcggcgctgctggtagtggctctgacggcggttctatcggcggcgtggcgggcggatgcgctatcggttacggtgaccgacaccgagtgcatccacgagtttcgtgcccttatgagggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagtttaaagctccyaagaggtggcatgtataagttctgcttcc

SEQ ID NO: 5230 - DNA, 148 bp, Zea mays
  misc_feature: Ceres CLONE 317004-F
  misc_feature (60)..(60): n is a, c, t, g, unknown, or other
cccacttccacccaaatccaccaccgccataccagcgtgtccgckattccgtcgagttanaccagtcgagagagcagtcccagacgagaagaggtgaatatgagttccggcggcggcaggggtcaagcccaagggtgtccaaggctgt

SEQ ID NO: 5231 - DNA, 258 bp, Zea mays
  misc_feature: Ceres CLONE 317008-F
  misc_feature: Translation starting site: 119
  misc_feature (203)..(203): n is a, c, t, g, unknown, or other
  misc_feature (233)..(233): n is a, c, t, g, unknown, or other
acccaggccgcggcgcatcctctccccatcggcagtcttcccccaagacgtctaaaccccaatccctaaatccccgacgcagaccacacgacgcgcacvdccgttcacgaggcggaacatgagtcgccacccgatcactaagtgggcacagaggtccgacagggtgttcttgacgatagakctgcccgabsgcccaggatgtnaagctgaacttgadgcctgadggccatttnaacttctcagctaaggkctcagatg

SEQ ID NO: 5232 - DNA, 108 bp, Zea mays
  misc_feature: Ceres CLONE 317022-F
acacgcacaccgcgacccagtccagagccagtacgtgcgamgcacgcacgctgctggtccgcgtacssagacgacggtcaggtcggctgcttttcagtttggaataat

SEQ ID NO: 5233 - DNA, 356 bp, Zea mays
  misc_feature: Ceres CLONE 317032-F
  misc_feature: Translation starting site: 234
  misc_feature (72)..(72): n is a, c, t, g, unknown, or other
gctagaagcaactgaaaacagccgagcgatctcctctccctctccctctccgatccattctccagcgcmsangtaaacatgtctgaccgggcaaagatgtcgtggcaggcgtacgtggacgagcacctgatgtgcgagatcgagggccaccacctcgcggcggcggccatcgtcggccacgrttgcccgcctgggcgcagagcacggcgttccccgagttcaagaccgaggacatggccaacatcatgaaggacttcgacgakccagggcacctcgcgccgacassctgttcctcggacctaccaagtacatggtcatccaaggcgagcctggtgccgtcatccgtggcaagaagg

SEQ ID NO: 5234 - DNA, 445 bp, Zea mays
  misc_feature: Ceres CLONE 317033-F
  misc_feature: Translation starting site: 68
  misc_feature (232)..(232): n is a, c, t, g, unknown, or other
atcttgctctgaacgcattcctcccatctcccaagacctcctcagacccgagaagcgcmbsgcggccatggacgccaccggcactggagctggagggaaggcgaagaagggagcggccggtcgcaaggccgtggtgccgaggaagaagtcggtgacgaggtccgtgaaggccgggctccagttccccgtcggccgcatcgggcgctacctcaagaagggccgctacgcgcancgtcggcagcggttgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagyycgggaagctgctgaccgkcgtgaccatcgcccacgggtcktgtttgcccaacatcaacc

SEQ ID NO: 5235 - DNA, 514 bp, Zea mays
  misc_feature: Ceres CLONE 317035-F
  misc_feature: Encodes the peptide sequence at SEQ ID NO. 5236
acccatcagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaaga

SEQ ID NO: 5236 - protein, 152 aa, Zea mays
  misc_feature: Ceres CLONE 317035-F
  misc_feature (83)..(152): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFK

SEQ ID NO: 5237 - DNA, 524 bp, Zea mays
  misc_feature: Ceres CLONE 317076-F
ataaccacaccaactctccccaatccagcagccctcgagtctggtcccccacccctcagcgcgacgaaggtaagatgttcctgcggaggatcctgaccggcgggggcggcctggcggcctgagggcggcgcgcgcgtgaaggagacgacggggatcgtgggccttgaggtggtgcctaacgcgcgagaggttctggtagggctctacgagcgcacgctcaaagagatcaaggccgtccccgaagacgagggttaccgcaagccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatggggatccatggggtgttcccgatgactacgaatgtgaggtgattgaagacgacaccccaattgccttaagcatgttcctcagcaccggcctgttgctcttcctgaggagttc

SEQ ID NO: 5238 - DNA, 198 bp, Zea mays
  misc_feature: Ceres CLONE 317105-F
agaggaaaaaatctcgcattcgcaaagcacacaaaacagcgtccccctccctctactaaaaaaaaaatggaggcatgagctccgcctcctcctcgtctctcgccgatctccccaaaccctagccccgacctgaccgccggcgggcccgcgcggagaaggaktcgctcccacccacccaacttctgcggcggaagggga

SEQ ID NO: 5239 - DNA, 415 bp, Zea mays
  misc_feature: Ceres CLONE 317108-F
  misc_feature: Encodes the peptide sequence at SEQ ID NO. 5240
  misc_feature (23)..(23): n is a, c, t, g, unknown, or other
  misc_feature (70)..(70): n is a, c, t, g, unknown, or other
  misc_feature (71)..(71): n is a, c, t, g, unknown, or other
  misc_feature (115)..(115): n is a, c, t, g, unknown, or other
gaaccggataacacaccgcgatnvsagssagaggtcttccaaaacccaacgcggcaaacggcttcctcanncccctcccctcgccatggccgtccccacctccacctcctccccnytccccctcctcttcctccatcgctgcaccgcaaactctagcccctcggttctctccttcccgtcctccctccgcggcgsstccctccgctcccgggccgcggcgcaccgcccgcagagaccctctctgccgacggatccccgacgcgccaccggaagggcgggaacgggaattccgttgccatcgtcgattggggatgatggggagcagcttgcacccaagcagaagatcagaatcaagctgcggtcctactgggtgccgttgatagaggactcgtgcaagaagataaccgaagctgcc

SEQ ID NO: 5240 - protein, 110 aa, Zea mays
  misc_feature: Ceres CLONE 317108-F
  misc_feature (11)..(11): Xaa is any aa, unknown, or other
  misc_feature (37)..(37): Xaa is any aa, unknown, or other
MAVPTSTSSPXPLLFLHRCTANSSPSVLSFPSSLRGXSLRSRAAAHRPQRPSLPTDPRRATGRAGTGIPLPSSIGDDGEQLAPKQKIRIKLRSYWVPLIEDSCKKITEAA

SEQ ID NO: 5241 - DNA, 463 bp, Zea mays
  misc_feature: Ceres CLONE 317109-F
  misc_feature: Encodes the peptide sequence at SEQ ID NO. 5242
  misc_feature (53)..(53): n is a, c, t, g, unknown, or other
ctccactcgccctcccacdcagaaaaccctagccgccgccaccgaagcggccncccaggtaagcaggagcgtccaccccgccgccgtcatgaagcgcaatccccgcgtcacgagctcccgccggaagtghcgcaagcacttttacggccccgtcctccgtccgccgcgttctcatgtccgccgggctgtcgacggagctccgccacaagtacaacgtgcgctccatcccgatccgcaagacgatcgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaagcgctcctggaccgcaagcccggggcgcgcgcc

SEQ ID NO: 5242 - protein, 96 aa, Zea mays
  misc_feature: Ceres CLONE 317109-F
  misc_feature (22)..(53): Pfam Name: KOW Pfam Description: KOW motif
MSAGLSTELRHKYNVRSIPIRKTIEVQVVRGTYKGREGKVVQVYRRRWVIHVERITREKVNGSTVNVGIHPSKVIVTKLKLDKDRKRSWTASPGRA

SEQ ID NO: 5243 - DNA, 487 bp, Zea mays
  misc_feature: Ceres CLONE 317115-F
  misc_feature: Translation starting site: 123
  misc_feature: SWISSPROT Homolog: EC 5.2.1.8 Peptidylprolyl isomerase
  misc_feature (117)..(117): n is a, c, t, g, unknown, or other
  misc_feature (357)..(357): n is a, c, t, g, unknown, or other
  misc_feature (373)..(373): n is a, c, t, g, unknown, or other
agatcagatcacactcgtagaagaaggaaaaatatccccaaaccctagctcccgatctcgatggcgaaccctcgcgtcttcttcgacatgaccgtcggcggcgcccggcgggccggntcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaasaacncgcccccggtgybtcntccatggccaacgccgggcccaacaccaacggctcccagttcttcatctgcaccgttcgcgaccccttggctcgacggcaagcacgtcgtcttcggccaggttcttcgaggggc

SEQ ID NO: 5244 - DNA, 450 bp, Zea mays
  misc_feature: Ceres CLONE 317129-F
  misc_feature (19)..(19): n is a, c, t, g, unknown, or other
  misc_feature (312)..(312): n is a, c, t, g, unknown, or other
ctccgcccccaacggccknctctgtgaaccgcccacatgacaggatggtgttggcagaggcagagccgccgcgtgggtccatcacgatcggaccagacgagggaagcgccgtccagagcacgccgcggcagccggcagssaggttatggcgattggcgtgggcggtgggcctcgggtgccatgcgccgctacggttaaaagccgagagagccagctgccagcctccgcgcttcagcagcagcggcttccactgtagtcccaagccggcgtgaccattccaaatcttccgcacccatctctcgccgcctcgcnkgcaccggagactggccctagtgcccgcgcgccttgcgaggtatcgaacacccaaagatggcaatggcaaccttcacatcatccccagttctctgcagcttcaggaccatcgaacagaagaaggcccctctgctgaac

SEQ ID NO: 5245 - DNA, 230 bp, Zea mays
  misc_feature: Ceres CLONE 317135-F
  misc_feature: Encodes the peptide sequence at SEQ ID NO. 5246
  misc_feature (132)..(132): n is a, c, t, g, unknown, or other
aatcaccgagccatggccatctcagtcactgccgtggccgccttgtccgctttctcggctcaaagaagcctcccgcagccgtaccgccagagggtcgtaacgttcatcgtcgtccggccggtgcgcgcgcrnccgktttgtgggcgtggcggccagctcgccgcccacgcbgccggatctcgcaaagaaggtgtccgagagcatcaagcaggcccaggagacgtgcgcag

SEQ ID NO: 5246 - protein, 72 aa, Zea mays
  misc_feature: Ceres CLONE 317135-F
  misc_feature (40)..(40): Xaa is any aa, unknown, or other
  misc_feature (42)..(42): Xaa is any aa, unknown, or other
MAISVTAVAALSAFSAQRSLPQPYRQRVVTFIVVRPVRAXPXCGRGGQLAAHAAGSRKEGVREHQAGPGDVR

SEQ ID NO: 5247 - DNA, 632 bp, Zea mays
  misc_feature: Ceres CLONE 317147-R
caaattgggtaccgggccccccctcgaggtcgacggtatcgataagctttttttttttttttttattttttttcttgcctcaaacaggccataaataaatgagaaaatactgcatagtcgaaaatgtttcttcaatcaattgacttacatccatattgactcagcgccacaaactttaaaaggtgaggtgggaacaaggtcactacacccagaagtgtctgtatcttgtacatcatataagacatcttgtagagtaaaacagcgcaaccaccagactattttccctgacagcacggcacagggacgactctttgtacctaagttacaattacatatagcttacaacatgtggacgttgtctttcgccattgccacccgttggcagagaatggcatggacatcttgaatctttgttctcaaattctctgcagaatatttttgtggacgtacaaattattgttggtctcgtagggacttgaccttcatatagttcacagtatggtacatgagcaacgagtggttttgggcaatttgttcgccttcttatctggttttgatttggctgatgatggttgaacaacaacgtgcatcgtgatagcactactgggaagatcaccaaaaggagctctgca

SEQ ID NO: 5248 - DNA, 483 bp, Zea mays
  misc_feature: Ceres CLONE 317249-F
  misc_feature: Encodes the peptide sequence at SEQ ID NO. 5249
  misc_feature (228)..(228): n is a, c, t, g, unknown, or other
  misc_feature (230)..(230): n is a, c, t, g, unknown, or other
acgatttagaaaccctcacctcttcccttcctccccgccgccgccaccgccggaaggagaaaaaaaatgggtgccgatggggaagaagcgtcgcggatagtcgtgccaatggcggtggaggggacctcggagcagctggcgttcgtggaggagtcgaagctgcagaagacgcaaggagaacgcggactgggccgtcagaaccgggagcgcagggcggtaaagcgccanantccgcgacgagcacaaggtcaccgtaagcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggaaggtctygagggaagctacggcttgacgacggtcctcaccggcgtattcctcagggcca

SEQ ID NO: 5249 - protein, 127 aa, Zea mays
  misc_feature: Ceres CLONE 317249-F
  misc_feature (30)..(97): Pfam Name: Ribosomal_L30_N Pfam Description: Ribosomal L30 N-terminal domain
  misc_feature (54)..(54): Xaa is any aa, unknown, or other
  misc_feature (55)..(55): Xaa is any aa, unknown, or other
  misc_feature (122)..(122): Xaa is any aa, unknown, or other
MGADGEEASRIVVPMAVEGTSEQLAFVEESKLQKTQGERGLGRQNRERRAVKRXXPRRAQGHRKRPEDFVAAFRNKERDFLRMRTRLKVRKQPPAEALSSKLVFAIRIPGSVDLHPHIRKVXREATA

SEQ ID NO: 5250 - DNA, 263 bp, Zea mays
  misc_feature: Ceres CLONE 317256-F
ttgtgcccgcggtgctactgacggttgctctagatccgttcatcctggtggttttgtgaggtcgaaagcggcgagcgaattagaagatgctggacaagctgtgggacgacgtggtggccgggcctcgcsgaggacggcctcgagaagctccgcaaggccaccaccgcccgcccgctcgtcatcaacaaagacgcggacggcgkcagctacaagcggggcgcagtcgattccgtcgaccccgacgacgccggtgacgccgtcgt

SEQ ID NO: 5251 - DNA, 178 bp, Zea mays
  misc_feature: Ceres CLONE 317405-F
  misc_feature: Encodes the peptide sequence at SEQ ID NO. 5252
gtttttcttcggaggctttatttatcgtttatccacggaacttccggtgccggcggcgaccacttgtggcgatccatccctcaccatgtcgtcggagaaggaggcggcgctcgykggcctcgatgacagcccaaccatatttgacaagatcatcaaaaaggaaataccttctactgtg

SEQ ID NO: 5252 - protein, 31 aa, Zea mays
  misc_feature: Ceres CLONE 317405-F
  misc_feature (10)..(10): Xaa is any aa, unknown, or other
MSSEKEAALXGLDDSPTIFDKIIKKEIPSTV

SEQ ID NO: 5253 - DNA, 714 bp, Zea mays
  misc_feature: Ceres CLONE 317442
  misc_feature: Encodes the peptide sequence at SEQ ID NO. 5254
caagttatcatgtttacagaattttcttgcacatgatttcaatatcttggaatctaggctctgcagcattagagaagctatttcaaatgctgaactgcttctgggcattagcctcttgcatagcacaacatcaggtcttccactccatcctttcattgttgaaacgctagaaaatactatggatatgtttagtggaggagagtactcagattttactgaagataagaagtatcaacataccaacttcctgtttgactgcattatagagtcactggattcaaaattctgcaatcttggcaaatgtggatacaaggcttggctgaagttgcctcacagtttgagcaaagatctgttgaagcgccagctattggaaaacatcagcaactggagggagtcaagtgggactgctcttagacaagtttctgacaaagaagtggaccaagtgactgacaggtgggatgcaaaccttgaagcatttgatataagcattgcaatcgagaacgacattcttgaggcgcttgtcggtgagttcgcagttgacctatggtgaaacggcgtattgactgccctatatgtatatgagatattgacatgtttggacttctgctcgcatgattctggataaataagatactgcggatatgtttgttttttcttwaaaaaaaaaaaaaaaaaaaaaaaaaaaaaaaaaaaaawaaaaaaaaaaaaaaaaaa

SEQ ID NO: 5254 - protein, 123 aa, Zea mays
  misc_feature: Ceres CLONE 317442
MDMFSGGEYSDFTEDKKYQHTNFLFDCIIESLDSKFCNLGKCGYKAWLKLPHSLSKDLLKRQLLENISNWRESSGTALRQVSDKEVDQVTDRWDANLEAFDISIAIENDILEALVGEFAVDLW

SEQ ID NO: 5255 - DNA, 215 bp, Zea mays
  misc_feature: Ceres CLONE 317445-F
  misc_feature: Encodes the peptide sequence at SEQ ID NO. 5256
agtcgcctccttcctgcgccgccgccgccgccgccgccgcctctaccaccgcctcgggccgcctgcgbtccgcgttttccgcacggaagttggtgaaggtttcttgaggctgagaacatggtgctgaagacggaactttgccgcttcagsscaagaagattttatcctgggaaaggcattagatttatccgtgctgattctcaggtcttcctttt

SEQ ID NO: 5256 - protein, 32 aa, Zea mays
  misc_feature: Ceres CLONE 317445-F
  misc_feature (11)..(11): Xaa is any aa, unknown, or other
  misc_feature (12)..(12): Xaa is any aa, unknown, or other
MVLKTELCRFXXRRFYPGKGIRFIRADSQVFL

SEQ ID NO: 5257 - DNA, 210 bp, Zea mays
  misc_feature: Ceres CLONE 317453-F
  misc_feature: Encodes the peptide sequence at SEQ ID NO. 5258
  misc_feature (125)..(125): n is a, c, t, g, unknown, or other
aactcacagctcaaaagcagccaaaacgctagctagctgcagcgattgatgtctcgctcctgctacctcgccgtgtcggtccttctcgcggtcgccgssacasscagcgggccatcgcsgccgtntgctgcacgaggtgcgcctcgaggaggagggcctgctggtcgcggagggcgcgagggtggcgtccacctgggcgggcaacaaggt

SEQ ID NO: 5258 - protein, 54 aa, Zea mays
  misc_feature: Ceres CLONE 317453-F
  misc_feature (17)..(17): Xaa is any aa, unknown, or other
  misc_feature (19)..(19): Xaa is any aa, unknown, or other
  misc_feature (24)..(24): Xaa is any aa, unknown, or other
  misc_feature (26)..(26): Xaa is any aa, unknown, or other
MSRSCYLAVSVLLAVAXTXSGPSXPXAARGAPRGGGPAGRGGREGGVHLGGQQG

SEQ ID NO: 5259 - DNA, 118 bp, Zea mays
  misc_feature: Ceres CLONE 317488-F
acgcacaccgcgacccagtccagagccagtacgtgcgamggccacgcacgctgctggtccgcgtacssagaacgacggtcaggtcggccggtgcttttcagtttggaataatgacggc

SEQ ID NO: 5260 - DNA, 136 bp, Zea mays
  misc_feature: Ceres CLONE 317513-F
acgcacaccgcgacccagtccagagccagtacgtgcgamggcacgcacgctgctggtccgcgtacssagacgacggtcaggtcggccggtgcttttcagtttggaatcaatgacggcgacgacgacgacagccgcc

SEQ ID NO: 5261 - DNA, 380 bp, Zea mays
  misc_feature: Ceres CLONE 317531-F
  misc_feature: Encodes the peptide sequence at SEQ ID NO. 5262
  misc_feature (8)..(8): n is a, c, t, g, unknown, or other
  misc_feature (297)..(297): n is a, c, t, g, unknown, or other
  misc_feature (306)..(306): n is a, c, t, g, unknown, or other
ggcgcganatcctttatagaaccacctctcggcttccaagcgccactcgccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgcsgccaagaaggacctgcaccggttcgtcaagtggcccaaggtcgtgcgtatccagcgccasscncgcatcbsncaagcagcgcctcaaggtaccaccgggcgctcaaccagttcacccgcaccctcgacaagaacctcgctacgaac

SEQ ID NO: 5262 - protein, 87 aa, Zea mays
  misc_feature: Ceres CLONE 317531-F
  misc_feature (39)..(39): Xaa is any aa, unknown, or other
  misc_feature (59)..(59): Xaa is any aa, unknown, or other
  misc_feature (60)..(60): Xaa is any aa, unknown, or other
  misc_feature (63)..(63): Xaa is any aa, unknown, or other
MAPKRGGRAPVPAKKKTDKVTNPLFEKRPKQFGIGGALXPRRTCTGSSSGPRSCVSSAXXASXKQRLKVPPGAQPVHPHPRQEPRYE

SEQ ID NO: 5263 - DNA, 408 bp, Zea mays
  misc_feature: Ceres CLONE 317536-F
  misc_feature: Encodes the peptide sequence at SEQ ID NO. 5264
caaaaaaaaccctagaacgccgccgccagtcctcactcctcaccatttcccaaaccctacccatacccccgccgccgccgccatgccgcccaagctcgacccgtcgcaggtggtggaggtcttcgtccgggtgacgggcggcgaggtcggcgcggcgtcgtccctggcgcccaagatcggcccgctcggtctctccccgaagaagatcggcgaggacattgccaaggagacggccaaggactggaagggcctgcgcgtcaccgtcaagctcactgtccagaaccgccagccaaggtctccgtcgtcccctccgccgccgcgctcgtcatcaaggcgctcaaggagcccgagaggacaggaagaaggtcaagaacatcaagcacagcggcaacatcggcctcgacgacg

SEQ ID NO: 5264 - protein, 108 aa, Zea mays
  misc_feature: Ceres CLONE 317536-F
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQPRSPSSPPPPRSSSRRSRSPRGQEEGQEHQAQRQHRPRR

SEQ ID NO: 5265 - DNA, 452 bp, Zea mays
  misc_feature: Ceres CLONE 317537-F
  misc_feature: Encodes the peptide sequence at SEQ ID NO. 5266
aatctgacaatctccatcctaagatagaacagcctcccaagcgacagaacagcctcaggaggcacccccgcggttagtctcgaagcttccgttcggaaccagggttagggtttcgcgtcctcccgtcgtcatcctcagccatgtccgggcgcgaggtccgcgagtacaccaatctcagcgaccccaaagacaggaagtttggtaaagggaaggataagatcgacgatgaggacatcaccttccagcgcatggttgcaaagatgcaagaggttgctggtgataggggaggctaccttcacggacgaggagcattggacagcgatgatttgctttacctgaaagagcaaatggaagctgaggaagatgcagagcgccttcttcgtcatactgagaagcgggcatttgctgcttttaagaaagcagcaattttagctgattctacacctgctgtc

SEQ ID NO: 5266 - protein, 104 aa, Zea mays
  misc_feature: Ceres CLONE 317537-F
MSGREVREYTNLSDPKDRKFGKGKDKIDDEDITFQRMVAKMQEVAGDRGGYLHGRGALDSDDLLYLKEQMEAEEDAERLLRHTEKRAFAAFKKAAILADSTPAV

SEQ ID NO: 5267 - DNA, 430 bp, Zea mays
  misc_feature: Ceres CLONE 317543-F
  misc_feature: Encodes the peptide sequence at SEQ ID NO. 5268
  misc_feature (134)..(134): n is a, c, t, g, unknown, or other
gtcttggttctatagcagcgamgcaccactcctagagagacgagcagcgtatgtcgtcgtcgtccgacctcgagcagcaggtkgccgccgccctccgccgtgtgacccccgtcgccgccgcgcchrctgtagancgtggaggcgcgccgtatctggcggcggcgattcagcgcgaatgssctcgcaacgssccaggggtgccgacgcgttctacssaagttcgcgtcggcccggtcgctcgccgacagaccttctcacgccgacgagtacagctgaagggactcaaggatcagctccgggacctccagtcgcagctcagggagtctcttacacttcagtcgtgcaaggaatggaaatacaggattgccacggagccgatgtcggaggccacagctacgaatgagcggctccgtagctggggttgcggatt

SEQ ID NO: 5268 - protein, 126 aa, Zea mays
  misc_feature: Ceres CLONE 317543-F
  misc_feature (26)..(26): Xaa is any aa, unknown, or other
  misc_feature (28)..(28): Xaa is any aa, unknown, or other
  misc_feature (43)..(43): Xaa is any aa, unknown, or other
  misc_feature (44)..(44): Xaa is any aa, unknown, or other
  misc_feature (47)..(47): Xaa is any aa, unknown, or other
  misc_feature (56)..(56): Xaa is any aa, unknown, or other
MSSSSDLEQQVAAALRRVTPVAAAPXVXRGGAPYLAAAIQREXXRNXPGVPTRSTXVRVGPVARRQTFSRRRVQLKGLKDQLRDLQSQLRESLTLQSCKEWKYRIATEPMSEATATNERLRSWGCG

SEQ ID NO: 5269 - DNA, 113 bp, Zea mays
  misc_feature: Ceres CLONE 317545-F
acacgcacaccgcgacccagtccagagccagtacgtgcgamgkcacgcacgctgctggtccgcgtacsaggacgacggtcaggtcggccggtgcttttcagtttggaataatg

SEQ ID NO: 5270 - DNA, 431 bp, Zea mays
  misc_feature: Ceres CLONE 317566-F
  misc_feature: SWISSPROT Homolog: EC 2.7.7.7 DNA-directed DNA polymerase
aagcaagtaagcwdcccaawccctccctcccctcccacgcgattcttgcctcccacgccgccgccggatcccgcgatggccgaccctcggctgtaccccacggagtccgggtccgacgaccggcgcgatgccgcctatcccggctccgagcgccgcctctacaacaacgtaccaggacctcaacctcccctatcggcagctctacgatcttcccacctccccggagttcctcttccaggaggaggccgtcgcgcagscggtcctggggcgagaacctcacctactacaccggcgtgggatacctcggcggcgcgtcggccggggccgcgctggggctccgcgacgccgcccggggcgccgagcctggggagcccgccaagatccgggccaaccgcgtcctcaactcctgcggcagttccggacgccgcgtc

SEQ ID NO: 5271 - DNA, 386 bp, Zea mays
  misc_feature: Ceres CLONE 317576-F
  misc_feature (116)..(116): n is a, c, t, g, unknown, or other
  misc_feature (142)..(142): n is a, c, t, g, unknown, or other
  misc_feature (308)..(308): n is a, c, t, g, unknown, or other
aacccctgaaatactttgaagagaacatataacagcgttggagcaagattgtgttattagcagcatctcgttctcgtcttctcgatcgatcgtagccatatssacgacgacgacgncaaaggtggccgcgggagccgggcgngacssggaggaggggatgaggcggaggaacgccgaggctcgagagggcggtcgcggaggcggcggcgagggaggagcggctgcggcgggagctggagacggccctggcgcggctggccgtggcgaggaggcgaggagcgcctgtgcgtccagctcggcgagctgantgccgaagccatggagcaggccgtcgagtaccaggagcgcgtcagggcgytgtccgaccgcctcgccttcgtttgacg

SEQ ID NO: 5272 - DNA, 106 bp, Zea mays
  misc_feature: Ceres CLONE 317587-F
atcttgctctgaacgcattcctcccatctcccaagacctcctcagacccgagaagcgcabgccggaccatggacgccaccggcactggagctggagggaaggcgaa

SEQ ID NO: 5273 - DNA, 1300 bp, Zea mays
  misc_feature: Ceres CLONE 317634
  misc_feature: Encodes the peptide sequence at SEQ ID NO. 5274
attgtgtcactgtaactagcaattgagctcttaaaattttggttgaggtgcagtagcaaggcacactactacgatctacaaacaagatgatcagttgatgcccggtgtcttcaggatcttttcagctctccgctccctccacggcgttgcatctctcatggcactcggtgtctcctgatagctgctgcttcgatctactccacctaaccgaaagagcgtcgtgtagggtcttggattcttggtccagtgctgttggcctgtttcttgagatcgaagatccaggagatgatcctgcggcggagatcgaggtcgatgaacagcagcgccggcgcccagaggagccacgtccccgatcagtccgcgagatcgtcgaccagtccatgcgacggtgacagtggcggggccggcgccgccggcagcaagaatgcgaccgcgcgtgccctgttcgcttccccgaggctgctgcactcttcttccctgcccgccggcaccgtcgccttcgccaagagccccgcgccggacgccgagccccagacggccttctccatgagcccgacctccgtgctcgacgcggcggcggccttcgcgccgggcacggacggcgccggcaagcgccgcccgccgtggcgggcgcgggacaacaacggcctcgcggacgcgctggactgcagcgaccaccaccaccagcagcagcagcaggagcggatcgtcctcgcggcgacgccgtcgtcgtgctcgctggccagatcgtgctccctggaccgccgcgtcgagttcggcgtcaagaacaggagctcgtggctgcccctccgcggccgcgaggccacggcgccggcgccggccgacccgtgggagatagagccgtcgtcggaggactacacgtgcgtcatctcccgcgggcctaacccgaggacggtgcacatcttcggcgaccgcgtcgtggagggcggcgccggcgccggcgccgacgccgcggcggagagggaggacagctcgccgcggcagatcaatctgccggcgcgcggcgaccggggcttcttcagcctgtgaatgatcccatccacatccatccacgagcgggcgcgtagactgatgcctaggtaaagaaaccgagtttgctgagtgctagtattaagttcagccttcgtgttgcggtattgtattggttgctccgtttccatctgatcagatgatcatagttgtttccttgatcagatgatgtgtactagacgttttgtccaggttgagctgaagctgtgatataaaatttcattacgttgttaaaaaaaaaaaaaaaaaa

SEQ ID NO: 5274 - protein, 254 aa, Zea mays
  misc_feature: Ceres CLONE 317634
MILRRRSRSMNSSAGAQRSHVPDQSARSSTSPCDGDSGGAGAAGSKNATARALFASPRLLHSSSLPAGTVAFAKSPAPDAEPQTAFSMSPTSVLDAAAAFAPGTDGAGKRRPPWRARDNNGLADALDCSDHHHQQQQQERIVLAATPSSCSLARSCSLDRRVEFGVKNRSSWLPLRGREATAPAPADPWEIEPSSEDYTCVISRGPNPRTVHIFGDRVVEGGAGAGADAAAEREDSSPRQINLPARGDRGFFSL

SEQ ID NO: 5275 - DNA, 363 bp, Zea mays
  misc_feature: Ceres CLONE 317643-F
  misc_feature: Encodes the peptide sequence at SEQ ID NO. 5276
accaaaagcagcttctagcttcccagttcccacacgttccctcgtcttttgtcagttggacaatccgcagctcctccatctcattcttccccccatcccatccccaaggttgaccggcgaaatcagcagtccgagaaccgcgagcttctgcctgatccagcctcatcccgccatggacgaatctgaggagcacagcaacggcggcgggcacccccacccgcaccacgggtacgagtggaagttcccggcggcgctgagcggaacacgacgagcgtgcacgtgacggcgctggacggcgtggtgaacgtgaactcgctgttcacggtggccgtgttcgtggggctgtcgctggcgaccccgggg

SEQ ID NO: 5276 - protein, 36 aa, Zea mays
  misc_feature: Ceres CLONE 317643-F
MDESEEHSNGGGHPHPHHGYEWKFPAALSGTRRACT

SEQ ID NO: 5277 - DNA, 463 bp, Zea mays
  misc_feature: Ceres CLONE 317658-F
  misc_feature: Translation starting site: 56
  misc_feature (401)..(401): n is a, c, t, g, unknown, or other
  misc_feature (404)..(404): n is a, c, t, g, unknown, or other
gtgctcgatctccatctcgaccgtcgctcaccgggaagctacgctacgacgaagcatggcgtccgtcaccgcccgckccccggtcgcccctgcgcccgtcgggtctctcaagtcgtcgtcgtcgtcggcggcggccttccttggccactctagccgcctcggccgcactgctaccgcgtcgccgacgagggcagctataaggcggaggccaagggcgagtggctcccgggccttccctcccccgcctacctcgacgggcagcctgccgggttgatcaatggcttcgacccgttgggcctggcgkakgacccggakaacctgaggtggttacgtgcaggcggastggttgaacgggcggtgggcgatgctgggcgtggccgggatgctgatcccgggagtgnctnaccaaggccggggctgatcaacgcgccgcaktggttacgacgccggcaagtcggagtac

SEQ ID NO: 5278 - DNA, 114 bp, Zea mays
  misc_feature: Ceres CLONE 317674-F
acacgcacaccgcgacccagtccagagccagtacgtgcgamggtcacgcacgctgctggtccgcgtacssagacgacggtcaggtcggccggtgcttttcagtttggaataatg

SEQ ID NO: 5279 - DNA, 482 bp, Zea mays
  misc_feature: Ceres CLONE 317684-F
  misc_feature: Encodes the peptide sequence at SEQ ID NO. 5280
atctatctttgtggtcgtggtcctcccgtcgtcgtcgactcgtcgtcgtcggtgttgctccgatgggcaaggactcgaagccgaagatcgccaaggggaagggcaagcaggcggccggctcctctggcggcgacgacggcggcggcaatgkgaggcaagggcaagggcaagggcaagggcggcaagtccgctgacgactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggtttgctttcaacacacctgaggkaactgttagcgcaccattcaagtccacgcacgg

SEQ ID NO: 5280 - protein, 43 aa, Zea mays
  misc_feature: Ceres CLONE 317684-F
  misc_feature (30)..(30): Xaa is any aa, unknown, or other
MGKDSKPKIAKGKGKQAAGSSGGDDGGGNXRQGQGQGQGRQVR

SEQ ID NO: 5281 - DNA, 345 bp, Zea mays
  misc_feature: Ceres CLONE 317693-F
  misc_feature: SWISSPROT Homolog: EC 3.3.2.10 Soluble epoxide hydrolase
  misc_feature: SWISSPROT Homolog: EC 3.8.1.5 Haloalkane dehalogenase
  misc_feature (281)..(281): n is a, c, t, g, unknown, or other
atcgatcaccctcctcgctcccggtcaacagcagcggcgbdgagcacgacgccgacacgcgccatggcggcggtgaggcaccggcagctggaggccaacggcatcacgatgcacgtcgcggaggccggccccgtgaacgcctccgcgccggcgtgctgttcgtgcacggcttcccggagctctggtactcgtggcgccaccagatgggctacctcgccgcgcgcgctaccgctgcgtggcacccgacctccgaggctacggcggcaccaccgcgccgcggnaaccgaactcctacaccgtcttccatatcgtcggcgacatcgtcgtcttcctcgacgccctcca

SEQ ID NO: 5282 - DNA, 346 bp, Zea mays
  misc_feature: Ceres CLONE 317779-F
  misc_feature: Encodes the peptide sequence at SEQ ID NO. 5283
  misc_feature (210)..(210): n is a, c, t, g, unknown, or other
  misc_feature (274)..(274): n is a, c, t, g, unknown, or other
aaatcaagaaaacagttgtctccagtttccatgcagagcagaaaagatcagctagacgagagaagcaatggcgtcggctcctgcgttctgcgtcgcgctgctgctgctgctggcttccgtcgctgccgtccaagcggtgccgccccaggccggcacgtcgtccacctgcagcactgacctcctccgcctcctcccctgccwgcccttcancgagggcaccgccaccgtgccggcggacacctgctgcgccaacctgggcagcatggtgcacgangagccgcagtgcctctgccaggctctcagcaaccccagcacggcccccgtcgccgtcaacatgacgcgcgtg

SEQ ID NO: 5283 - protein, 93 aa, Zea mays
  misc_feature: Ceres CLONE 317779-F
  misc_feature (45)..(45): Xaa is any aa, unknown, or other
  misc_feature (48)..(48): Xaa is any aa, unknown, or other
  misc_feature (69)..(69): Xaa is any aa, unknown, or other
MASAPAFCVALLLLLASVAAVQAVPPQAGTSSTCSTDLLRLLPCXPFXEGTATVPADTCCANLGSMVHXEPQCLCQALSNPSTAPVAVNMTRV

SEQ ID NO: 5284 - DNA, 497 bp, Zea mays
  misc_feature: Ceres CLONE 317806-F
  misc_feature: Encodes the peptide sequence at SEQ ID NO. 5285
aaacatatcgacaattcctcctccctcctcccatcgcttgcccctcgctcccctccctctccgcgccgccccctctcgaatcgaaatccctctccgccatgccgaaggcgccaagaagcgcgccaagctcaagaagcagcagcagcagggccaccccgacgatgccggcaacaccaacgccagcaacggcaactgtaacggcagcgatgacaacaacagcgcctcgagcggccgcgacggcgaccaccacctgcggatcccacccaaagtttctcgtgtggatgcgaacgaggactccatggagagctctgaggagatggtcaccccccgagctgccgcgtcggagccggatgaggaggagactaaggccactgcggccgaggtgcccgtggagcgcaccgtcgacgcggacgtssccgggttctggggaggtcatagtggacgcgtttccgccggaaaccgtttggacaggaacgtkakggcaaagtggatkaggc

SEQ ID NO: 5285 - protein, 165 aa, Zea mays
  misc_feature: Ceres CLONE 317806-F
  misc_feature (139)..(139): Xaa is any aa, unknown, or other
  misc_feature (160)..(160): Xaa is any aa, unknown, or other
  misc_feature (164)..(164): Xaa is any aa, unknown, or other
NISTIPPPSSHRLPLAPLPLRAAPSRIEIPLRHAEGAKKRAKLKKQQQQGHPDDAGNTNASNGNCNGSDDNNSASSGRDGDHHLRIPPKVSRVDANEDSMESSEEMVTPRAAASEPDEEETKATAAEVPVERTVDADVXGFWGGHSGRVSAGNRLDRNVXAKWXR

SEQ ID NO: 5286 - DNA, 173 bp, Zea mays
  misc_feature: Ceres CLONE 317839-F
ataaaatccccggcattcctccttgcctgttccatcgcctccacgaacaaaccacacaccccacctaccccggccggaccggcaggcagcacaacatggacctcgccctcctggagaaggccctgctgggctggkttcgccgcggctgtggtggccatcgccgtggccaagct

SEQ ID NO: 5287 - DNA, 166 bp, Zea mays
  misc_feature: Ceres CLONE 317920-F
gcgcaaaggtgagcttttcttcagaatcattcgtcctcgtcaactcgtgctcagctcatccttcccttccttgggcaaattcatactaatcttctgatccagagccgggtgttggcacagatcaggcggccgcatggckatcagttcgcggattcggcgaacaacg

SEQ ID NO: 5288 - DNA, 127 bp, Zea mays
  misc_feature: Ceres CLONE 317929-F
acacgcacaccgcgacccagtccagagccagtacgtgcgamggccacgcacgctgctggtccgcgtacssagacgacggtcaggtcggccggtgcttttcagtttggaataatgacggcgacgacga

SEQ ID NO: 5289 - DNA, 119 bp, Zea mays
  misc_feature: Ceres CLONE 317938-F
acacgcacaccgcgacccagtccagagccagtacgtgcgamggcacgcacgctgctggtccgcgtacssaggacgacggtcaggtcggccagtgcttttcagtttggaataatgacggc

SEQ ID NO: 5290 - DNA, 379 bp, Zea mays
  misc_feature: Ceres CLONE 317945-F
  misc_feature: Encodes the peptide sequence at SEQ ID NO. 5291
  misc_feature (129)..(129): n is a, c, t, g, unknown, or other
  misc_feature (138)..(138): n is a, c, t, g, unknown, or other
gacacgaaccaggcaaccagctgccgagggaggaacctagcggaacaggtgacggcggcgcgctaccggtgacggggatacggcggcatcgtccccctcggcccctcctccatccccggcgcggcggcnagcagcggncctgcagctttataatggatcccaacatgragcagcttcaagaggctctggttgatattgagactgatgcagaaaaagttcttctggctagacatcagttggtggaaawtgataagataagaaatggtaacaggggaggctctgacagccytttcggaaacaagctaggacgtccaagactagcgtgccatctcccttkgaggtcwtaatgaaagagwtggaaggwakctctggcaagcag

SEQ ID NO: 5291 - protein, 64 aa, Zea mays
  misc_feature: Ceres CLONE 317945-F
  misc_feature (6)..(6): Xaa is any aa, unknown, or other
  misc_feature (32)..(32): Xaa is any aa, unknown, or other
  misc_feature (46)..(46): Xaa is any aa, unknown, or other
  misc_feature (62)..(62): Xaa is any aa, unknown, or other
MDPNMXQLQEALVDIETDAEKVLLARHQLVEXDKIRNGNRGGSDSXFGNKLGRPRLACHLPXRS

SEQ ID NO: 5292 - DNA, 210 bp, Zea mays
  misc_feature: Ceres CLONE 317969-F
  misc_feature (126)..(126): n is a, c, t, g, unknown, or other
  misc_feature (131)..(131): n is a, c, t, g, unknown, or other
gtgcccgcggtgctagtgacggttgctctagatccgttcatcctggtggttttgtgaggtcgaaagcggcgagcrattagaagatgctggacaagctgtgggacgacgtggtggccgggcctcgcntatgnacggcctcgagaagctccgcaagccaccaccgcmcgcccgctcgtcatcaacaaagacgcggacggcggcasstacaag

SEQ ID NO: 5293 - DNA, 766 bp, Zea mays
  misc_feature: Ceres CLONE 318006
  misc_feature: Encodes the peptide sequence at SEQ ID NO. 5294
atccactggaatcataaaagaacagagcggagcagctgcacttccgcgtcgagaaatcattagagctcaagaaaacaggtcagcaatggaggccacggcgacgccaagaacccaagaagtgatgaagcccgagcccggcacggccaaggtgaccgtggacgaggtgacgctccgcaagttcgagctgtccgacgtggacgcgatgatggcgtgggcgtcggacccgcaggtggccgccgtgtgccggtgggagccctacgagtcgacggagccgctgctggccttcatccgcgacgtggtactccctcacccgtggttccgcgccatctgcctccgcggcgagccccgccccgtcggcgccgtgtccgtgtccccgacgggggacccgtgccgcgccgagctcggctacgtgctggcgcgcgcgcactggggccggggcgtggccacggccgccgtgaagcgcacggtggccacggtgttcgccgaggtgccggggctggagcgcgtcgaggcgctcgtggacgtggccaacccggcgtcgcagcgcgtgctggagaaggccgggttcacgagggaggccgtgctccgcaagtacggcgccatcaaaggcgtcgtcagggacatggtcatgtccagcttcatcgacaccgacccagtgcccgagtgacttgagcgcccctgttgcaaatcttttgctgtcggatgcatccagttccgaatttgaatgcaagcacttccaattgtttcctccaaaaaaaaaaaaaaa

SEQ ID NO: 5294 - protein, 193 aa, Zea mays
  misc_feature: Ceres CLONE 318006
  misc_feature (81)..(162): Pfam Name: Acetyltransf_1 Pfam Description: Acetyltransferase (GNAT) family
  misc_feature: SWISSPROT Homolog: EC 2.3.1.128 Ribosomal-protein-alanine N-acetyltransferase
MEATATPRTQEVMKPEPGTAKVTVDEVTLRKFELSDVDAMMAWASDPQVAAVCRWEPYESTEPLLAFIRDVVLPHPWFRAICLRGEPRPVGAVSVSPTGDPCRAELGYVLARAHWGRGVATAAVKRTVATVFAEVPGLERVEALVDVANPASQRVLEKAGFTREAVLRKYGAIKGVVRDMVMSSFIDTDPVPE

SEQ ID NO: 5295 - DNA, 190 bp, Zea mays
  misc_feature: Ceres CLONE 318080-F
aactgggcaattccccaaacctaactaacctttgccaccgcgggagccaccatgggtsscagatgccggacgccgacgggaaggcccgctcggcgactcctcgtcctcttacgggtaccgccgtcggscctgccgcagcaccagtacggcacctttggtcccccatccggagcctccggggagtttccgc

SEQ ID NO: 5296 - DNA, 280 bp, Zea mays
  misc_feature: Ceres CLONE 318087-F
  misc_feature: Encodes the peptide sequence at SEQ ID NO. 5297
  misc_feature (228)..(228): n is a, c, t, g, unknown, or other
atttaacaacccccctgtttcctcataggagagggcggggcgcgcgcgsgassagttcgttcccgtggtgaagaagcgatcgaccggaccatcggccggtccggcagccgggacgcggtgccgtgggccggctgtccctcccacccatcgatcgaggattcaaggatgctgatcctggatcttgggcatctgggtgctacccttgacgctgctgctggcgccggcgcngtattggtgbttccgtcgacggcctgcagcggatcttcctcgccgtcgcctg

SEQ ID NO: 5297 - protein, 38 aa, Zea mays
  misc_feature: Ceres CLONE 318087-F
  misc_feature (25)..(25): Xaa is any aa, unknown, or other
MLILDLGHLGATLDAAAGAGAVLVXPSTACSGSSSPSP

SEQ ID NO: 5298 - DNA, 352 bp, Zea mays
  misc_feature: Ceres CLONE 318095-F
  misc_feature: Encodes the peptide sequence at SEQ ID NO. 5299
aggaaaagggcaaaagccaaaaggcatcaccgccgcgacgacgaccacgatggcagcctcgctccaagccgcggccaccctgatgcagccggccaagatcggcggccgggcgccctttgcctcgctgccgtcccgcccgtcgtcgcaactcgcctgcaggbstttcggcgtcgacgcggcgccgccaggatcacgtgctccctgcaggacgtcgccagcaggtgcgtcgacgccgcgavstcgccggcttcgssctcgccacctcggcgctcctcgtctcgggcgcgackcggagggcacgcccaagaggctgacctacgacgagatccagagcaaaacgtacatggaggtg

SEQ ID NO: 5299 - protein, 101 aa, Zea mays
  misc_feature: Ceres CLONE 318095-F
  misc_feature (38)..(38): Xaa is any aa, unknown, or other
  misc_feature (64)..(64): Xaa is any aa, unknown, or other
  misc_feature (69)..(69): Xaa is any aa, unknown, or other
  misc_feature (81)..(81): Xaa is any aa, unknown, or other
MAASLQAAATLMQPAKIGGRAPFASLPSRPSSQLACRXFGVDAAPPGSRAPCRTSPAGASTPRXRRLRXRHLGAPRLGRDXEGTPKRLTYDEIQSKTYMEV

SEQ ID NO: 5300 - DNA, 445 bp, Zea mays
  misc_feature: Ceres CLONE 318101-F
  misc_feature: Encodes the peptide sequence at SEQ ID NO. 5301
  misc_feature (184)..(184): n is a, c, t, g, unknown, or other
  misc_feature (440)..(440): n is a, c, t, g, unknown, or other
gatttcgattctttctttttacccccacgtgcgccgccgcgaccttcctcgatcccatctcccaacgcccccgcctcgcctcgggatcccgccgccgctccatctgcctttgctcccccacccgcagcagctgagcgacamsscgggcgagggatggccaaggccaggtcgttggcgaacgagnaagcaggcgcasaattcaaacggcggcggcggccacgcgctgtcctccaagctcgcccggtacctcgacccggagcctccttggacaaggaccaactgctggacgcggtgcactggatccgccagcgtgggggctcatatgcgggcctgctctgggggagccgtcccccttcgtcggcgccgtctggatcgcactatttatgggccatctcgactggcattatctattgggtactacacctactttgctgaaggtnkacga

SEQ ID NO: 5301 - protein, 93 aa, Zea mays
  misc_feature: Ceres CLONE 318101-F
  misc_feature (11)..(11): Xaa is any aa, unknown, or other
  misc_feature (15)..(15): Xaa is any aa, unknown, or other
MAKARSLANEXAGAXFKRRRRPRAVLQARPVPRPGASLDKDQLLDAVHWIRQRGGSYAGLLWGSRPPSSAPSGSHYLWAISTGIIYWVLHLLC

SEQ ID NO: 5302 - DNA, 128 bp, Zea mays
  misc_feature: Ceres CLONE 318116-F
acgcacaccgcgacccagtccagagccagtacgtgcgamgcacgcacgctgctggtccgcgtacssagaacgacggtcaggtcggccggtgcttttcagtttggaataatgacggcgacgacgacgac

SEQ ID NO: 5303 - DNA, 119 bp, Zea mays
  misc_feature: Ceres CLONE 318150-F
acacgcacaccgcgacccagtccagagccagtacgtgcgamggcacgcacgctgctggtccgcgtacgagacgacggtcaggtcggccggtgcttttcagtttggaataatgacggcga

SEQ ID NO: 5304 - DNA, 213 bp, Zea mays
  misc_feature: Ceres CLONE 318167-F
  misc_feature (40)..(40): n is a, c, t, g, unknown, or other
ctcctcctctatcttcgcatctggcacgagcagccaagcnvataaaagtagagcggcgagcrcgaccggcctgggcactctttcggccgagcgtascagcaggtcgtcgtcgtcgtcgtcgtcgcagcacccggccggctagcatggccacgaggaggcagtggtggtggtggtgcctgctgctgctggcggcgtggtgctgcgccgcggccg

SEQ ID NO: 5305 - DNA, 395 bp, Zea mays
  misc_feature: Ceres CLONE 318170-F
  misc_feature: Encodes the peptide sequence at SEQ ID NO. 5306
  misc_feature (285)..(285): n is a, c, t, g, unknown, or other
  misc_feature (320)..(320): n is a, c, t, g, unknown, or other
  misc_feature (321)..(321): n is a, c, t, g, unknown, or other
agatcggatccccatacttgctaatgctaggccacggctgacgtctgcgccgcttccgcgtcggcgcggacagctcggagccgctagtctccgctctctgccgcattccgtggcatatcctataacaatttccccaacgccacatggccaacgccgacgctggcgacggcgacgaggtcatcctcgacgctcccggcttcatacgagtgtacaggagcggccgcktcgagcgctttctgccggtcgacttcgccccgccctccactgacgccgccaccgsstctncttcaaaggacgtcgccatcctcccagacgcctgnntattggttcgcatttacctcccattgcccccctcttccggaagttacagcggcaaactccccgtcctggtgttc

SEQ ID NO: 5306 - protein, 84 aa, Zea mays
  misc_feature: Ceres CLONE 318170-F
  misc_feature (28)..(28): Xaa is any aa, unknown, or other
  misc_feature (46)..(46): Xaa is any aa, unknown, or other
  misc_feature (48)..(48): Xaa is any aa, unknown, or other
  misc_feature (59)..(59): Xaa is any aa, unknown, or other
  misc_feature (60)..(60): Xaa is any aa, unknown, or other
MANADAGDGDEVILDAPGFIRVYRSGRXERFLPVDFAPPSTDAATXSXSKDVAILPDAXXLVRIYLPLPPSSGSYSGKLPVLVF

SEQ ID NO: 5307 - DNA, 445 bp, Zea mays
  misc_feature: Ceres CLONE 318184-F
  misc_feature: Translation starting site: 93
atcacacactcgactctcctctctcgcatccgcrcctttcgagctctactccaccccctcgatctcgaagcgcragcagcagtcaggcggccatggacgcgagcgcmcggagccggcgkgaaggcgaagaagggckcggccgggcgcaaggccggcgggcgaggaagaagtcggtgacgaggtccgtcaaggccgggctgcagtttcccgtcggccgcatcgggcggtacctgaagaagggccggtacgcgcascgtccgggcacgggcgcccccgtcttacctggccgccgtcctcgagtaccttggccgccgaggtgctggagctggccggcaacgctgccaaggacaacaagaagacccgcatcatccccgcgccacgtgctccttgccatccgcaacgacgaggagctcggcaagctgctgtccggcgtcaccatcgccca

SEQ ID NO: 5308 - DNA, 116 bp, Zea mays
  misc_feature: Ceres CLONE 318206-F
acacgcacaccgcgacccagtccagagccagtacgtgcgamgcacgcacgctgctggtccgcgtacssagaacgacggtcaggtcggccggtgcttttcagtttggaataatgacg

SEQ ID NO: 5309 - DNA, 441 bp, Zea mays
  misc_feature: Ceres CLONE 318227-F
  misc_feature (309)..(309): n is a, c, t, g, unknown, or other
aagagaagacccgcctctcccgtgagccgtgacgcgacgccggatcgtcctcgtctcctagctcgtggaatgaagggaggtggcgtcatcagggccgccggcggaggtgccgggggcgggtctgttgcgaacgcgactgcggcttcccgtggtgctcctctcctgctccctcttcttcctcgccggcttcttcggctygctcctcttcacccaggatccggagaggcggatatgccgttgccgagagagcggctgttggaggcggcggtggcgragatgccttacggcgagtccggcgaggctgcgcknccttgatcccataccagattttgagctggcagcctcgtgctttgtactttccacaatttgcgacatcagaacagtgtgaaaatatagtaaaaacggcaaaggagagacttaagccatcaacattagccctga

SEQ ID NO: 5310 - DNA, 364 bp, Zea mays
  misc_feature: Ceres CLONE 318257-F
  misc_feature: Encodes the peptide sequence at SEQ ID NO. 5311
  misc_feature (150)..(150): n is a, c, t, g, unknown, or other
  misc_feature (155)..(155): n is a, c, t, g, unknown, or other
  misc_feature (159)..(159): n is a, c, t, g, unknown, or other
gaagccttcgcattcctgtccggcggaaccgctgaagkaagggagccgaacgagcaagcaagccaccaacgaaggttgctagggccggagtggatrgggttcatgctgcgggtgaggctcgcctccttcttcgtcggcgcggctgccgcncrcgngcgngggctacttcctctacaatgactacaagctcgccaacgactctctggccctcaatggtgaaatktctccaatactcaactgacactcgctacgaagcccttgaaaagcgactcgctgctttrgaaggtctgcawagccctgaggctgcaccggatgtggatacgccatctgataagtctgttcgctacgagactttgactttacg

SEQ ID NO: 5311 - protein, 50 aa, Zea mays
  misc_feature: Ceres CLONE 318257-F
  misc_feature (4)..(4): Xaa is any aa, unknown, or other
  misc_feature (27)..(27): Xaa is any aa, unknown, or other
MVKXLQYSTDTRYEALEKRLAALEGLXSPEAAPDVDTPSDKSVRYETLTL

SEQ ID NO: 5312 - DNA, 100 bp, Zea mays
  misc_feature: Ceres CLONE 318275-F
acgcacaccgcgacccagtccagagccagtacgtgcgamgcacgcacgctgctggtccgcgtacgsagaacgacggtcaggtcggccggtgcttttcagt

SEQ ID NO: 5313 - DNA, 114 bp, Zea mays
  misc_feature: Ceres CLONE 318286-F
acacgcacaccgcgacccagtccagagccagtacgtgcgamgtcacgcacgctgctggtccgcgtacssagacgacggtcaggtcggccggtgcttttcagtttggaataatga

SEQ ID NO: 5314 - DNA, 208 bp, Zea mays
  misc_feature: Ceres CLONE 318287-F
  misc_feature: Encodes the peptide sequence at SEQ ID NO. 5315
  misc_feature (61)..(61): n is a, c, t, g, unknown, or other
  misc_feature (143)..(143): n is a, c, t, g, unknown, or other
atcaccaatcagtcagtcacagctcacagcaaacaccgcgamcgcccccgctcccaaaccngaccgagcaaagcgsacccccccaaccgcggatcaatccgcagcatcgatggcgcccaaggcggagaaaaagccggcgssanagaagcccgcggaggaggagcccgcgaccgagaaggcggagaaggctccggcagggaagaagccg

SEQ ID NO: 5315 - protein, 33 aa, Zea mays
  misc_feature: Ceres CLONE 318287-F
  misc_feature (11)..(11): Xaa is any aa, unknown, or other
  misc_feature (12)..(12): Xaa is any aa, unknown, or other
MAPKAEKKPAXXKPAEEEPATEKAEKAPAGKKP

SEQ ID NO: 5316 - DNA, 106 bp, Zea mays
  misc_feature: Ceres CLONE 318294-F
acacgcacaccgcgacccagtccagagccagtacgtgcgamgcacgcacgctgctggtccgcgtacsaggacgacggtcaggtcggccggtgcttttcagtttgga

SEQ ID NO: 5317 - DNA, 450 bp, Zea mays
  misc_feature: Ceres CLONE 318296-F
  misc_feature: Encodes the peptide sequence at SEQ ID NO. 5318
  misc_feature (91)..(91): n is a, c, t, g, unknown, or other
  misc_feature (93)..(93): n is a, c, t, g, unknown, or other
aacattcacctcccatccatttctcaccagaagcgaaggcgaaggcggaggcggaggagcggaggtaggagatctcgagcaagccggassnangttagatgaagacgttcgacccgtggccggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagaaacgcatgtttggccagccagttctgttatgcttttgaatgaaaaatttagacccctctttctcgtttccttaatcgaaatgcttgaactctatgttccatttgtaatgtaataagaggcaaatgaattgaaccaacagcaatcaacttctgatcgaaaa

SEQ ID NO: 5318 - protein, 57 aa, Zea mays; identical to SEQ ID NO: 544
  misc_feature: Ceres CLONE 318296-F

SEQ ID NO: 5319 - DNA, 366 bp, Zea mays
  misc_feature: Ceres CLONE 318315-F
  misc_feature: Encodes the peptide sequence at SEQ ID NO. 5320
  misc_feature (108)..(108): n is a, c, t, g, unknown, or other
aaagaaaacccaacgcaaaagcaacaaacaactccaaaggtccaaagccaacccgtactaatccgagatccccaaccatggccgtcggcgacgtggagacgcggcgcnctgctgcccccgccggcgtctgccctggcggacgagccctccgcgggcccgcctccagacgaccggctcggcatcggctacctcatcttcttcaccctgggcgccggcttcctgctcccctggaacgcgttcatcaccgccgtcgactacttcgacttcctctacccgggggccccgtcgaccgcgtgttctccatatcctacatggtctccgccttactgcccctgctcgtcatcgtgctcttcttccccaagtcca

SEQ ID NO: 5320 - protein, 122 aa, Zea mays
  misc_feature: Ceres CLONE 318315-F
KENPTQKQQTTPKVQSQPVLIRDPQPWPSATWRRGALLPPPASALADEPSAGPPPDDRLGIGYLIFFTLGAGFLLPWNAFITAVDYFDFLYPGAPSTACSPYPTWSPPYCPCSSSCSSSPSP

SEQ ID NO: 5321 - DNA, 517 bp, Zea mays
  misc_feature: Ceres CLONE 318318-F
  misc_feature: Encodes the peptide sequence at SEQ ID NO. 5322
  misc_feature (81)..(81): n is a, c, t, g, unknown, or other
gcgctgcacgtcatccgcgtcgaagcggatacagtgttggagcatacgcaacccggaagcgggcatatatgaacagcgtgngtcagacgcggagggtgcactttggattcgctcgatcggccatcatctgactgtgcaagcacgagagggggatacagcggattcataaaccgtcagagtgttaggacaagatggtggccaatggtgatgcacctgctagagggagcgcggcggcagctgcaagcctgcgtaggcgtaggaccacaagtggtgctgctgctggtggaggcggtgccagctcaatgctccaattctacactgacgagactgctggccgcaaaatgtcaccaaacactgttctgatcatgagtattgggttcgtagccgtcgttgctgtgctccatgtattcgggaagctgtaccgcacctccaactaggttgggcattgccattatccaagacagctgagtttcaccaagagaggattcctgtagaacaatttaaatggatagcaagt

SEQ ID NO: 5322 - protein, 81 aa, Zea mays
  misc_feature: Ceres CLONE 318318-F
  misc_feature (32)..(77): Pfam Name: Sec61_beta Pfam Description: Sec61beta family
MVANGDAPARGSAAAAASLRRRRTTSGAAAGGGGASSMLQFYTDETAGRKMSPNTVLIMSIGFVAVVAVLHVFGKLYRTSN

SEQ ID NO: 5323 - DNA, 781 bp, Zea mays
  misc_feature: Ceres CLONE 318326-R
  misc_feature: SWISSPROT Homolog: EC 3.4.16.5 Carboxypeptidase C
  misc_feature (494)..(494): n is a, c, t, g, unknown, or other
ccaattgggtaccgggccccccctcgaggtcgacggtatcgataagcttttttttttttttttttgttaaggaaaaaaacatattatttctctttctggatccagggggtgtatacatgagatgctttacaagagcagcagacagacagggtttccagcattgaacttcttatcaacagcatccatccatgagccaatggaaacaacaagcttcagcagctcagtgatcgacacacgctcgcttgaacgacacctcggaccacctagtaattaagagactcccttcttcccttcacgacgtccacgccagtcacatcgccgccttcaaggccatcgtctcacggagcggttcctgcttcagtttcacttgcgtgaatctcctcagcatctccagggcagctttcggctggtccatccgaaaccatgttgcccgcattgtgggacctttgaggaagctcagtgggtcatggctctttcagactccagcttctgcnacgtctactacaaacgggtgagtcccaggaggaatacgaagtctttctggcccgaccatttccttcgaattgccccaattcccgagttttccccacccaattggaaattaaggtccaaacctcccccgccgaattttaaccacgtttaaacccatcctcaaaaggaggccgcgggaatgcccaattttcaaaattctcctcaaccaagcccgggggggattcccttccacaaaacacgaaaaggggcttcaaagaaacgaaaatttatttgtcccccaacacccaac

SEQ ID NO: 5324 - DNA, 593 bp, Zea mays
  misc_feature: Ceres CLONE 318342-R
ccgattgggtaccgggccccccctcgaggtcgacggtatcgataagcttttttttttttttttttgttctatatatatgtgtctattatcatcatgtagttgaatatagatataaaaactctaaaataaatactattttaggacggatggagcagttagttatggatcagaacgagaatccgaggattagaagatgcaacatatcatatatatattatttatattcaacccggtggctaatttgcaccgccgccgccgctggctttgtacactatattcatgatcctaatctagaattgcatcaggaacgagcatgttcctcatcccctgttcccaaacaacacagggaaaagcatatgatcagacccagatagagggaacgcttcgccatcgaggctcgagaggtcgtcactcgatgattcagtcctcgcgatctggtctggctttgcaggcccctagctccatcgaagaaccctttcccaacagcttgtcttatacaaccgaaaagccttcccgggggattttccctaagcctcttccaaacctttaaagggaggggaccggggtccaaaaccccccctgggggggcaccg

SEQ ID NO: 5325 - DNA, 431 bp, Zea mays
  misc_feature: Ceres CLONE 318343-F
  misc_feature: Encodes the peptide sequence at SEQ ID NO. 5326
  misc_feature (209)..(209): n is a, c, t, g, unknown, or other
ctggttcgtcgaagcaccctagtcgtcgtagcggcctacgggctcttgggcagagakagaagctgcatagccagtcgctcctgcatatgctccagctgctgcgcgcaatgatggcactgacggagcggcasscgcagctggagaagaagccggcgcgcgggaggkcgcsctgtcggggaaggccgtcgcggcgctgtgsstgacgagcntcgtcgtggggctgctgcttagcggcaacgtgtcgctcatgtcggcctcggcgtcgsbtccgtccctcgagcacggaayagcgccgacagcgacaagagcattcgtgtttccggttgcgacaattgaagcgtaaactcggagaaaccaccccaaggatctcctgaacgaggtgtcgagaactcatcaagcaatccagtcgctggacaagggcggtgtccacc

SEQ ID NO: 5326 - protein, 31 aa, Zea mays
  misc_feature: Ceres CLONE 318343-F
  misc_feature (7)..(7): Xaa is any aa, unknown, or other
  misc_feature (14)..(14): Xaa is any aa, unknown, or other
MSASASXPSLEHGXAPTATRAFVFPVATIEA

SEQ ID NO: 5327 - DNA, 294 bp, Zea mays
  misc_feature: Ceres CLONE 318379-F
  misc_feature: Encodes the peptide sequence at SEQ ID NO. 5328
aacaccagaatccgcgaatcacagacgcgtctatctcagcttgctgcactgcactaccctgccctgccatcatatcgtacgtgagcccggccgagcgagavsggggaggaggcatggctgctccgaagctcgcgacgctggcgctggccgtgctcctggcggcgaccgtggtggctcccccggccgcggtgcgcgcgsgattgtcgtgctccaccgtgtacagcacgctgatgccgttgcctgccgttcgtccagattgggcggggccatgccgccccagccgtgctgcggcgc

SEQ ID NO: 5328 - protein, 60 aa, Zea mays
  misc_feature: Ceres CLONE 318379-F
  misc_feature (29)..(29): Xaa is any aa, unknown, or other
MAAPKLATLALAVLLAATVVAPPAAVRAXLSCSTVYSTLMPLPAVRPDWAGPCRPSRAAA

SEQ ID NO: 5329 - DNA, 433 bp, Zea mays
  misc_feature: Ceres CLONE 318390-F
  misc_feature: Encodes the peptide sequence at SEQ ID NO. 5330
  misc_feature (319)..(319): n is a, c, t, g, unknown, or other
aattcgcttcgatccccagaggcacagacgagacgacagagatgaaggacggaacgygktcggggggaggggcgttcgctgcgggcassatccaaggcagccgtcgacgggaassatacgcgccgccgaagctgtcgccccaggacctacccatcgactatgcaggcttcctcgccgtcgccttcgsbtcctcggcgtcatgctccgctacaaggtgtgctcgtggatcgcaatcatcttctgcgctcagtcgttggcaaacatgaagaactttgagaacgatctgaagcagttttctatggccttcatgtttgctgtnatgggtytggtgacgaactattttggccccgctcgtccaggcagtacaaagcgctaaactgcggaagaacatgtgctacattcttcataggacttttttgggcttccgatagct

SEQ ID NO: 5330 - protein, 58 aa, Zea mays
  misc_feature: Ceres CLONE 318390-F
  misc_feature (1)..(57): Pfam Name: UPF0139 Pfam Description: Uncharacterised protein family (UPF0139)
MLRYKVCSWIAIIFCAQSLANMKNFENDLKQFSMAFMFAVMGLVTNYFGPARPGSTKR

SEQ ID NO: 5331 - DNA, 372 bp, Zea mays
  misc_feature: Ceres CLONE 318400-F
  misc_feature (182)..(182): n is a, c, t, g, unknown, or other
atgagctactataaatggccaaaccctagcggmsscacaaaacactctcctccttcctccaccgccgccaacgtcgcctggcggccgtctgcagctccgcgcctctgctcggaagttgttggtgaaggtttcttgaagctgagaagatggtgctgaagacagaactctgccgcttcacgcangaagatttatcctgggaaaggcatccgatttatccgtgctgattctcaggtttcssctttttgccaactcaaaatgcaagcgctacttccacaaccgccttgaagyctgcaaagcttacctggacagcaatgtacaggaagcagcacaagaaggatatccatgctgaggctgtcaagaagaggcgccgcg

SEQ ID NO: 5332 - DNA, 261 bp, Zea mays
  misc_feature: Ceres CLONE 318434-F
  misc_feature: Encodes the peptide sequence at SEQ ID NO. 5333
  misc_feature (51)..(51): n is a, c, t, g, unknown, or other
  misc_feature (72)..(72): n is a, c, t, g, unknown, or other
acccccttcccttcctccgatccccccgcctcccccaaaatccgacgcgtnatcgccgccatggccgccgcngcaagctcctcctcctggtcgccgccgtcctgggttccctcgtcgccgaygcgcgcccgtgcggcyacssgcagacgctcctcgtctccttctcctccgtcctcaggccgaacccggaccccaccaacccgacgccgctcaccaccacagtcgtcaccgtcctccgcgtccgccgcytcggcccgcacc

SEQ ID NO: 5333 - protein, 86 aa, Zea mays
  misc_feature: Ceres CLONE 318434-F
  misc_feature (17)..(17): Xaa is any aa, unknown, or other
  misc_feature (24)..(24): Xaa is any aa, unknown, or other
  misc_feature (46)..(46): Xaa is any aa, unknown, or other
  misc_feature (47)..(47): Xaa is any aa, unknown, or other
  misc_feature (83)..(83): Xaa is any aa, unknown, or other
PLPFLRSPRLPQNPTRXRRHGRRXKLLLLVAAVLGSLVADARPCGXXQTLLVSFSSVLRPNPDPTNPTPLTTTVVTVLRVRRXGPH

SEQ ID NO: 5334 - DNA, 149 bp, Zea mays
  misc_feature: Ceres CLONE 318446-F
atcacacactcgactctcctctctcgcatccgcrcctctcgagctctactccactccctcgatctcgaatcgtagcagcagtcaggcggccatggacgcgagcgcacggagccggcggtgaaggcgaagaagggcgcggccgggcgcaa

SEQ ID NO: 5335 - DNA, 110 bp, Zea mays
  misc_feature: Ceres CLONE 318476-F
acacgcacaccgcgacccagtccagagccagtacgtgcgamgtcacgcacgctgctggtccgcgtacssagacgacggtcaggtcggccggtgcttttcagtttggaata

SEQ ID NO: 5336 - DNA, 376 bp, Zea mays
  misc_feature: Ceres CLONE 318499-F
  misc_feature: Encodes the peptide sequence at SEQ ID NO. 5337
  misc_feature (78)..(78): n is a, c, t, g, unknown, or other
attgcatccccctttctgctcctgtgctgcgtccaccagccttgtcgttaggacgtaaggtaagacacccaggggcgngccagtgagtacagagagtagccttacgtagcgambtcagagcaagcgagggtacggtcaaggggggtgatggcgctgtctcgacgcatggcggctcccgtcctcgtccttcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgtaaggcggagggcgccacacaagtgcttctgcaa

SEQ ID NO: 5337 - protein, 62 aa, Zea mays
  misc_feature: Ceres CLONE 318499-F
  misc_feature (18)..(53): Pfam Name: Gamma-thionin Pfam Description: Gamma-thionin family
MLLLVATELGTTKVAEARHCLSQSHRFKGLCMSSNNCANVCQTENFPGGECKAEGATQVLLQ

SEQ ID NO: 5338 - DNA, 444 bp, Zea mays
  misc_feature: Ceres CLONE 318504-F
  misc_feature: Encodes the peptide sequence at SEQ ID NO. 5339
  misc_feature (239)..(239): n is a, c, t, g, unknown, or other
accgcaagatccaccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgcctcaggccggtggcagtcgccggcggcctccgtggctacaacaccggcgctccgndccgacgctacgagggggccgagtcggaagacgatagcgtccgcgagtacgatgggcggcacggcggccgggactacgccgtgcccagcctgttctcagatattttccgtgatccgcttagtgcgccgcmatgcattggccgcctgctgaacctgatggacgacttggcggtggcggcgcagggtcgtgcggtgcgccgtggctg

SEQ ID NO: 5339 - protein, 147 aa, Zea mays
  misc_feature: Ceres CLONE 318504-F
  misc_feature (80)..(80): Xaa is any aa, unknown, or other
  misc_feature (123)..(123): Xaa is any aa, unknown, or other
PQDPPQQRRRKQTNLATQGERPKGRGECRHGFHCRFQEGRSSSSRSGEAHRSVLRARDWLRLRPVAVAGGLRGYNTGAPXRRYEGAESEDDSVREYDGRHGGRDYAVPSLFSDIFRDPLSAPXCIGRLLNLMDDLAVAAQGRAVRRG

SEQ ID NO: 5340 - DNA, 472 bp, Zea mays
  misc_feature: Ceres CLONE 318522-F
  misc_feature: Encodes the peptide sequence at SEQ ID NO. 5341
caagatgactgaggctgacacgggaagtacagaggtcaaagataaagaagagaagggagatgaagttgtggacacaactgtggataagcaggatgaatcgaaggagcaagaggaaggtgtttcggctgagcaagatgagaagcaaggagaggaagcagaagaaaaaggaaaagaaacggatgccgatgagaagcaagaagaggaagcagaagaaaaaggttctgctgataagaaagatgaagatgaaggtgaccagaagatggaagagaataaggaggagactccgaagaataagaaagcaaggagtgccagggatagaagccagggaaatgataataaacatgatggatcaaaatctagggaagccaaaagtttgctgaacaccccaagcccatatggtaccgatcgtcctcaacgtgagaggaaaatagtggagaggttggttgaggtgattgagaaagagccaaacagg

SEQ ID NO: 5341 - protein, 157 aa, Zea mays
  misc_feature: Ceres CLONE 318522-F
KMTEADTGSTEVKDKEEKGDEVVDTTVDKQDESKEQEEGVSAEQDEKQGEEAEEKGKETDADEKQEEEAEEKGSADKKDEDEGDQKMEENKEETPKNKKARSARDRSQGNDNKHDGSKSREAKSLLNTPSPYGTDRPQRERKIVERLVEVIEKEPNR

SEQ ID NO: 5342 - DNA, 468 bp, Zea mays
  misc_feature: Ceres CLONE 318529-F
  misc_feature: Encodes the peptide sequence at SEQ ID NO. 5343
acacagctcaacaaaggagcgcggcggcccctcattccttcctcccacttctctcgcgctgsgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccacc

SEQ ID NO: 5343 - protein, 110 aa, Zea mays
  misc_feature: Ceres CLONE 318529-F
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQAST

SEQ ID NO: 5344 - DNA, 172 bp, Zea mays
  misc_feature: Ceres CLONE 318561-F
  misc_feature (101)..(101): n is a, c, t, g, unknown, or other
cccaaactgcggtassgaaaacgcgagckctgcggaacaacgatggcgacgatgtctcttgccgcggcgtcacccctcgcctccattccccgcggcatcgntccaggctcccttgcgcggcattcctgtccatccgcttaggtggcgcgacgkcgacgcggttcgctggact

SEQ ID NO: 5345 - DNA, 731 bp, Zea mays
  misc_feature: Ceres CLONE 318563
  misc_feature: Encodes the peptide sequence at SEQ ID NO. 5346
atacccaaatacacaatggctggtgggtcctcctccatttcccccacctactacttcctctgctcgccttcgtcggatcggatccacagcaagcagcaacagcctgcagccggcagtcctcgcctccgcctcctccaccctgaccgtcaacagaggaagacgaggatgtcgggatccaaggtgtacaccctcgaggaggtggctaagcacaacaccaaggacgactgctggctcgtcatcggcggcaaggtgtacaatgtgaccaagtttctggaggatcaccctggaggcgatgatgttctgctgtcttccactgccaaggatgctaccgatgatttcgaagatgtggggcacagcagcactgcccgtgcaatgatggacgagtacttagtgggtgagattgatgcagccacgatacccaccaaggtgaagtacacgccccccaagcagccgcactacaaccaggacaagacccaggagttcgtcatcaagatcctccagtttttggtccccctcgcaatactgggtctggccgtcgctgtaaggatgtacaccaagtcggaatctgcctaatctcttgtcatcaacgcttcaaacatcattcacaaactgaataagttagtgttgaaatgctgcaaagatcattaattcggaaacttgagtctttgctgtcgtgtgagacgtacgtctattagtataaaatcacttctataagaaaaaaaaaaaaaaaa

SEQ ID NO: 5346 - protein, 185 aa, Zea mays
  misc_feature: Ceres CLONE 318563
  misc_feature (56)..(130): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MAGGSSSISPTYYFLCSPSSDRIHSKQQQPAAGSPRLRLLHPDRQQRKTRMSGSKVYTLEEVAKHNTKDDCWLVIGGKVYNVTKFLEDHPGGDDVLLSSTAKDATDDFEDVGHSSTARAMMDEYLVGEIDAATIPTKVKYTPPKQPHYNQDKTQEFVIKILQFLVPLAILGLAVAVRMYTKSESA

SEQ ID NO: 5347 - DNA, 342 bp, Zea mays
  misc_feature: Ceres CLONE 318602-F
  misc_feature: Translation starting site: 205
  misc_feature (254)..(254): n is a, c, t, g, unknown, or other
  misc_feature (326)..(326): n is a, c, t, g, unknown, or other
acaacgctacgggcagggcagacaatccgcatcgatccccaccgcaaattgcccctatctatccctccctacaaatcgaaacaaagaaagataaaatcgagaggacgccagggccgattctctgcgtgacttggggcgtcgtcgcgagttttctccggccgagggcggcgcgaccggacaaccagcgtgasscggaccggcgacatgactcgcggcaaccagcgtgaccgcgwccgtgagcgcgcggcgkcssnaaagcccaacgccaagaactcccaggacgggctcaccccggakcwgcgccgckagagggacaagaaagctcnggaggagaaggcggcc

SEQ ID NO: 5348 - DNA, 221 bp, Zea mays
  misc_feature: Ceres CLONE 318618-F
  misc_feature: Encodes the peptide sequence at SEQ ID NO. 5349
atctcgacggctcgccacctctcttctctcctcggccctcgccactctcactccgccacgccggagcacgccgctgcgsscgcctkcgccgcttacacacgaggggactatggacacggtggctccccgcctgagtcgctcctcgacgcgatacgggcccatcagcagcagtgctssctccttcagtgggcccgtccggaagtggcgcaaggcctgggtgc

SEQ ID NO: 5349 - protein, 37 aa, Zea mays
  misc_feature: Ceres CLONE 318618-F
  misc_feature (23)..(23): Xaa is any aa, unknown, or other
MDTVAPRLSRSSTRYGPISSSAXSFSGPVRKWRKAWV

SEQ ID NO: 5350 - DNA, 229 bp, Zea mays
  misc_feature: Ceres CLONE 318628-F
  misc_feature: Translation starting site: 69
  misc_feature (66)..(66): n is a, c, t, g, unknown, or other
  misc_feature (137)..(137): n is a, c, t, g, unknown, or other
atcttgctctgaacgcattcctcccatctcccaagacctcctcagacccgagaagcgcmbgctggnccatggacgccaccggcactggagctggagggaaggcgaagaagggagcggccggtcgcaaggccgckggngccgaggaagaagtcggtgacgaggtccgtgaaggccgggctccagttccccgtcggccgcatcgggcgctacctcaagaagggccgctacg

SEQ ID NO: 5351 - DNA, 446 bp, Zea mays
  misc_feature: Ceres CLONE 318629-F
  misc_feature: Encodes the peptide sequence at SEQ ID NO. 5352
ctctttcttgttgcacgcctgcctgggcgaaccgtcgccgctatacaccaggcgccgggcttcgcggcgccgagtagccaccagctgccgctcaacattcacctctgccaagggcatggaccacatgacgatgctcggcgccggagccccccaccagctctccagggctgaaccaatgcctgaccgtabaaagggttctggcagacggatgtgcagcctgtgcctcggatagacatcatctgtcctctgccttgtcgcccttcccgctcactgctcctcaataggcccagccccaagcctaatggggcactcccattgtatggagcaaaccctacttatgatatcgttgatctcatccttagcaagaatgaccctgatgtggatactgattcaagcagccaggcggcctttttctgtggctcgccttcctgcccgcactaacaacc

SEQ ID NO: 5352 - protein, 38 aa, Zea mays
  misc_feature: Ceres CLONE 318629-F
  misc_feature (25)..(25): Xaa is any aa, unknown, or other
MDHMTMLGAGAPHQLSRAEPMPDRXKGSGRRMCSLCLG

SEQ ID NO: 5353 - DNA, 176 bp, Zea mays
  misc_feature: Ceres CLONE 318663-F
  misc_feature (35)..(35): n is a, c, t, g, unknown, or other
acaccaagaatcacacaacagcagctcaaaaaacncaacacacctcaacaagcagagcaaagacccgggattcgccggcgcggtassagaagcrgagatggacgggaggatgttcggtctcgagacccccctgatggtggcgctgcagcaccttctggacgtgcccgacggcgacg

SEQ ID NO: 5354 - DNA, 437 bp, Zea mays
  misc_feature: Ceres CLONE 318680-F
  misc_feature (197)..(197): n is a, c, t, g, unknown, or other
atgcatcccatctccatccccatccatagagctgcaggcggcctgcgctgcagccaacaagctcatcagctcaccgtacctaggaggacgaccgagcagctaaggtagtagtagctagctagccagtgatggcgggctacaaagcgcagggcggggcgctcggcgtcgtcctggctgtcgccgcgctcttcgcssgncassgaattggcgatggcggtggacgacgagcacatgtaccactggaagtgcttcaagtcgtgcacggggaacttgccgcgacgaggacgccttttgacgacgtcgtcgcccgccactccgagggctcctcccacgtcgtcgtcgctgccgtcttccggcggcaagttgcaaggacaggtgcctcagcgagtgcttcgaggacctgccggccctctgctaccaccagttgcgtcgccacc

SEQ ID NO: 5355 - DNA, 190 bp, Zea mays
  misc_feature: Ceres CLONE 318692-F
  misc_feature: Encodes the peptide sequence at SEQ ID NO. 5356
  misc_feature (102)..(102): n is a, c, t, g, unknown, or other
gttttgccgctctgtgagcctgctgccgtcttcttccgccgccgccgccgtcgtcgtcttcgtccgtagcagatcagagakcggggaggaagaaaaagcgantcgatggcgtccaactacgtggacacgccgggcgtakgagggacggttccacggccctcacagccacagcaccagcacgaccccgacg

SEQ ID NO: 5356 - protein, 28 aa, Zea mays
  misc_feature: Ceres CLONE 318692-F
  misc_feature (12)..(12): Xaa is any aa, unknown, or other
MASNYVDTPGVXGTVPRPSQPQHQHDPD

SEQ ID NO: 5357 - DNA, 232 bp, Zea mays
  misc_feature: Ceres CLONE 318740-F
  misc_feature: Encodes the peptide sequence at SEQ ID NO. 5358
acaacaccagaatccgcgaatcacagacgcgtctatctcagcttgctgcactgcactaccctgccctgccatcatatcgtacgtgagcccggccgagcgagassmggggawgaggcatggctgctccgaagctcgcgacgctggcgctggccgtgctcctggcggcgaccgtggtggctcccccggccgcggtgcgcgcgsgaattgtcgtgctccaccgtgtacagcacgc

SEQ ID NO: 5358 - protein, 38 aa, Zea mays
  misc_feature: Ceres CLONE 318740-F
  misc_feature (29)..(29): Xaa is any aa, unknown, or other
MAAPKLATLALAVLLAATVVAPPAAVRAXIVVLHRVQH

SEQ ID NO: 5359 - DNA, 154 bp, Zea mays
  misc_feature: Ceres CLONE 318768-F
aaccacaccactcgagcgcgcgcbggcccaccgctccgccgctgcccgcccgccgcatgbkagggatcctctcctcttcctccgctctcctccggcgagccggcgcccagctctcgcgcacggactgcagtagcccctcagcgtccgcgacctc

SEQ ID NO: 5360 - DNA, 403 bp, Zea mays
  misc_feature: Ceres CLONE 318786-F
  misc_feature: Translation starting site: 53
gtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgccgagttcgtcgaggccgcggcggagtccggcgaggccgcccacgcctgcggctgcggtagcrttgcaagtgcgacccctgcaactgctgatcacatcgatcgacgaccatggatatgattattatctatctagcttgtggtggtggttgaacaataataagcgaggccgagctggccctccacggcaacgccgcaaggtcttctgcggcctc

SEQ ID NO: 5361 - DNA, 424 bp, Zea mays
  misc_feature: Ceres CLONE 318804-F
  misc_feature: Encodes the peptide sequence at SEQ ID NO. 5362
  misc_feature (259)..(259): n is a, c, t, g, unknown, or other
  misc_feature (379)..(379): n is a, c, t, g, unknown, or other
atctctatgacacagtgagggttgatccggtccactcccatccctagtgggccggatacgtttcgaggctacagaacaccaacatggatattgcgatcggtgcctcgatgggctaaaaatcagaacacatgccatcctggcccatttgaccagtgcgcttggagataaggcacggcacaagctaggcgcgcaaagccattcgacacatgggcggcgcggcgagctagacgccttcgacgccggccgctgcgcgassggntacgcgctgggcctcgccgtgggccgtcggttcgccgaggtcatccagagcaggatgcggcaggacctcgtgctccgggagcagctgctgccgttcgcgtcgacggcgcaggcgcacgcntcccttcgccgcgctccagtccgccaacagggaagaggtacccgc

SEQ ID NO: 5362 - protein, 37 aa, Zea mays
  misc_feature: Ceres CLONE 318804-F
MRQDLVLREQLLPFASTAQAHASLRRAPVRQQGRGTR

SEQ ID NO: 5363 - DNA, 654 bp, Zea mays
  misc_feature: Ceres CLONE 318806-R
  misc_feature: SWISSPROT Homolog: EC 2.5.1.16 Spermidine synthase
ccaattgggtaccgggccccccctcgaggtcgacggtatcgataagcttttttttttttttttttgtctaattgtttggacaataaattactgacatggtgaagggagtacattgtaatatcagctcgtcctttcttagcatgccaatctcatctcattgtttggatactgaattactgacatgatgcctcattatgcgtctcatagcatgtgatagtaagactatgaaccaatggcgatactggaggtacggcaccaggaaggaaggaatggtttcttgatatcttgtggtacatcgcgagtcctggtctagctaggatgtagcgaaaatttcactcctggatgcaagagtcaacttcagtggtgccgccggtgtttcctccgcttgctctgtttcagtgaaaacgcaatatgcttctagctctctccttgcaaaggtcgggaagacaaatgctgccctatgcatctctgagttataaaatctgatctcccttccagcttttgtagctccttccagctttttcatttgatttattagaatcagaaaagtcaccaatgggaccttcttggcacactagtaaaaatcaatcaccccactccggtaaggttgggacactttggtcatgcctaacgtaaagaaaaccttgaaaggtt

SEQ ID NO: 5364 - DNA, 130 bp, Zea mays
  misc_feature: Ceres CLONE 318811-F
actgctgccgcctgggccaagtcgtcgtcttgcttgccaatccgtcgctccacctgaacacaccgtgtcgtaagaggaggcgaagaagcgatgggcgtgaccaaggaggacgtcgaggcggccatcacct

SEQ ID NO: 5365 - DNA, 498 bp, Zea mays
  misc_feature: Ceres CLONE 318832-F
  misc_feature: Encodes the peptide sequence at SEQ ID NO. 5366
gttttttccatcccattttctctcctctctccgtcgccgcctcgggccaaaccctacgcagggagttgattgatcgattgcagccatgagtaagttgcattccgagcttctcaaggattgcatctcccagatagttcagaatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatggaacttgactacatggatgttgaggccctcaagaaaatgaacaagaacaagaagcttgttaagaagcttgccaagaagtaccatgcttttttggcatcagagaccatcatcaagcaaattccccgtctccttggtcctggtctcaacaaggcaggcaagttccccactctggtcactca

SEQ ID NO: 5366 - protein, 137 aa, Zea mays
  misc_feature: Ceres CLONE 318832-F
  misc_feature (9)..(137): Pfam Name: Ribosomal_L1 Pfam Description: Ribosomal protein L1p/L10e family
MSKLHSELLKDCISQIVQNAKKNRKFTETVELQISLKNYDPQKDKRFSGSVKLPHIPRPKMKVCMLGDAQHVEEAEKMELDYMDVEALKKMNKNKKLVKKLAKKYHAFLASETIIKQIPRLLGPGLNKAGKFPTLVT

SEQ ID NO: 5367 - DNA, 455 bp, Zea mays
  misc_feature: Ceres CLONE 318844-F
  misc_feature: Encodes the peptide sequence at SEQ ID NO. 5368
  misc_feature (408)..(408): n is a, c, t, g, unknown, or other
gagatcgcatacgcctgcctgcccacccacctccccttttccttcctcttcgccccagcgacgcggccgcccggagaccgagcgaggcaggcaactaaccaccgagaggcagggacaggaacaggaagccggavsaagatgtcgtcggtgttcagcggcgatgagacggcccccttcttcggcttcctcggcgccgccgccgccctcgtcttctcatgcatgggcgccgcgtacgggaycgcgaagagcgtcgtcggcgtggcgtcgatgggtgtgatgcggccggagctcgtcatgaagtccatcgtgcccgtggtcatggctggtgdgccggtatctacggcggctcatcatcgccgtcatcattagcacggggatcaaccccaaggccaagccctactacctctntgatggctacgccacctttcgtccgggcttgcctgtggyctcgctgg

SEQ ID NO: 5368 - protein, 76 aa, Zea mays
  misc_feature: Ceres CLONE 318844-F
  misc_feature: SWISSPROT Homolog: EC 3.6.3.14 H(+)-transporting two-sector ATPase
  misc_feature (34)..(34): Xaa is any aa, unknown, or other
  misc_feature (64)..(64): Xaa is any aa, unknown, or other
MSSVFSGDETAPFFGFLGAAAALVFSCMGAAYGXAKSVVGVASMGVMRPELVMKSIVPVVMAGXPVSTAAHHRRHH

SEQ ID NO: 5369 - DNA, 140 bp, Zea mays
  misc_feature: Ceres CLONE 318862-F
acacgcacaccgcgacccagtccagagccagtacgtgcgamggcacgcacgctgctggtccgcgtacgcagacgacggtcaggtcggccggtgcttttcagtttggaataatgacggcgacgacgacgacagccgccggc

SEQ ID NO: 5370 - DNA, 417 bp, Zea mays
  misc_feature: Ceres CLONE 318872-F
  misc_feature: Encodes the peptide sequence at SEQ ID NO. 5371
aatcaaactgattgatccgtcgcccgcabsacagcagccgcggcgaggtcgtccgtcggattcggaggctcagttattactgaaaagtataatacagtacctakggcttctctggacgccgttgssaggagacctcgccctgctgattctgtacctgaacaaggccgaggcgcgggacaagatctgccgagcgatccagtacgggttccaagtttcatcagcaacggcgagccagggcctgcgcagaacgtcgacaagttccaccagccttggcccggaaagtgttccggctctgtaagttcgtcaacgacctttcatgctttggatcagccctcctgccaaggggactccgctcccgctgatcctactcgggaaktccaagaacgcgatgctgtcgactttcctcttcctggacca

SEQ ID NO: 5371 - protein, 33 aa, Zea mays
  misc_feature: Ceres CLONE 318872-F
  misc_feature (20)..(20): Xaa is any aa, unknown, or other
MLWISPPAKGTPLPLILLGXSKNAMLSTFLFLD

SEQ ID NO: 5372 - DNA, 182 bp, Zea mays
  misc_feature: Ceres CLONE 318924-F
  misc_feature (128)..(128): n is a, c, t, g, unknown, or other
gtgcccgykgtgctagtgacggttgctctagatccgttcatcctggtggttttgtgaggtcgaaagcggygagcdattagaagatgctggacaagctgtkggacgacgtggtggccgggcctcgccgnagcacggcctcgagaagctccgcaaggccaccaccgcsscgcccgctcgtcatc

SEQ ID NO: 5373 - DNA, 301 bp, Zea mays
  misc_feature: Ceres CLONE 318962-F
  misc_feature: Encodes the peptide sequence at SEQ ID NO. 5374
  misc_feature (85)..(85): n is a, c, t, g, unknown, or other
  misc_feature (91)..(91): n is a, c, t, g, unknown, or other
  misc_feature (255)..(255): n is a, c, t, g, unknown, or other
aaagcaagccatgtggaggagggctttagcgatggtcctgttcatggctggcgccgcgctgctcgccggggctgccggcccggcnccacanggcgtgtggagcatcatcacccggcccatgttccagagcatgctgagccaccgcggcgacasgggttgccagggcgccttctacacctacgacgccttcatcgaggccgccagcaagttccccggcttcggcaccaccggcgacgagcagacgcgcaggcgggnagctcgccgccttcttcggccagamgtcccacgkaaccaccggtgg

SEQ ID NO: 5374 - protein, 97 aa, Zea mays
  misc_feature: Ceres CLONE 318962-F
  misc_feature: SWISSPROT Homolog: EC 3.2.1.14 Chitinase
  misc_feature (27)..(27): Xaa is any aa, unknown, or other
  misc_feature (48)..(48): Xaa is any aa, unknown, or other
  misc_feature (82)..(82): Xaa is any aa, unknown, or other
  misc_feature (90)..(90): Xaa is any aa, unknown, or other
MWRRALAMVLFMAGAALLAGAAGPAPXGVWSIITRPMFQSMLSHRGDXGCQGAFYTYDAFIEAASKFPGFGTTGDEQTRRRXARRLLRPXVPRNHRW

SEQ ID NO: 5375 - DNA, 473 bp, Zea mays
  misc_feature: Ceres CLONE 319001-F
  misc_feature: Encodes the peptide sequence at SEQ ID NO. 5376
gacacattccacccacccatcaccccttccttcctttccattctctgtcgccttcgcccctccaaggttctctgattccagacgcaaccccgcgggtcaaggagccagagggggggtgcacagcgatcgttctgccggagatcgaaaccctaaggtagggtttgaggcgccgggctgcggccgccgagatgtcgacgccggcgaggaagcggctgatgcgggacttcaggcgcctgcagcaggacccgcccgccgggatcagcggcgcgccssacgacaacaacatcatgctctggaacgccgtcatattcgggccggatgatacgccttgggacggaggcacgttcaagcttaccttgcagtttacagaagattacccaaacaagccaccaactgttcggtttgtctctaggatgtttcatccaaacatatatgctgatggaagcatctgcttggatatcctacagaaccag

SEQ ID NO: 5376 - protein, 95 aa, Zea mays
  misc_feature: Ceres CLONE 319001-F
  misc_feature (8)..(95): Pfam Name: UQ_con Pfam Description: Ubiquitin-conjugating enzyme
  misc_feature: SWISSPROT Homolog: EC 6.3.2.19 Ubiquitin--protein ligase
  misc_feature (29)..(29): Xaa is any aa, unknown, or other
MSTPARKRLMRDFRRLQQDPPAGISGAPXDNNIMLWNAVIFGPDDTPWDGGTFKLTLQFTEDYPNKPPTVRFVSRMFHPNIYADGSICLDILQNQ

SEQ ID NO: 5377 - DNA, 386 bp, Zea mays
  misc_feature: Ceres CLONE 319021-F
  misc_feature: Translation starting site: 69
  misc_feature (136)..(136): n is a, c, t, g, unknown, or other
atcttgctctgaacgcattcctcccatctcccaagacctcctcagacccgagaagcccagctgcggccatggacgccaccggcactggagctggagggaaggcgaagaagggagcggccggtcgcaaggcacgcgnggcgaggaagaagtcggtgacgaggtccgtgaaggccgggctccagttccccgtcggccgcatcgggcgctacctcaagaagggccgctacgcgcassgtcggcagcggtgcccccgtctacctcgcggccgtcctggagtacctcgccgctgaggtcctggagctcgccgkcaacgctgccaagggacaacaagaagacgcgcatcgtcccgcgccacgtgctgctggcgatccgcaackacgaggagc

SEQ ID NO: 5378 - DNA, 137 bp, Zea mays
  misc_feature: Ceres CLONE 319023-F
  misc_feature (68)..(68): n is a, c, t, g, unknown, or other
acacgcacaccgcgacccagtccagagccagtacgtgcgamggcacgcacgctgctggtccgcgtacnagacgacggtcaggtcggccggtgcttttcagtttggaataatgacggcgacgacgacgacagccgccg

SEQ ID NO: 5379 - DNA, 99 bp, Zea mays
  misc_feature: Ceres CLONE 319030-F
atctccctgtttaatcaatccttcaagcgcaakgcctcctcccctcgtccggtcgtgagaagggatggcgggccgtggcaaggctatcggcgctggcgc

SEQ ID NO: 5380 - DNA, 334 bp, Zea mays
  misc_feature: Ceres CLONE 319038-F
  misc_feature: Encodes the peptide sequence at SEQ ID NO. 5381
  misc_feature (34)..(34): n is a, c, t, g, unknown, or other
gttgtctctttcacttgctccgcgccggcatccnccccccttcgccgccaccgcgatcttgttctcagttctacggcggcgatacccccctccactccccaccctgtcacccccacaaaataagttctgcggcggcgatggcgctctcctcctcccggccgaagcacctcctgcgccccatcctgcggggtttccacgcctcagcgcgggccctggcgcgggtggagccgcacgagttctccaagcccagcgagtacctgggcagctgggagcccgcggcggasctcgggaggcgtgggcgcggctggaccggctgcgcaaggggtacgcgagc

SEQ ID NO: 5381 - protein, 65 aa, Zea mays
  misc_feature: Ceres CLONE 319038-F
  misc_feature (49)..(49): Xaa is any aa, unknown, or other
MALSSSRPKHLLRPILRGFHASARALARVEPHEFSKPSEYLGSWEPAAXLGRRGRGWTGCARGTR

SEQ ID NO: 5382 - DNA, 404 bp, Zea mays
  misc_feature: Ceres CLONE 319039-F
  misc_feature (180)..(180): n is a, c, t, g, unknown, or other
  misc_feature (181)..(181): n is a, c, t, g, unknown, or other
  misc_feature (184)..(184): n is a, c, t, g, unknown, or other
  misc_feature (282)..(282): n is a, c, t, g, unknown, or other
agaaaaaaagaactaacgttaaaggcggcttgtgttgtggcgcagggcaccagcagcagtgggcgctccccttcgccggctccttgcaggtcagtccgccgccgcagcaggsscaaccggataggaagggccgcggcggaggcggggtcatggattcaggctccagatccagcggcgganngtntcgacgtacgaagacggcctcaccacgcgccgssaggtctcctcctcgctccaagatttggcagtaagggtggattggaaggktgggagctgcagcrntggcggtacaaatcaggggccaaacacaccacggtcaaaacactcggccacagagcagcgcagacgcagcaagatcaatgataggtttcagatacttagggagctgttgccacacaaatgat

SEQ ID NO: 5383 - DNA, 379 bp, Zea mays
  misc_feature: Ceres CLONE 319075-F
  misc_feature: Encodes the peptide sequence at SEQ ID NO. 5384
  misc_feature (37)..(37): n is a, c, t, g, unknown, or other
  misc_feature (197)..(197): n is a, c, t, g, unknown, or other
atcccatctccatccccatccatagagctgcaggcgncctgcgctgcagccaacaagctcatcagctcaccgtacctaggaggacgaccgagcagctaaggtagtagtagctagctagccagtgatggcgggctacaaagcgcagggcggggcgctcggcgtcgtcctggctgtcgccgcgctcttcgcggccassnawtggcgatggcggtggacgacgakcacatgtaccactggaagtgcttcaagtcgtgcacggggaactgccgcgacgaggacgcctttgacgacgtcgtcgccccgccacttccgagggcttcctcccacgtcgtcgtcgctgccgtctccggcggcaagttgcaaggacaggtgcctcagc

SEQ ID NO: 5384 - protein, 58 aa, Zea mays
  misc_feature: Ceres CLONE 319075-F
  misc_feature (6)..(6): Xaa is any aa, unknown, or other
MAVDDXHMYHWKCFKSCTGNCRDEDAFDDVVAPPLPRASSHVVVAAVSGGKLQGQVPQ

SEQ ID NO: 5385 - DNA, 424 bp, Zea mays
  misc_feature: Ceres CLONE 319084-F
  misc_feature: Encodes the peptide sequence at SEQ ID NO. 5386
  misc_feature (50)..(50): n is a, c, t, g, unknown, or other
aaatcgaatcgagcccatccatctccatttccgccgmcgccgccgccgangaccccaaccccacccatccaccaccatgtgcgccgctccacaccctagcccccgccttgcgcagggctaccgccgccgccgccggggcccctgcggcgtccgcctcctctgcagcccgcgccagccccgctctcctcggcggccgssctttccgccgcaccagcccgctcctctcaggggacaagccggcgagtgtggaggacgtcatgcccatcgccacggggctcgagcgggaggagctggaggccgagctcaaggggaagaagcggttttgacatggatcccctggtgcggccccttcggtaccaaggaggaaccattctgtagttgagtcctactataacaagcggatagtcggctgccctggtggtga

SEQ ID NO: 5386 - protein, 107 aa, Zea mays
  misc_feature: Ceres CLONE 319084-F
  misc_feature (12)..(12): Xaa is any aa, unknown, or other
  misc_feature (16)..(16): Xaa is any aa, unknown, or other
  misc_feature (66)..(66): Xaa is any aa, unknown, or other
IESSPSISISAXAAAXDPNPTHPPPCAPLHTLAPALRRATAAAAGAPAASASSAARASPALLGGRXFRRTSPLLSGDKPASVEDVMPIATGLEREELEAELKGKKRF

SEQ ID NO: 5387 - DNA, 112 bp, Zea mays
  misc_feature: Ceres CLONE 319089-F
acacgcacaccgcgacccagtccagagccagtacgtgcgamgccacgcacgctgctggtccgcgtacssagaacgacggtcaggtcggccggtgcttttcagtttggaataa

SEQ ID NO: 5388 - DNA, 428 bp, Zea mays
  misc_feature: Ceres CLONE 319100-F
  misc_feature: Translation starting site: 67
  misc_feature (231)..(231): n is a, c, t, g, unknown, or other
atcttgctctgaacgcattcctcccatctcccaagacctcctcagacccgagaagcgcmbgcggccatggacgccaccggcactggagctggagggaaggcgaagaagggagcggccggtcgcaaggccgcgggccgagtgaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagttcgccggcaacgctgccaaggacaacaagaagacgcgcatcgtcccgcgccacgtgctgctggcgatccgcaacgacgaggagctcgggaagctgctgaccggcgtgaccatcgcccacgssgcgtgtt

SEQ ID NO: 5389 - DNA, 408 bp, Zea mays
  misc_feature: Ceres CLONE 319103-F
  misc_feature: Translation starting site: 92
accctctagccaaaaccctagcagccgcccggtgctccctctctgcagatctccctttcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagtcagattatgtcaagctggtgaaggcactctgcgcggassacaatkttcacctggtcactgttcctgccgctaagacccttggcgagtgggctgggctttgcaagattgactctgagg

SEQ ID NO: 5390 - DNA, 126 bp, Zea mays
  misc_feature: Ceres CLONE 319136-F
  misc_feature (43)..(43): n is a, c, t, g, unknown, or other
acacgcacaccgcgacccagtccagagccagtacgtgcgaagncacgcacgctgctggtccgcgtacssagacgacggtcaggtcggccggtgcttttcagtttggaataatgacggcgacgacga

SEQ ID NO: 5391 - DNA, 424 bp, Zea mays
  misc_feature: Ceres CLONE 319159-F
  misc_feature: Encodes the peptide sequence at SEQ ID NO. 5392
  misc_feature (195)..(195): n is a, c, t, g, unknown, or other
aggcatcctggccacacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcangccggcgggcagtgcctgccgcagctgaaccgcctcctggsstgccgcgcgtacctggtgcccggcgcgccgtaccccagcgcggactgctgcagcgcgctgagcgcgttgtcgcacgagtgcgcctgcagcaccatgggcatcatcaacagcctgcccggccggtgccacctcgcccaagccaactgctccgcttgaagcagggacctggcacgcgtgctgcaatgga

SEQ ID NO: 5392 - protein, 103 aa, Zea mays
  misc_feature: Ceres CLONE 319159-F
  misc_feature (43)..(101): Pfam Name: Tryp_alpha_amyl Pfam Description: Protease inhibitor/seed storage/LTP family
  misc_feature (38)..(38): Xaa is any aa, unknown, or other
  misc_feature (52)..(52): Xaa is any aa, unknown, or other
MALEAATAPRALLAACLVLLVLGGGTGPSSVLRGAGAXAGGQCLPQLNRLLXCRAYLVPGAPYPSADCCSALSALSHECACSTMGIINSLPGRCHLAQANCSA

SEQ ID NO: 5393 - DNA, 520 bp, Zea mays
  misc_feature: Ceres CLONE 319193-F
  misc_feature: Encodes the peptide sequence at SEQ ID NO. 5394
  misc_feature (104)..(104): n is a, c, t, g, unknown, or other
  misc_feature (124)..(124): n is a, c, t, g, unknown, or other
aagtcaaacgtccccagcctcctaaaatttcccctttccccaactaacacgacacccccttcccttcctccgatccccccgcctcccccaaaatccgacgcgtntcgccgccatggccgccgcngcaagctcctcctcctggtcgccgcgtcctggcggcttccctcgtcgccgaccgcgcccgtgcggccacssgcagacgctcctcgtctccttctcctccgtcctcaggccgaacccggaccccaccaacccgacgccgctcaccaccacagtcgtcaccgtcctccgcgtccgccgcctcggcccgcaccagatccgccgccccgtgggctccccgccgtcgagtcggaggtcgccgcctcgtccgcccaggaycgcgccaaggacatcctcgtcgtcgtctccggcctcctcttcgggcttcgggctgcggcgccctcaccgccgcgttccatgtacctcgtatggtcgctcctcgcatccamctgcgcctccggataagacgacgacgtctaca

SEQ ID NO: 5394 - protein, 136 aa, Zea mays
  misc_feature: Ceres CLONE 319193-F
  misc_feature (28)..(28): Xaa is any aa, unknown, or other
  misc_feature (89)..(89): Xaa is any aa, unknown, or other
  misc_feature (126)..(126): Xaa is any aa, unknown, or other
MAAAASSSSWSPRPGGFPRRRPRPCGHXQTLLVSFSSVLRPNPDPTNPTPLTTTVVTVLRVRRLGPHQIRRPVGSPPSSRRSPPRPPRXAPRTSSSSSPASSSGFGLRRPHRRVPCTSYGRSSHPXAPPDKTTTST

SEQ ID NO: 5395 - DNA, 368 bp, Zea mays
  misc_feature: Ceres CLONE 319216-F
  misc_feature: Encodes the peptide sequence at SEQ ID NO. 5396
  misc_feature (55)..(55): n is a, c, t, g, unknown, or other
  misc_feature (316)..(316): n is a, c, t, g, unknown, or other
gcaattgacacctcccgacctccgttagcacgagctgcagggagggagttgggangagaaacatagctaccggggcgatgggcacgtgctcgattcgcacttcctggcgctcaccgcatcgttactgtggggtacagctgctgttcttcatcatcacagctctcctccggttcgataaggtcaccgatttcgcaggcagtacaaattttatcataatcgccatcctaacattagctttgaagggagcatggcatttccgtcagattgtgctgacagtgctttgtcaccatttggggtcttcgtctaggattatttntattgatgaggatttgcaatggggtgaagaccgaagkttgacaaaatgcgtg

SEQ ID NO: 5396 - protein, 97 aa, Zea mays
  misc_feature: Ceres CLONE 319216-F
  misc_feature (80)..(80): Xaa is any aa, unknown, or other
  misc_feature (92)..(92): Xaa is any aa, unknown, or other
MGTCSIRTSWRSPHRYCGVQLLFFIITALLRFDKVTDFAGSTNFIIIAILTLALKGAWHFRQIVLTVLCHHLGSSSRIIXIDEDLQWGEDRXLTKCV

SEQ ID NO: 5397 - DNA, 196 bp, Zea mays
  misc_feature: Ceres CLONE 319221-F
  misc_feature: Encodes the peptide sequence at SEQ ID NO. 5398
  misc_feature (82)..(82): n is a, c, t, g, unknown, or other
  misc_feature (90)..(90): n is a, c, t, g, unknown, or other
gaccgatctgtccgatctctctcccgagtccactccaagccttttcgccttttcctccgccttctcgcgatggcgccgcgcngcgctctnctcgtcctcgccgctctcctcctctccctctcccttggggccgcctccttccattccgacgagctcctcctcaacgatgacgaagagttcgagggcgtcgtcgccg

SEQ ID NO: 5398 - protein, 42 aa, Zea mays
  misc_feature: Ceres CLONE 319221-F
  misc_feature (5)..(5): Xaa is any aa, unknown, or other
MAPRXALLVLAALLLSLSLGAASFHSDELLLNDDEEFEGVVA

SEQ ID NO: 5399 - DNA, 371 bp, Zea mays
  misc_feature: Ceres CLONE 319228-F
  misc_feature: SWISSPROT Homolog: EC 2.1.1.41 Sterol 24-C-methyltransferase
  misc_feature (57)..(57): n is a, c, t, g, unknown, or other
attccactagattaccaccacctccacctcgtcktctcccaccaccgccgagckcgnccctagcccgatctagccggcggaggcaccagatcccgccgcccgckctccccgggaccgccccgccgaatccgccgctcctcgcactgcaacacgcccgkaccacggtgcatttgatccgtcccgtccgcctacacgatttccaagtcgggagcgctggatcttgcttctggcctcggaggggaagatcaacaaggtggaagtcaagtcggccgtcgatgagtatgagaaatatcatggatactatggagggaagkaggaagcaaggaagtccaactatactgatatggttaataaatactatgatcttgcca

SEQ ID NO: 5400 - DNA, 225 bp, Zea mays
  misc_feature: Ceres CLONE 319235-F
gactggtggaccagacccagcgaccgaacccgactcgatttcccaactccaaacctccttgcccctccgtgactcgccttcctctcctgactcctccgccttggcccgccgtctctcgccgccccggscccaacccctctcggactaggtgagggggccggctgcccagcgtcgtcgccggcgagatcttcccaccgccgctggcaatggctgccccgcacgacg

SEQ ID NO: 5401 - DNA, 246 bp, Zea mays
  misc_feature: Ceres CLONE 319260-F
  misc_feature: Encodes the peptide sequence at SEQ ID NO. 5402
  misc_feature (118)..(118): n is a, c, t, g, unknown, or other
aatgcttcagtttgagcccccttgccccttctttgcttgggcaggcaagccagccgcgtkaaagacaccgagcgcagacaggttggagttggacataacctctccctctcctcggcgnctcagccgggcatggcgtgcggcggcaagggcggcacggggtgttcctctctgccggcggacctgctgctcagcatattcgccctcctccctgccgacgctcaccgcgtccgtttccgcgccttctgc

SEQ ID NO: 5402 - protein, 39 aa, Zea mays
  misc_feature: Ceres CLONE 319260-F
MACGGKGGTGCSSLPADLLLSIFALLPADAHRVRFRAFC

SEQ ID NO: 5403 - DNA, 377 bp, Zea mays
  misc_feature: Ceres CLONE 319289-F
  misc_feature: Encodes the peptide sequence at SEQ ID NO. 5404
  misc_feature (105)..(105): n is a, c, t, g, unknown, or other
  misc_feature (108)..(108): n is a, c, t, g, unknown, or other
  misc_feature (254)..(254): n is a, c, t, g, unknown, or other
gatttcgtagtaagtcctcgaccatccctgcaaattaccgcgatggctcccaagatcctagtcatccttgtgttcctcgccgtggcctcaccggcggctctggcnttncgatgtgatagagatgctggccgacaagcccacgtactccacgttcctgaagctcctgcaggacaccaaggtcgcgggckaggcgaatcagctccggtcggcgacgctactggtcgtccccgacaaacttgccaagcctctgsgtncgctgcccgccgataaggtgcggccggcggtggagaaccacgtccttctcagttacttcgaccccatcaagctggacgagatgaagacacgcaccgccatcctccccacgctgctctccgtca

SEQ ID NO: 5404 - protein, 85 aa, Zea mays
  misc_feature: Ceres CLONE 319289-F
  misc_feature (23)..(23): Xaa is any aa, unknown, or other
  misc_feature (44)..(44): Xaa is any aa, unknown, or other
  misc_feature (45)..(45): Xaa is any aa, unknown, or other
MLADKPTYSTFLKLLQDTKVAGXANQLRSATLLVVPDKLAKPLXXLPADKVRPAVENHVLLSYFDPIKLDEMKTRTAILPTLLSV

SEQ ID NO: 5405 - DNA, 470 bp, Zea mays
  misc_feature: Ceres CLONE 319296-F
  misc_feature: Encodes the peptide sequence at SEQ ID NO. 5406
ataaaccgaccccaacgcatccattatattcagcttcttgatctcacacgaaggcatggcgacggagatccagggctactacgatgacggcaccgcsskggtgtcgttcgacgtgcacaacatcgacaccacgctgacgaacttgggcagcgtggtggagtggtggctgggtgagacctatcgcctccaccaccgcggccacatcgccggcctcgacgtggagtggcgccccgctcgcgtgccgggccccgtccccgtcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggccgggtacaggctgggggtggcgagcgcgtggacctgcgcgttctcgctgccgacacgct

SEQ ID NO: 5406 - protein, 138 aa, Zea mays
  misc_feature: Ceres CLONE 319296-F
  misc_feature (15)..(15): Xaa is any aa, unknown, or other
MATEIQGYYDDGTAXVSFDVHNIDTTLTNLGSVVEWWLGETYRLHHRGHIAGLDVEWRPARVPGPVPVAVLQICVDHRCLVFQILQADYIPDALSRFLADRRFTFVGVGISGDVAKLRAGYRLGVASAWTCAFSLPTR

SEQ ID NO: 5407 - DNA, 438 bp, Zea mays
  misc_feature: Ceres CLONE 319320-F
  misc_feature: Encodes the peptide sequence at SEQ ID NO. 5408
  misc_feature (183)..(183): n is a, c, t, g, unknown, or other
ctctttccaaaccggcaaatcctcagatccgccccctcctccgcctccgcctcctgtaccctcacgcggtgcttccacagccctcccacctccgaatccagatccgccgccaccaactcctgcttctcacctcctaggctgcttcgcgcgacaacctccgcgagrcagcaggakcggcggcgncggcatggggcgggacggcggtggcggtgtcgccggcggaatgtctgaatcggtgctgcggaaggtgctcctctcctacttgtacgtcgcggtgtggatcttcctctccttctccgtcatcgtctacaacaagtacatcctcgaccccaagatgtacaactggcccttccccatctcgctcaccatggtgcacatgggtttctgctcatccctcgccgtcgcgctcgtccgcgtgctccgcgtcgtcgacctccc

SEQ ID NO: 5408 - protein, 83 aa, Zea mays
  misc_feature: Ceres CLONE 319320-F
MGRDGGGGVAGGMSESVLRKVLLSYLYVAVWIFLSFSVIVYNKYILDPKMYNWPFPISLTMVHMGFCSSLAVALVRVLRVVDL

SEQ ID NO: 5409 - DNA, 517 bp, Zea mays
  misc_feature: Ceres CLONE 319328-F
  misc_feature: Encodes the peptide sequence at SEQ ID NO. 5410
  misc_feature (174)..(174): n is a, c, t, g, unknown, or other
  misc_feature (183)..(183): n is a, c, t, g, unknown, or other
  misc_feature (272)..(272): n is a, c, t, g, unknown, or other
  misc_feature (273)..(273): n is a, c, t, g, unknown, or other
  misc_feature (315)..(315): n is a, c, t, g, unknown, or other
ataccagcaattggcatccaagccatggcgtcgttcaagtgcatgtgcgtcttcttagtctcgcttatgctcgccctcatcgtcaataacgcccaggaagagcggacgctcccgccgttcccctgcatcccaggccagccacgacccccgtggctcccaccctgcccgccagynccasskagntgctacacgtcggtgtcggggctgatgccgtgcgcggacttcctcacccacatcgggctgccaccggcaccacccacgaccgcctgctnngacggtctcaggtcgctcgtcaccaacgcgcccatctgcakncgccacgtcgtcaatggcgacatcaacaagctcctaccggcgcccatgatacccgtgcgcatggtggcgctcccccgcttgtgcgtcgtccccttcccacgagccacgattcgccagtgcatcagaggccatgtgccaccgatgaaccctccatctccaccaccgactccgtcaaaatcatcaccgccawaatcaccaccgt

SEQ ID NO: 5410 - protein, 164 aa, Zea mays
  misc_feature: Ceres CLONE 319328-F
  misc_feature (50)..(50): Xaa is any aa, unknown, or other
  misc_feature (52)..(52): Xaa is any aa, unknown, or other
  misc_feature (53)..(53): Xaa is any aa, unknown, or other
  misc_feature (83)..(83): Xaa is any aa, unknown, or other
  misc_feature (97)..(97): Xaa is any aa, unknown, or other
  misc_feature (161)..(161): Xaa is any aa, unknown, or other
MASFKCMCVFLVSLMLALIVNNAQEERTLPPFPCIPGQPRPPWLPPCPPXPXXCYTSVSGLMPCADFLTHIGLPPAPPTTACXDGLRSLVTNAPICXRHVVNGDINKLLPAPMIPVRMVALPRLCVVPFPRATIRQCIRGHVPPMNPPSPPPTPSKSSPPXSPP

SEQ ID NO: 5411 - DNA, 511 bp, Zea mays
  misc_feature: Ceres CLONE 319329-F
  misc_feature: Translation starting site: 303
caaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtgttctctgctccaa

SEQ ID NO: 5412 - DNA, 275 bp, Zea mays
  misc_feature: Ceres CLONE 319330-F
  misc_feature: Encodes the peptide sequence at SEQ ID NO. 5413
attataaaaagtcgggcgcgccggcctcatctgacccgtccgtgtccgtgtccgtccccgcaagcccagctcctcgctgctcactccacagcgccgcgcaatggcggccaagcagcggcaccggcagctgccactcctgcccctcctcgccgcggccgtcgcgtggtcgctactgcgcgccgccgccgccgcgggcacgggcactggcacgctcggcctccggcacaagcccgcgaggcagcacaacagcacgcggcacgggggagggcggcgcg

SEQ ID NO: 5413 - protein, 58 aa, Zea mays
  misc_feature: Ceres CLONE 319330-F
MAAKQRHRQLPLLPLLAAAVAWSLLRAAAAAGTGTGTLGLRHKPARQHNSTRHGGGRR

SEQ ID NO: 5414 - DNA, 152 bp, Zea mays
  misc_feature: Ceres CLONE 319339-F
  misc_feature: Encodes the peptide sequence at SEQ ID NO. 5415
agactgagatggaggcggcggcassggcggccggcgtggagctgggctctcgaaagccccagatcgcgacgcaggssgagatggcggaggcccgggtgccgctcgcctaccgcgatcagtgcgcgcacctcctcatccgctcaacaagttcc

SEQ ID NO: 5415 - protein, 48 aa, Zea mays
  misc_feature: Ceres CLONE 319339-F
  misc_feature (6)..(6): Xaa is any aa, unknown, or other
  misc_feature (23)..(23): Xaa is any aa, unknown, or other
MEAAAXAAGVELGSRKPQIATQXEMAEARVPLAYRDQCAHLLIRSTSS

SEQ ID NO: 5416 - DNA, 265 bp, Zea mays
  misc_feature: Ceres CLONE 319364-F
  misc_feature: Encodes the peptide sequence at SEQ ID NO. 5417
  misc_feature (113)..(113): n is a, c, t, g, unknown, or other
  misc_feature (114)..(114): n is a, c, t, g, unknown, or other
  misc_feature (123)..(123): n is a, c, t, g, unknown, or other
  misc_feature (139)..(139): n is a, c, t, g, unknown, or other
  misc_feature (141)..(141): n is a, c, t, g, unknown, or other
  misc_feature (209)..(209): n is a, c, t, g, unknown, or other
agcatcgccactactcgctccaccatcccctgaccccgtgcacccgcaccattagctcggcctagcttgcttcgatcatcggctcgatcggttctctgactctgatctgatcnngagatcganctcggccggccggssncntatggacggttcgaagagcaatgctcaccaacaaggcgcggcggtgactagcaccaccagctcggcgngcaagcgcaagggaaaggcggcttcatcttgcggcggcggaaagaagccacctatc

SEQ ID NO: 5417 - protein, 41 aa, Zea mays
  misc_feature: Ceres CLONE 319364-F
  misc_feature (23)..(23): Xaa is any aa, unknown, or other
MDGSKSNAHQQGAAVTSTTSSAXKRKGKAASSCGGGKKPPI

SEQ ID NO: 5418 - DNA, 115 bp, Zea mays
  misc_feature: Ceres CLONE 319444-F
acacgcacaccgcgacccagtccagagccagtacgtgcgamggcacgcacgctgctggtccgcgtacssagtacgacggtcaggtcggccggtgcttttcagtttggaataatga

SEQ ID NO: 5419 - DNA, 168 bp, Zea mays
  misc_feature: Ceres CLONE 319493-F
  misc_feature (31)..(31): n is a, c, t, g, unknown, or other
  misc_feature (32)..(32): n is a, c, t, g, unknown, or other
acaggtcgcaacaaccccaacgagcaaaccnnccatttgccaccaaccccgacgagcggcgatgaccggcacgkgtctaagctggcggcgcccgtccggcggcaccgcytccgggccggcgtccctccgcaccgccgccctcgccttcgccccctccgcgcgccgggt

SEQ ID NO: 5420 - DNA, 328 bp, Zea mays
  misc_feature: Ceres CLONE 319519-F
  misc_feature: Encodes the peptide sequence at SEQ ID NO. 5421
  misc_feature (114)..(114): n is a, c, t, g, unknown, or other
  misc_feature (179)..(179): n is a, c, t, g, unknown, or other
aaggattttgtttcgggtgaggtggggggcggcatggcgcaccgccgctcaggctcagctcctcctctccaaccacccctcgccgttgctgtcgccgccgcaacgtcgtcgcancctcagtggaccgccgcctcgctcacacacctgcgccatccggcaccaccacggccacgacaagncgcctcctcctcctccactcgccttcgccacgccctccgcccgcccgccgccaccgccgtgcatcgcgcccggcgaccamhggggaaactgggccttcctcctctccgccgccgcgttcggcacatgggcggaggagaacacgtcgtgg

SEQ ID NO: 5421 - protein, 109 aa, Zea mays
  misc_feature: Ceres CLONE 319519-F
  misc_feature (38)..(38): Xaa is any aa, unknown, or other
  misc_feature (60)..(60): Xaa is any aa, unknown, or other
  misc_feature (86)..(86): Xaa is any aa, unknown, or other
  misc_feature (87)..(87): Xaa is any aa, unknown, or other
RILFRVRWGAAWRTAAQAQLLLSNHPSPLLSPPQRRRXLSGPPPRSHTCAIRHHHGHDKXPPPPPLAFATPSARPPPPPCIAPGDXXGNWAFLLSAAAFGTWAEENTSW

SEQ ID NO: 5422 - DNA, 463 bp, Zea mays
  misc_feature: Ceres CLONE 319546-F
  misc_feature (58)..(58): n is a, c, t, g, unknown, or other
  misc_feature (135)..(135): n is a, c, t, g, unknown, or other
  misc_feature (196)..(196): n is a, c, t, g, unknown, or other
aattttccactttcgagcgcagaaacgagakggcaggagcagccgcagtcccggcgantcccgcgccggtcgccctcatacttcctcgtcactgccttcgtttctctttccaacaatcaagatgagccgtggcgntagcgcgggtggtggtcaaagttctctgggttacctctttggaagcgtktgagccccccanaccagcagtggcaccagctgtaagtgctccacctgctgctgcagtctccacctsttgagaaaccacctgctgcaaassctgatggcaccagtcagattgctgctggggttacagccaaaccaataactaccacagggccgacggtcagaacaccggcaacttccttacggaccgcccttcgaccaaggtccacgctgctcctggcggtggctcttccctgggatacctgtttggtggcaactgatgccgctcaccaaggctatcacc

SEQ ID NO: 5423 - DNA, 340 bp, Zea mays
  misc_feature: Ceres CLONE 319549-F
  misc_feature: Encodes the peptide sequence at SEQ ID NO. 5424
  misc_feature (68)..(68): n is a, c, t, g, unknown, or other
  misc_feature (77)..(77): n is a, c, t, g, unknown, or other
  misc_feature (78)..(78): n is a, c, t, g, unknown, or other
ctcacgagcacaacagggcggccagacagggctcccacaggccatcaccacaacacacaaatacakcncrgagcaanncacacacaggctcctctcccccgttgcgcaacbskttcccccacttcacccgcctcggcgccatggctaagctcgcgctggcgctcctcctcctgctggccgtggcggcgtccgcgtcggccagcatcgggagccacctggatctcgacctgggcttcctctcctctggggaacgccggaggattgccgcggcagtttggccgattgcctcgccgagagtcggatgaggagggccttgacctggctggatcccaccgccgcg

SEQ ID NO: 5424 - protein, 54 aa, Zea mays
  misc_feature: Ceres CLONE 319549-F
MAKLALALLLLLAVAASASASIGSHLDLDLGFLSSGERRRIAAAVWPIASPRVG

SEQ ID NO: 5425 - DNA, 416 bp, Zea mays
  misc_feature: Ceres CLONE 319600-F
  misc_feature: Encodes the peptide sequence at SEQ ID NO. 5426
  misc_feature (152)..(152): n is a, c, t, g, unknown, or other
  misc_feature (216)..(216): n is a, c, t, g, unknown, or other
ctccctcccctccagcgctccagctcccctccatcctcggccaaaaattctgcggcgagctccgatccggtccgactactaacccacgccgcagaagccgcgcgacctgatcgssgggtgttcgaggagaggggaagcgcggcgccgcggtntgcctgccaccgtaccgccgcagagaaggaagaggagcccgtatccctccgccccgctgcccgncggaccgatggactccgagcactggatctcgcgcctggccgccgcgaagctttctacgcggcgcactcggccacagcgatcgggccgggattggacgagctggagatgggacgaggaggtcaggcccgatttcccctgcccctactgctacgaggaccacgacgtcggatccctctgcgcgcaccttggaggaggagcac

SEQ ID NO: 5426 - protein, 64 aa, Zea mays
  misc_feature: Ceres CLONE 319600-F
MDSEHWISRLAAAKLSTRRTRPQRSGRDWTSWRWDEEVRPDFPCPYCYEDHDVGSLCAHLGGGA

SEQ ID NO: 5427 - DNA, 458 bp, Zea mays
  misc_feature: Ceres CLONE 319606-F
  misc_feature: Encodes the peptide sequence at SEQ ID NO. 5428
  misc_feature (333)..(333): n is a, c, t, g, unknown, or other
gagctgcttgtccaagaatcgctcccactcccggctgtcgggagagcgcmssccagctagccgcctccgcttcttggaggtcgatggccgcgaaggggttgagggaggtggggaggakkakggcggcggaggtcgggcggcgctgcttgtctggcgggagcgctgggccgccggcgccggktaagcggaakkagggagggaaggcggtgaacctgttcacggccgtcaaccaggcgctccacatcgccctcgacaccgacccccgcgcctacgtcttcggagaggacgtcggggttcggcggcgtcttccgctgcacgacaggcctcgccgantcggttycggcaagakcagagtgttcaacacgccgttgtgtgagcagggtattgctggatttgccatcgcctagcagcgatgggcaatcgagctatcgcagaaatccagtttgcgggactacata

SEQ ID NO: 5428 - protein, 107 aa, Zea mays
  misc_feature: Ceres CLONE 319606-F
  misc_feature: SWISSPROT Homolog: EC 1.2.4.4 3-methyl-2-oxobutanoate dehydrogenase (2-methylpropanoyl-transferring)
  misc_feature (12)..(12): Xaa is any aa, unknown, or other
  misc_feature (13)..(13): Xaa is any aa, unknown, or other
  misc_feature (33)..(33): Xaa is any aa, unknown, or other
  misc_feature (36)..(36): Xaa is any aa, unknown, or other
  misc_feature (37)..(37): Xaa is any aa, unknown, or other
  misc_feature (84)..(84): Xaa is any aa, unknown, or other
  misc_feature (86)..(86): Xaa is any aa, unknown, or other
  misc_feature (89)..(89): Xaa is any aa, unknown, or other
MAAKGLREVGRXXAAEVGRRCLSGGSAGPPAPXKRXXGGKAVNLFTAVNQALHIALDTDPRAYVFGEDVGVRRRLPLHDRPRRXGXGKXRVFNTPLCEQGIAGFAIA

SEQ ID NO: 5429 - DNA, 339 bp, Zea mays
  misc_feature: Ceres CLONE 319635-F
  misc_feature: Encodes the peptide sequence at SEQ ID NO. 5430
  misc_feature (97)..(97): n is a, c, t, g, unknown, or other
  misc_feature (193)..(193): n is a, c, t, g, unknown, or other
  misc_feature (198)..(198): n is a, c, t, g, unknown, or other
  misc_feature (199)..(199): n is a, c, t, g, unknown, or other
caagatgtcgtcggtgttcagcggcgatgagacggcccccttcttcggtttcctcggcgccgsscsgccctcgtcttctcatgcatgggcgcagtancgggaccgcgaagagcgtcgtcggcgtggcgtcgatgggtgtgatgcggccggagctcgtcatgaagtccatcgtgcccgtggtcatggctggtgngctcnnyatctacgggctcatcatcgccgtcatcatcagcactgggatcaaccccaaggccaagccctactacctttttgatggctacgctcacctttcgtccgggcttgcctgtggccttgctgggcttgcagctggcatggcca

SEQ ID NO: 5430 - protein, 86 aa, Zea mays
  misc_feature: Ceres CLONE 319635-F
  misc_feature: SWISSPROT Homolog: EC 3.6.3.14 H(+)-transporting two-sector ATPase
  misc_feature (6)..(6): Xaa is any aa, unknown, or other
  misc_feature (38)..(38): Xaa is any aa, unknown, or other
  misc_feature (40)..(40): Xaa is any aa, unknown, or other
MHGRSXGTAKSVVGVASMGVMRPELVMKSIVPVVMAGXLXIYGLIIAVIISTGINPKAKPYYLFDGYAHLSSGLACGLAGLAAGMA

SEQ ID NO: 5431 - DNA, 99 bp, Zea mays
  misc_feature: Ceres CLONE 319645-F
atcttgctctgaacgcattcctcccatctcccaagacctcctcagacccgagaagcgcakgctggtccatggacgccaccggactggagctggagggaa

SEQ ID NO: 5432 - DNA, 494 bp, Zea mays
  misc_feature: Ceres CLONE 319672-F
  misc_feature: Encodes the peptide sequence at SEQ ID NO. 5433
aaggcagcggatctggttccgtctggctcggccgtcaagccggctgccggtagagcggaggagacggcgtctcgssctcgcttcgtttccgccttccctctcccgcaaagtcgccgccgtctcgcattcgtggttccgcgtgggggtccggggaaacgctacgagagaggcggaascgatggcgaagtcgtgcaaggggttggccatggagctcgtcaagtgtctcagcgagacccactgcgtcaaggtgcagaaaaggccgtacaaggagtgcgctggggagaaggtgcccaacattaccagcgagtgcgctggcctgcgggagacctacttcaactgcaagakgggccaggttgacatgcgggcccgaatacgcgggaacaagggatactagtgatgtgcctgcaatatccacaatcagttttggtttctagccatgctttctgtgacattgaggtgtaatgataacatggtttagtgtgcccgtgttctgg

SEQ ID NO: 5433 - protein, 71 aa, Zea mays
  misc_feature: Ceres CLONE 319672-F
  misc_feature (56)..(56): Xaa is any aa, unknown, or other
MAKSCKGLAMELVKCLSETHCVKVQKRPYKECAGEKVPNITSECAGLRETYFNCKXGQVDMRARIRGNKGY

SEQ ID NO: 5434 - DNA, 115 bp, Zea mays
  misc_feature: Ceres CLONE 319678-F
acacgcacaccgcgacccagtccagagccagtacgtgcgamgtcacgcacgctgctggtccgcgtacssagacgacggtcaggtcggccggtgcttttcagtttggaataatgac

SEQ ID NO: 5435 - DNA, 122 bp, Zea mays
  misc_feature: Ceres CLONE 319681-F
gccaaggaaacagtcacgtctcccagatctaactccccccgactcataatcccagagagcctccatggcgacgcaccgccactgcctcccactcctcctcgtggccgccgcctcgccctcgc

SEQ ID NO: 5436 - DNA, 158 bp, Zea mays
  misc_feature: Ceres CLONE 319695-F
  misc_feature (26)..(26): n is a, c, t, g, unknown, or other
acgcaacctcccactgcattctcganttacgattcccaatccagcaaaccctaccagccttttgcaaactcagagagggacccgatggcacccaaggcggagaagaagccggcgtgctrtagaagcccgcagakgaggagcccgcgtgccccggcgga

SEQ ID NO: 5437 - DNA, 443 bp, Zea mays
  misc_feature: Ceres CLONE 319723-F
  misc_feature: Encodes the peptide sequence at SEQ ID NO. 5438
  misc_feature (162)..(162): n is a, c, t, g, unknown, or other
atcacacactcgactctcctctctcgcatccgcrcctctcgagctctactccactccctcgatctcgaatcgtagcagcagtcaggcggccatggacgcgagcgcmcggagccggcgggaaggcgaagaagggcgcggccgggcgcaaggccggcgggcganggaagaagtcggtgacgaggtccgtcaaggccgggctgcagttccccgtcggccgcatcgggcggtatctgaagaagggccggtacgcgcacgtcggcacgggcgcccccgtctacctggccgccgtcctcgagtacctggccgccgaggtgctggagctggccggcaacgctgccaakggacaacaagaagacccgcatcatcccgcgccacgtgctcctggccatccgcaacgacgaggagctcggcaagctgttggtccggcgtcaccatcgcccacg

SEQ ID NO: 5438 - protein, 147 aa, Zea mays
  misc_feature: Ceres CLONE 319723-F
  misc_feature (60)..(127): Pfam Name: Histone Pfam Description: Core histone H2A/H2B/H3/H4
  misc_feature (11)..(11): Xaa is any aa, unknown, or other
  misc_feature (35)..(35): Xaa is any aa, unknown, or other
  misc_feature (54)..(54): Xaa is any aa, unknown, or other
  misc_feature (113)..(113): Xaa is any aa, unknown, or other
HTLDSPLSHPXLSSSTPLPRSRIVAAVRRPWTRAXGAGGKAKKGAAGRKAGGRXKKSVTRSVKAGLQFPVGRIGRYLKKGRYAHVGTGAPVYLAAVLEYLAAEVLELAGNAAXGQQEDPHHPAPRAPGHPQRRGARQAVGPASPSPT

SEQ ID NO: 5439 - DNA, 334 bp, Zea mays
  misc_feature: Ceres CLONE 319755-F
  misc_feature (33)..(33): n is a, c, t, g, unknown, or other
  misc_feature (103)..(103): n is a, c, t, g, unknown, or other
  misc_feature (151)..(151): n is a, c, t, g, unknown, or other
atctccctgtttaatcaatccttcaagcgcaangcctcctcctcgtcgtccggtcgtgagaagggatggcgggccgtggcaaggctatcggcgctggcgccgnaagaakgcaacgtcgaggagctccaaggccggactccagtttccccgntcggcaggawttgctaggttcctcaaggcgggcaagtacgctgagcgcgtcggcsscggcgcccccgtgtacctcgccgccgtcctcgagtacctcgcggctgaggttctcgaacttgcctggtaactgccgcgaggtacaacaagaagacccgcattgtgccgcgccacatccagcttgctg

SEQ ID NO: 5440 - DNA, 460 bp, Zea mays
  misc_feature: Ceres CLONE 319763-F
  misc_feature: Translation starting site: 90
ctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcrctcgtgatgaagaagtcaagtgctcatgatggacttgtgaagggtctccgtgagctgccaaggccatcgagaagcacgccgctcagctttgcgtgcttgctgaggactgtgaccagccagattatgtcaagctggtgaaggcactctgcgcggassacaatgttcacctggtcactgttcctgccgctaagacccttggcgagtgggctgggctttgcaagattgactctgaggggcaaggcaaggaaggttgtaggctgctcctgtgtcgtcgtcaaggactacggt

SEQ ID NO: 5441 - DNA, 400 bp, Zea mays
  misc_feature: Ceres CLONE 319832-F
  misc_feature: Encodes the peptide sequence at SEQ ID NO. 5442
acatctcgatctatctcacacacacatcgttgagaatgagatcaatccaaccccatatgtgtgtagtgtatatatataaagtcgtgccacccatctaccctgcatcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaa

SEQ ID NO: 5442 - protein, 68 aa, Zea mays
  misc_feature: Ceres CLONE 319832-F
MAAPAMLQVVILAAVLLLPFLSVPGAEAQTKKFCLTQFAIASQACAILPPTSPEHHHHHHDDEDNDED

SEQ ID NO: 5443 - DNA, 425 bp, Zea mays
  misc_feature: Ceres CLONE 319860-F
  misc_feature: Translation starting site: 123
atcacacaaaaccgatcaatctcgcagagggagaaccaaccaatccatcatctgtctcgactctctcgcgtctccgccggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtcgcggcagcgggtccaggccgaccgcgccggcggcgcaaccctacctggaacgccacgctccgcttcgccgtcccggcaaccggcgcctcctcctccctccacatcctcctccgcgccgagcgcgccctcggccaccgcgacgtcggcgaggtccacatcccgctctccgagctcctctccggcg

SEQ ID NO: 5444 - DNA, 424 bp, Zea mays
  misc_feature: Ceres CLONE 319884-F
  misc_feature: Encodes the peptide sequence at SEQ ID NO. 5445
acaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgc

SEQ ID NO: 5445 - protein, 114 aa, Zea mays
  misc_feature: Ceres CLONE 319884-F
  misc_feature (55)..(114): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFM

SEQ ID NO: 5446 - DNA, 186 bp, Zea mays
  misc_feature: Ceres CLONE 319916-F
ataccacactagagccgccgccgccgccgcagctgccgtttcgcgcaccgtaccctagccctcgtcagcggcggctwcgagctcctccagccakgacgttcaarcggaggaatggcggacgcaacragcacgggcgcggtacacrtcaagatacatccgactgctccaactgtgccaagtgctgcc

SEQ ID NO: 5447 - DNA, 486 bp, Zea mays
  misc_feature: Ceres CLONE 319998-F
  misc_feature: Encodes the peptide sequence at SEQ ID NO. 5448
agcagcctcccgaatccccaaagcctccgacccccttcctctctccctccgccgccgctgcgcacgcagggaacaagcgacatgggcgtctacaccttcgtgtgccgcaacvacagcggcgagtggaccgccaagcagcactccggcgagatcgaggcttccgccgctaccccatacgagctgcagcgccgcctcgtcgccgctgcctccgcggccgactctgcctacggcgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtggtggtttggtcctg

SEQ ID NO: 5448 - protein, 119 aa, Zea mays
  misc_feature: Ceres CLONE 319998-F
  misc_feature (25)..(118): Pfam Name: Ribosomal_60s Pfam Description: 60s Acidic ribosomal protein
  misc_feature (11)..(11): Xaa is any aa, unknown, or other
MGVYTFVCRNXSGEWTAKQHSGEIEASAATPYELQRRLVAAASAADSAYGVQSSFSMVTPSSAVFQVIVGAVGGGAMMVSGGGGGAAASGGAAAEAPKEEKKEEEKEESDDDMGFSLFD

SEQ ID NO: 5449 - DNA, 511 bp, Zea mays
  misc_feature: Ceres CLONE 320045-F
  misc_feature: Encodes the peptide sequence at SEQ ID NO. 5450
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtgttctctgctcc

SEQ ID NO: 5450 - protein, 150 aa, Zea mays
  misc_feature: Ceres CLONE 320045-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRSVLCS

SEQ ID NO: 5451 - DNA, 487 bp, Zea mays
  misc_feature: Ceres CLONE 320059-F
ttcctatagctatcgttcagctcctggtggtgctacgggggtgactgcgggggcgactgcggctggtggctgttgtcctcatcgaccatctcggcgacgtcctactcgagcgagatctcgctgcagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaaaagtggaagctgctaggaagcaggaagagttgcaatctgtttgatgccttttctagaacatatctgtggttagaactttgtcagaactacgtgcaatctgtttcaatgcttcaaacc

SEQ ID NO: 5452 - DNA, 517 bp, Zea mays
  misc_feature: Ceres CLONE 320096-F
  misc_feature: Encodes the peptide sequence at SEQ ID NO. 5453
actcacgaattccccattcccttcccccatcgcatcgagagccaggccagccagccacctctgctaggtctccatggccgccgcgctcaggtccccggcctcggccaaggtctcgagccccgccgccgcctccaaggtgcgccaggcgtccagagtcgcggtgggcgggttccggcagcatccgcggagccgtgtcggccccgtggccgtgcgggcgtcgctgttctcgcccaagcccgcggcggccaaggacgcgcggccgaccaaggtgcaggagctgtacgtgtacgagatgaacgagcgggaccgcgagagccccgcgtacctgcgcctcagcgccaagcagacggagaacgcgctgggcgacctggtccccttcacaaacaaggtttacaacggcagcctggacaagcggctgggcatcaccgccggcatctgcgtgctcatccagcacgtccccgaccgcaacggcgaccggtacgaggccatctacagcttctacttcggcgactacggc

SEQ ID NO: 5453 - protein, 148 aa, Zea mays
  misc_feature: Ceres CLONE 320096-F
  misc_feature (59)..(148): Pfam Name: Allene_ox_cyc Pfam Description: Allene oxide cyclase
  misc_feature: SWISSPROT Homolog: EC 5.3.99.6 Allene-oxide cyclase
MAAALRSPASAKVSSPAAASKVRQASRVAVGGFRQHPRSRVGPVAVRASLFSPKPAAAKDARPTKVQELYVYEMNERDRESPAYLRLSAKQTENALGDLVPFTNKVYNGSLDKRLGITAGICVLIQHVPDRNGDRYEAIYSFYFGDYG

SEQ ID NO: 5454 - DNA, 537 bp, Zea mays
  misc_feature: Ceres CLONE 320139-F
accgacggcatttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccacactacccagactctcatcatgggtgttgcaccgtccaagggcgggttcgaggcggccgccggagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttgttttgttcgagtcagtcagacagtcagccgcgtgccatgggccatggcatagcatgccattgcctcgctctatctgctccatcgccttttttcctagtggtggtactgatgggggaacgaataattgtacc

SEQ ID NO: 5455 - DNA, 452 bp, Zea mays
  misc_feature: Ceres CLONE 320194-F
  misc_feature: Encodes the peptide sequence at SEQ ID NO. 5456
aaactcccagccgtctcctccgcacgcgaaaaccctagcagttcggtagtccctctcctctcgaggtggcggcgctccccccgtcttcttcttcttcttcttcctgtactatatagcctcccctcgcaaatcgtcactgacgttcattccgcttgcttgattgttccaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagc

SEQ ID NO: 5456 - protein, 83 aa, Zea mays
  misc_feature: Ceres CLONE 320194-F
  misc_feature (17)..(83): Pfam Name: Ribosomal_60s Pfam Description: 60s Acidic ribosomal protein
MKFVAAYLLAVLAGNASPSADDLTAILESVGCEVDNEKMELLLSQLSGKDITELIAAGREKFASVPCGGGGVAVAAAAPAAGG

SEQ ID NO: 5457 - DNA, 494 bp, Zea mays
  misc_feature: Ceres CLONE 320243-F
  misc_feature: Translation starting site: 60
aaaccaattcgcttctctgtcaacttcacttcctcgtcgacgcctccggcccaccaaccatgccggcggctgcggcggcgcagaggctcctcgcggcgagcacgaaaatcatcggcgttgggcgcaactacatagcccactccaaggagctcggcaatccggtccccaaggagcccgtcctgttcctgaagccgacctcgtcgtttctccacgctggtgtggccacgccgccgttgagatcccggagccgctcgagtcgctacaccacgaggtcgagctcgccgtcgtcatttcccggcgcctcctgtcgccgccgtccgccaccgcggccgctcggcgggccgcgccagttgccgctgaggctgtttccagcgggggtggcgtcctcctacctaggggtggtgtcgccggggtagcggccaacggatggagtggtagcggcccagggctccgcttggctcgaaggctctgcacctacgacgagagagatgaca

SEQ ID NO: 5458 - DNA, 505 bp, Zea mays
  misc_feature: Ceres CLONE 320313-F
  misc_feature: Encodes the peptide sequence at SEQ ID NO. 5459
gcgcccgtggcccgtaaaagacaccaacccacttctcgaatcgaatccaggtccagggacgccgctacccgccgcccttcacccccgccatgccgacgctcggcatcgcgccgctgctggacgcctacttccggcgccgcttcgccgcggcgggcctcgtggaggcctcggtcccgctggacggcggcgccaccacggtccactgctggcgcttcccgccggggtccgccgacggcgaggacgacgcccgtcccgtcctggtgctcctgcacggcttcgggcccccggcaacgtggcagtggaggcgccaggtgggcccgctgtcgcgccggttccgcctcgtcgtcccggacctgctcttcttcggcggctcgtccacgtcggcggcggcgcccgggcgcgggcgggtgtccgaggcgcggcaggcggaggcggtggcgaagctcgtggcggcctggtggcgccgcyggcgcgcgtgtcggtggcmggcaccagctacggcggg

SEQ ID NO: 5459 - protein, 138 aa, Zea mays
  misc_feature: Ceres CLONE 320313-F
  misc_feature: SWISSPROT Homolog: EC 6.6.1.1 Magnesium chelatase
  misc_feature (127)..(127): Xaa is any aa, unknown, or other
  misc_feature (133)..(133): Xaa is any aa, unknown, or other
MPTLGIAPLLDAYFRRRFAAAGLVEASVPLDGGATTVHCWRFPPGSADGEDDARPVLVLLHGFGPPATWQWRRQVGPLSRRFRLVVPDLLFFGGSSTSAAAPGRGRVSEARQAEAVAKLVAAWWRRXRACRWXAPATA

SEQ ID NO: 5460 - DNA, 424 bp, Zea mays
  misc_feature: Ceres CLONE 320338-F
aacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgccgaaaccaactcctcctcctccatcgccaccaccgccgtcgcccaccagcacgccgtgccctccgccaccgtccagctccggcggcaagtgcccaagaacgcgctgaaactgggcgtgtgcgccaacgtgctgggcctcgtcaaggtgtccatcggcaaggtgccaccgactcgtgctgcccgctgctggacggcctcgcaacctggaggccgccgtctgcctctgcaccgcgctc

SEQ ID NO: 5461 - DNA, 462 bp, Zea mays
  misc_feature: Ceres CLONE 320342-F
  misc_feature: Encodes the peptide sequence at SEQ ID NO. 5462
aggtcgtcgcagcgccgctacgagggggaggggatcgaactcgaaggagaatttccattcgaccccatccacttctcacctcaatctcgcgagaagcgaagccggaggaggagggtgcgaggagatcgcgagcagccggagccggagccggagccggaggcctagtagatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccaggtgttgtccgaattgcctgtctggacagccagttatgttatgctgtttgaatgaaaaattagcttctttttcttcatctaaatgcgtgcagcctatgctccatctgtaatgtaat

SEQ ID NO: 5462 - protein, 56 aa, Zea mays
  misc_feature: Ceres CLONE 320342-F
MKTFDPWPVFFRREWKRNWPFLTGFAITGFIITKMTANFTEEDLKNSKFVQEHKKR

SEQ ID NO: 5463 - DNA, 800 bp, Zea mays
  misc_feature: Ceres CLONE 320423-R
  misc_feature (367)..(367): n is a, c, t, g, unknown, or other
  misc_feature (412)..(412): n is a, c, t, g, unknown, or other
  misc_feature (413)..(413): n is a, c, t, g, unknown, or other
  misc_feature (418)..(418): n is a, c, t, g, unknown, or other
  misc_feature (419)..(419): n is a, c, t, g, unknown, or other
  misc_feature (424)..(424): n is a, c, t, g, unknown, or other
  misc_feature (800)..(800): n is a, c, t, g, unknown, or other
ccgggccccccctcgaggtcgacggtatcgataagcttttttttttttttttttctgacagaacattctggatctttatttcatcatcatctaaaagactaccttattatactactacgtagctaacaaagtgacgtgggacgcgaacagagagacagatggagatgcattagacggcccgaggaagacatggcgtagggaaagaccaaacgagcacgcactggcagggagcggcaagagctagccagtccccatggggggaggccatcagcacaccacatcacaggccgccgccaccaccaccaaggccggaacaacaagcagaccgtggactcccgtctggatgttggagtcggagaagatgaanaaaaaaaaacaactgattggtctgaaaaaatgagggagcggacannccccnnagganagcccagccatgccctgataatgtgcagcttccggggccacaaccctgccctaacactgtccacaccccagctgagcataacaccctgtcgccgaaaggggctgtaactcaggaaccttgcctacgggttgagatgtcggatgccccctcgacaaacgaaactcaaaaaggcggcccagcaaaactattctccgggggaaaaggccaattatccctactcggccggaaccattttctacccatcaaatgtgagccgatgaatcgtgaacccacccacgggacgtcagtttctgaggcagcagtccgaatggtgccccctccagagagaagggcccgtcaaacccgggcagctgccggggcgggggaaaaccgtggn

SEQ ID NO: 5464 - DNA, 425 bp, Zea mays
  misc_feature: Ceres CLONE 320439-F
  misc_feature: Encodes the peptide sequence at SEQ ID NO. 5465
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcasgaggggctgccgacgatgaatcagcgtctggacatctcgaacgcggcggtgacgcakatggcgac

SEQ ID NO: 5465 - protein, 113 aa, Zea mays
  misc_feature: Ceres CLONE 320439-F
  misc_feature (10)..(113): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (92)..(92): Xaa is any aa, unknown, or other
  misc_feature (111)..(111): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAXEGLPTMNQRLDISNAAVTXMA

SEQ ID NO: 5466 - DNA, 405 bp, Zea mays
  misc_feature: Ceres CLONE 320545-F
  misc_feature: Encodes the peptide sequence at SEQ ID NO. 5467
aaaaaactaacacgacaccccccttcccttcctccgatccccccgcctcccccaaaatccgacgcgtaatcgccgccatggccgccgccggcaatctcctcctcctggtcgccgccgtcctggcggcttccctcgtcgccgacgcgcgcccgtgcggccacgcgcagacgctcctcgtctccttctcctccgtcctcaggccgaacccggaccccaccaacccgacgccgctcaccaccacagtcgtcaccgtcctccgcgtccgccgcctcggcccgcaccagatccgccgccccgtggcgctccccgccgtcgagtcggaggtcgccgcctcgtccgcccaggaccgcgccaaggacatcctggtcgtcgtctccggcctcctcttcggcttcggctgcggcg

SEQ ID NO: 5467 - protein, 109 aa, Zea mays
  misc_feature: Ceres CLONE 320545-F
MAAAGNLLLLVAAVLAASLVADARPCGHAQTLLVSFSSVLRPNPDPTNPTPLTTTVVTVLRVRRLGPHQIRRPVALPAVESEVAASSAQDRAKDILVVVSGLLFGFGCG

SEQ ID NO: 5468 - DNA, 442 bp, Zea mays
  misc_feature: Ceres CLONE 320556-F
  misc_feature: Encodes the peptide sequence at SEQ ID NO. 5469
ccccacgcaattcccacatctcagcttcgccgccgccctcgttcgcccagcccagccgcctcctcccgtcctccgcctgtccatggaccgccgccatcgagccgtaccttactccgcgcgccagcagcagcagcggttcctccggcccggcgcgctcgcgcggctccgggactcgaggatcgtcgcccgctccgtccggtcgtcggcgtgcctcttgctcccgcggtccrcmcctccgtcwccgtcccccagcgcccccggtcgtcgccgcggacgagctggccgccgcaccgcgcttcctggggaccacgagcggctctggacggtacccgctccgcaggagggtcgtcgccgccaggggcgtggcgttctcgccgtcgtcgccgtagcctggcacggacggaggcgccgtagctgagaacttgtgactagatttgtgttt

SEQ ID NO: 5469 - protein, 111 aa, Zea mays
  misc_feature: Ceres CLONE 320556-F
  misc_feature (50)..(50): Xaa is any aa, unknown, or other
MDRRHRAVPYSARQQQQRFLRPGALARLRDSRIVARSVRSSACLLLPRSXPPSPSPSAPGRRRGRAGRRTALPGDHERLWTVPAPQEGRRRQGRGVLAVVAVAWHGRRRRS

SEQ ID NO: 5470 - DNA, 435 bp, Zea mays
  misc_feature: Ceres CLONE 320595-F
  misc_feature: Encodes the peptide sequence at SEQ ID NO. 5471
atgaaagagcagcagccccgcccccgcccaagcatcatgttcgtcctgtcgtcgctcgccaagaataacccagaggccgtgctggcgctcatcgcggtggtcaccgtcgtcgccctgcgccacttgatctcctcatggcggcaacaggccccgctgcccccgtcaccgacgagcctcccagtgatcgggcacctgcacctgctccgaccgccggtgcaccgcaccttccaggagctggcgtcccggatcggtccgctgatgcacatccgcctcggctccacgcactgcgtggtggccagcagcccggaggtggccagcgagctcatccgcggccacgagggcagcatctcggagcggccgctcacggcggtggcccgccagttcgcgtacgactcggccggcttcgccttcgcgccctacaacacgcactggcgc

SEQ ID NO: 5471 - protein, 133 aa, Zea mays
  misc_feature: Ceres CLONE 320595-F
  misc_feature: SWISSPROT Homolog: EC 1.14.13.68 4-hydroxyphenylacetaldehyde oxime monooxygenase
MFVLSSLAKNNPEAVLALIAVVTVVALRHLISSWRQQAPLPPSPTSLPVIGHLHLLRPPVHRTFQELASRIGPLMHIRLGSTHCVVASSPEVASELIRGHEGSISERPLTAVARQFAYDSAGFAFAPYNTHWR

SEQ ID NO: 5472 - DNA, 528 bp, Zea mays
  misc_feature: Ceres CLONE 320645-F
  misc_feature: Encodes the peptide sequence at SEQ ID NO. 5473
actaattggacccccgcctccctcggtcccttccgaagcaaaggatcagatgcccaaaattcccggctcgaagactgcaggcatcggacgcggcccccgccgagaagctactcgaatcccctccaaaattcggaggcgagagccactgatctatcgcaaaatccatcaaattacacaattcaaatcagccaaccccacctacagccaccaattcgtgcgcatcaagtctagccccctacccccttcgcaatcagtgaacccccaatccacacgacacagcctgcgaatcgctggatcaaaatttggtctcgaactctcgatccaccattccccgaggaaggagatctcagtcaaccgaataagtctcgggaagctctgtgttgggaatatggggaaaccgctgatctacgaggtactggagaagccggcgagcagcagcgtcatcggcatctgctctctgatctggtggctcatccagaagcggggcatcgggtacgcggacgtcgggctgagctacgaggccgcggt

SEQ ID NO: 5473 - protein, 46 aa, Zea mays
  misc_feature: Ceres CLONE 320645-F
MGKPLIYEVLEKPASSSVIGICSLIWWLIQKRGIGYADVGLSYEAA

SEQ ID NO: 5474 - DNA, 516 bp, Zea mays
  misc_feature: Ceres CLONE 320646-F
  misc_feature: Encodes the peptide sequence at SEQ ID NO. 5475
agtcaaattttacgtaacttgcgtggttctcttcctgcgacggaagcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgthcttgacatgacgaccttgacaataatgcgcactcttccacgggaggtggatcctgtggtatataacatgcttcatgaagatccaggaaatgtcagttactctgctgtaggtggtc

SEQ ID NO: 5475 - protein, 144 aa, Zea mays
  misc_feature: Ceres CLONE 320646-F
MADGEDAAAARRRAAITDYRKKLLNCRELESRVGTVRESLKTAKKDFTKTEDDLKSLQSVGQIIGEVLRPLDNERFIVKASSGPRYVVGCRSKVDKEKLTSGTRVVLDMTTLTIMRTLPREVDPVVYNMLHEDPGNVSYSAVGG

SEQ ID NO: 5476 - DNA, 509 bp, Zea mays
  misc_feature: Ceres CLONE 320712-F
  misc_feature: Encodes the peptide sequence at SEQ ID NO. 5477
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcga

SEQ ID NO: 5477 - protein, 140 aa, Zea mays
  misc_feature: Ceres CLONE 320712-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSS

SEQ ID NO: 5478 - DNA, 514 bp, Zea mays
  misc_feature: Ceres CLONE 320747-F
  misc_feature: Encodes the peptide sequence at SEQ ID NO. 5479
acatccttattggaagggcagctaataaggtaataaggggcgacgaaaatggctccaacgaccgccaccaaggacgacagtggctacggcgacgagcgccggcgcgagctgcaggcgttcgacgacacgaagctgsgggtgaaaggcctggtggactccggcgtcaagtccatcccgtccatcttccaccacccgccggaagccctgagcgacataatttctccggcgcctctgccgccgtcgtcgtcgccctccgccgccgccatcccggtggtggacctctcggtgacgcgccgcgaggacctagtcgagcaggtgaggcacgcggccgggacggtgggcttcttctggctggtgaaccacggcgtggcggaggagctgatgggcggcatgctccgcggggtgcgccagttcaacgagggccccgtggaggcgaagcaggcgctctactcgagggacctcgctcgcaacctgcgcttcgcctccaacttcgacctcttcaaggctgctgcgg

SEQ ID NO: 5479 - protein, 155 aa, Zea mays
  misc_feature: Ceres CLONE 320747-F
  misc_feature: SWISSPROT Homolog: EC 1.14.11.20 Desacetoxyvindoline 4-hydroxylase
  misc_feature (30)..(30): Xaa is any aa, unknown, or other
MAPTTATKDDSGYGDERRRELQAFDDTKLXVKGLVDSGVKSIPSIFHHPPEALSDIISPAPLPPSSSPSAAAIPVVDLSVTRREDLVEQVRHAAGTVGFFWLVNHGVAEELMGGMLRGVRQFNEGPVEAKQALYSRDLARNLRFASNFDLFKAAA

SEQ ID NO: 5480 - DNA, 494 bp, Zea mays
  misc_feature: Ceres CLONE 320793-F
  misc_feature: Encodes the peptide sequence at SEQ ID NO. 5481
atttaccacaccctgctctcgctcttgttgtgacggtcgattcgcttgtacaagtgaccacccttccgctcccttctcacctatagctagcaaccttgagatccagccaagatccagccatgagggagattctccacatccagggtggacagtgcggcaaccagatcggttccaagttctgggaggtcgtctgcgacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtccgcaccgggccgtacggccagatcttccgccccgacaacttcgtcttcggccagtctggcgcggggaacaactgggccaagggccactacacagagggcgctgagctcatcgactctgtgcttgacgtcgtgaggaaagaggcggag

SEQ ID NO: 5481 - protein, 125 aa, Zea mays
  misc_feature: Ceres CLONE 320793-F
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAE

SEQ ID NO: 5482 - DNA, 374 bp, Zea mays
  misc_feature: Ceres CLONE 320801-F
gtgctttcttagaggtgggttggcttctcctccccctccggttcgggttcgggttcgtgaggttctccggggttcggtttcgtgggtgagcggtggggcccgcgcggccaagttatcctgttcgctaccgtgttgtttaccctagtccagagggtttatcttcgttcgtctcatgtttgttgttgcccatctgtgtttttgattgcaaggtcgctttgtgtcagttgttagtgctgtgttcatcctcggctccagcagacccatgcatcaaccagcatggactgcggatcgatggatgctgttacccccgtcaggctttatcctaagttaatcttcaaggaaaaaatggtgcttcttggtgctacaaaaaaaaa

SEQ ID NO: 5483 - DNA, 496 bp, Zea mays
  misc_feature: Ceres CLONE 320844-F
  misc_feature: Encodes the peptide sequence at SEQ ID NO. 5484
attccacctaggcgcatcggcgacgacggcgttgcgccctggtccatctaccgaactcgcctacccgcggtcctcgtcgttcacaggcggcgcgccctcgtccaggtccagtcgtcctcgttcacgaaggcggcctcgtccagcctactgttccttctgctacaaattcatagtcactgatggggaaggcaaagcgtgcctcgatcttcatcaggctggtttctgcagccggcactggattcttctacgtgaagcgcaagaatcctcgtcgcatcaccgagaagcttgagtttagaaagtatgatccccgtgtgaacaagcatgttctgtttaccgaagcgaagatgaagtgagatcttgtttctccacaatgcagaactgtaataagttgtcaaccttttgcgaccagaaacctttatgccgttattagacagatgattaacgatcctatgtgtttttcctgctccaatgagctgcaagcagcagatggctagtg

SEQ ID NO: 5484 - protein, 57 aa, Zea mays
  misc_feature: Ceres CLONE 320844-F
  misc_feature (8)..(55): Pfam Name: Ribosomal_L33 Pfam Description: Ribosomal protein L33
MGKAKRASIFIRLVSAAGTGFFYVKRKNPRRITEKLEFRKYDPRVNKHVLFTEAKMK

SEQ ID NO: 5485 - DNA, 407 bp, Zea mays
  misc_feature: Ceres CLONE 320875-F
  misc_feature: Encodes the peptide sequence at SEQ ID NO. 5486
aaaaaatccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtgg

SEQ ID NO: 5486 - protein, 99 aa, Zea mays
  misc_feature: Ceres CLONE 320875-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGG

SEQ ID NO: 5487 - DNA, 507 bp, Zea mays
  misc_feature: Ceres CLONE 320885-F
  misc_feature: Encodes the peptide sequence at SEQ ID NO. 5488
gtaagaaaagattatgcctttctagcacctcctggccaccaaagaagcaaaagtcttccaggttctcccacccacacggccacacgcccacacccactgctcctctaatctcacatgctcatgcatcctcctaatgtaacctgaagctttaagaaaacaaagtgctcccggaagactccaagctgcagctaccggccttcctctcccccattccaattccgagaacaggggcggcggagtcaaccaggtacgatgtgctcggtagcaaggctggcgtttgtgcttgcactggccatagccgcctcatcaattacggttgcggagagcagagattttaatatctttgctcagggcagcttgcctgatgcaaccaagggatcgtcaggtctagctgcaaccagtggaaagttgtgtcagttatgcgagcagtactcatccgaggcgctcctctatctcacacaaaacgagaccagactgagattcttagcattctacaccatgaatgtg

SEQ ID NO: 5488 - protein, 85 aa, Zea mays
  misc_feature: Ceres CLONE 320885-F
MCSVARLAFVLALAIAASSITVAESRDFNIFAQGSLPDATKGSSGLAATSGKLCQLCEQYSSEALLYLTQNETRLRFLAFYTMNV

SEQ ID NO: 5489 - DNA, 495 bp, Zea mays
  misc_feature: Ceres CLONE 320919-F
  misc_feature: Encodes the peptide sequence at SEQ ID NO. 5490
atttcactcgatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacggccacgagggccgaccgcaccacggcggcggcggatcccagtacggccacgagacacgcccgcaccacggcggcgggggcggcgcccgccctgtgaggcagcagacgtaca

SEQ ID NO: 5490 - protein, 158 aa, Zea mays
  misc_feature: Ceres CLONE 320919-F
MEFPHHHHHHGHRRDDDEDDRRGPPPPVYGGYGQPPPPDPYGRAPVDPDPYGRPPPQSAYGGAGDAYGHSGQGYAPPPAYGAGGGYGNVVHVAHEVGDERPYYGGGGGGLGGAYGGGGSEYGHEGRPHHGGGGSQYGHETRPHHGGGGGARPVRQQTY

SEQ ID NO: 5491 - DNA, 618 bp, Zea mays
  misc_feature: Ceres CLONE 320927-R
  misc_feature (565)..(565): n is a, c, t, g, unknown, or other
ccgattgggtaccgggccccccctcgaggtcgacggtatcgataagcttttttttttttttttttggcggtcgagcaaacaaaatgcttcccattttccaatcccgtaaacatctgaagttcaggaagcacagattaacattgtgtatgaacagatgattttccagagcctagatgaagcgatggcgacagagacctcaaatctaacagctaaataatgctattgcaagctactgcatgccccgtcccgttacggccaccagacaaggggatggactacgtgcgtcgtccaacatcacagactcatccggcgacacacacgcttcccaaatagatcatatatatatcctcccagccagcatcatctcctccgtcctgcaagtttgcttgctgcattacctgtcgtcttctcatcaccctcgccctactggaaagagcacatgtggttactgaacaccacttggttgaacagctctggccttggcccacctactgtttgcgccatgtagccgccgccgtcctcctgcgggaaagagatgctggcgccgccgccgtggagctcgtangaacggggggaggaggcggtggcgtgcgtactgtccgcgatagcttcgaatgg

SEQ ID NO: 5492 - DNA, 493 bp, Zea mays
  misc_feature: Ceres CLONE 320958-F
  misc_feature: Encodes the peptide sequence at SEQ ID NO. 5493
acaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcggcgggcagcttggaccaggagctggacatcacgtggggcgacgggcggggcaaggtcctggacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcaggrcggcgcgcacgacgagatcgacttcgagttcctgggcaacgtgtccggcgagccctacacgctgcacaccaacgtg

SEQ ID NO: 5493 - protein, 122 aa, Zea mays
  misc_feature: Ceres CLONE 320958-F
  misc_feature (28)..(122): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (97)..(97): Xaa is any aa, unknown, or other
MATSSRRVPLLLLVLGVLVSCSFAAGSLDQELDITWGDGRGKVLDNGRLLTLSLDRTSGSGFQSRHEYLFGKIDMQLRLVPGNSAGTVTAYYLSSQXGAHDEIDFEFLGNVSGEPYTLHTNV

SEQ ID NO: 5494 - DNA, 511 bp, Zea mays
  misc_feature: Ceres CLONE 320965-F
  misc_feature: Encodes the peptide sequence at SEQ ID NO. 5495
aatttcctccacctcccgaaccctaccggcggcgcagcagcatcacaaccaccacccgaagatggtgaagtttctgaagcccggcaaggccgtaatcctcctccagggcagattcgccggccggaaggcggtgatcgtgcgcgtgttcgaggagggcacccgcgaccgtccctatgggcactgcctcgtcgccggcctggccaagtaccccaagaaggtgatccgcaaggactccgccaagaagacggccaagaagtcccgcgtcaagtgcttcatcaagctcgtcaatttcactcacctcatgcccacccgctacaccctcgacgtcgacttcaaggacgtcgcctcgggcgggcccgacgcgctctccacccgggacaagaaggtcgaggcctgcaaggccgccaaggcgcgcctcgaggagaggttcaagaccggcaagaacaggtggttctttaccaagctccgcttctaggcgccgggcacccgcatagtgactgctttagttgtc

SEQ ID NO: 5495 - protein, 137 aa, Zea mays
  misc_feature: Ceres CLONE 320965-F
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKAAKARLEERFKTGKNRWFFTKLRF

SEQ ID NO: 5496 - DNA, 166 bp, Zea mays
  misc_feature: Ceres CLONE 320996-F
accaagccgccctgaccgccagacccaagccaacaagcaagagcattactactgcttccgaccgaaacctttcttggaacgcaagaaggatccccaccccgaccgaccwaccctaatcggcgatggcgacggtggcgatggacatctcgaagcccactccagyggc

SEQ ID NO: 5497 - DNA, 1171 bp, Zea mays
  misc_feature: Ceres CLONE 321006
  misc_feature: Encodes the peptide sequence at SEQ ID NO. 5498
agggaccagtccatctcgtctcgtcccagcaaagcaaaggcatccatgccccacagtctcttcctgctcgtcgtcctcctcgccgccgcgcaagccggcgcggccacgccgcggcagctgttcctcgtgagccggccgcccgtcacgctcaccaaccaccacggccagctgctgacgggcagctactccgtcaacctgctctggtacgggcgtttcacgccggcgcagcgcgccgtggtggccgacttcatcctctccctctcggggacggggacggggccggggccggggccggggtccgtggcggcttggtgggccacgacgtcgcggtaccatcctggcgcagcacggctgtcgctggggcgacaggtgctggacccgtcgcgctccctaggccgccgcctctcggagtcgtcgctagcgtccctggcgacgcgcctggccccgcaccgcggctccgtggcggtcgtggtgacggcgccggacgtgctcgtggacgggttctgcctctcccgctgcggcctccacgcgtcgtccctgaccccgaacgccacccgcgggcgtggccgcgggcggtacgtgtacgcgtgggtggggaaccccgcggagcagtgcccgggggagtgcgcatggcccttccaccagccgctctacggcccgcagccggcggcggcgccgctggtggccccgaacgcggacgtcgggatggacggcgcggtgatcacgctggccacgctgctggcgggcgcggtgaccaacccgtacggcggcggcttcttccagggccccgcggaggcgccgatggaggccgttacggcgtgcgcgggcgtgttcggggccggcgcctaccaggggtacccggggcagctgcgcgtggacgccgccacgggcgccagctacaacgccgtggggatcgccggccgacgcttcctgctgccggccatgtgggaccccgagacggcgcagtgctccacgccgctggactagatagatagatgcccgtgccgccgtgcattgcatgactgtggagtcgagtgtcggtgctgctgtttctttctcgtgtcccctcccctcccgtcccctcgcattgtggatataccactcagcaaccacttcgtttgtggctatactactactcctccggagggttggtggaaaaaaaaaaaaaaaa

SEQ ID NO: 5498 - protein, 313 aa, Zea mays
  misc_feature: Ceres CLONE 321006
  misc_feature (35)..(312): Pfam Name: Phi_1 Pfam Description: Phosphate-induced protein 1 conserved region
MPHSLFLLVVLLAAAQAGAATPRQLFLVSRPPVTLTNHHGQLLTGSYSVNLLWYGRFTPAQRAVVADFILSLSGTGTGPGPGPGSVAAWWATTSRYHPGAARLSLGRQVLDPSRSLGRRLSESSLASLATRLAPHRGSVAVVVTAPDVLVDGFCLSRCGLHASSLTPNATRGRGRGRYVYAWVGNPAEQCPGECAWPFHQPLYGPQPAAAPLVAPNADVGMDGAVITLATLLAGAVTNPYGGGFFQGPAEAPMEAVTACAGVFGAGAYQGYPGQLRVDAATGASYNAVGIAGRRFLLPAMWDPETAQCSTPLD

SEQ ID NO: 5499 - DNA, 516 bp, Zea mays
  misc_feature: Ceres CLONE 321007-F
  misc_feature: Encodes the peptide sequence at SEQ ID NO. 5500
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcccctgtcgtgcgtccgctcgtggggcggcgcgctctcgtccatcaaccacctcgtgtacgtctcgtcgagcgaggcgcgctt

SEQ ID NO: 5500 - protein, 144 aa, Zea mays
  misc_feature: Ceres CLONE 321007-F
  misc_feature (10)..(144): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASPVVRPLVGRRALVHQPPRVRLVERGAL

SEQ ID NO: 5501 - DNA, 488 bp, Zea mays
  misc_feature: Ceres CLONE 321055-F
  misc_feature: Encodes the peptide sequence at SEQ ID NO. 5502
aacctctagctgattgatctctggtttaccactctttccttccctccttcaattctaaataccacaaatcaaagttgctytgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggctttatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgt

SEQ ID NO: 5502 - protein, 134 aa, Zea mays
  misc_feature: Ceres CLONE 321055-F
  misc_feature (10)..(134): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHL

SEQ ID NO: 5503 - DNA, 530 bp, Zea mays
  misc_feature: Ceres CLONE 321059-F
  misc_feature: Encodes the peptide sequence at SEQ ID NO. 5504
gtatgtaggcctagggtttccttcctcctccagtgctgtcatcgccgccgccgccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcggaatagtgtcttggtagttttcgtatggagttggatgtcatctaattgtgctatgtttgtcgaagtttcatttaaaatggggacttgagaagggagttcttagttagacgagcttttgattgccctgaatgtgtttccccggctaatgctttgtgctgctggaccgtttcctgatagctttgctttgatgacatcctccccgttatcgataaag

SEQ ID NO: 5504 - protein, 65 aa, Zea mays
  misc_feature: Ceres CLONE 321059-F
  misc_feature (1)..(65): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEREARRLR

SEQ ID NO: 5505 - DNA, 492 bp, Zea mays
  misc_feature: Ceres CLONE 321126-F
  misc_feature: Encodes the peptide sequence at SEQ ID NO. 5506
acacagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccaccatcagagtaggcagctacaacggg

SEQ ID NO: 5506 - protein, 118 aa, Zea mays
  misc_feature: Ceres CLONE 321126-F
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNG

SEQ ID NO: 5507 - DNA, 393 bp, Zea mays
  misc_feature: Ceres CLONE 321290-F
  misc_feature: Encodes the peptide sequence at SEQ ID NO. 5508
  misc_feature (244)..(244): n is a, c, t, g, unknown, or other
atcccgagcttgctttaaccatctggtcgaaccatcaactataaaaatccttataaccctccatcgtttggtcactgctcccgcaccrscatcgcaatttgcatcaaacatggctcgcgttctcgccgcaatcgccgtcgcgacggckttccacctcctcgccttgctccacggtgcctcagccgcgcggccgatgggaaggcagcaggcggccgcwttccggacggggackttggcgttggcnccggctggagatcaaaatcagcagcggcgcacggcggcggcggcggccgcagaggcsgggaagtggctgccgttcgcgggcgtgcaccaccacctgccggcgccggcgtactgggcacacaggccggcgccgtgggttggggccggcgg

SEQ ID NO: 5508 - protein, 94 aa, Zea mays
  misc_feature: Ceres CLONE 321290-F
MARVLAAIAVATAFHLLALLHGASAARPMGRQQAAAFRTGTLALAPAGDQNQQRRTAAAAAAEAGKWLPFAGVHHHLPAPAYWAHRPAPWVGAG

SEQ ID NO: 5509 - DNA, 520 bp, Zea mays
  misc_feature: Ceres CLONE 321334-F
  misc_feature: Encodes the peptide sequence at SEQ ID NO. 5510
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggccgcgcttcccg

SEQ ID NO: 5510 - protein, 145 aa, Zea mays
  misc_feature: Ceres CLONE 321334-F
  misc_feature (10)..(145): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEAALP

SEQ ID NO: 5511 - DNA, 452 bp, Zea mays
  misc_feature: Ceres CLONE 321347-F
  misc_feature: Encodes the peptide sequence at SEQ ID NO. 5512
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcccctgtcgtgcgtccgct

SEQ ID NO: 5512 - protein, 122 aa, Zea mays
  misc_feature: Ceres CLONE 321347-F
  misc_feature (10)..(122): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASPVVRP

SEQ ID NO: 5513 - DNA, 529 bp, Zea mays
  misc_feature: Ceres CLONE 321361-F
  misc_feature: Encodes the peptide sequence at SEQ ID NO. 5514
acactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagacaaagaggtggcggctgtggaggctaacga

SEQ ID NO: 5514 - protein, 130 aa, Zea mays
  misc_feature: Ceres CLONE 321361-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKRWRLWRLT

SEQ ID NO: 5515 - DNA, 281 bp, Zea mays
  misc_feature: Ceres CLONE 321368-F
  misc_feature (61)..(61): n is a, c, t, g, unknown, or other
  misc_feature (132)..(132): n is a, c, t, g, unknown, or other
aaaaaaaaccccgccgcccctccgcttctctcccgagtcccgactcccgagtcccgtcttnkgcccggccccctcctcgcaaaaaccctaacccctcgacctctcaagatggcgtcsccgccgccgcctccngccgywgyygcagccccagccgccgcggcgtccgggaccgccgccgccggcgcaagtggtgggcaacgccttcgtgcatcagtactacaacttcctgcaccagtcgccggagctcgtctaccgcttctaccaggagtccagccgcctcg

SEQ ID NO: 5516 - DNA, 500 bp, Zea mays
  misc_feature: Ceres CLONE 321386-F
attgatcttcctggtgtggattcagggttatcgctaaagctcttctcttgaaggtttcacaagacttttccaaccgaacaaacctgtgacaaagggacaagctgccctagcattttcagctggtgattctggcgaagtggttctggaggagcttacccgtatcgaggcagagaaaatagctgaagcagctgtaaatgcacatgctgcattggttgctcaggtcgagaaagatcttaatgcaagttttgaaagggagcttaaggaggaaagagaaagggtagagacccttgaaaaagtagctgaagaagctagggtggagctagataggttgagggcagaaagagaggaagagaagaacattctggtcaggggcagagctgctgttgagtctgaaatggaagttctgttgaagttgaggagtgaggtagaggaacagctgcagaacgtactgagcaagaaggtggaggtgtcgttcgagaagagtaggattgagaaactcc

SEQ ID NO: 5517 - DNA, 521 bp, Zea mays
  misc_feature: Ceres CLONE 321412-F
  misc_feature: Encodes the peptide sequence at SEQ ID NO. 5518
  misc_feature (337)..(337): n is a, c, t, g, unknown, or other
aaatcaggacaggcatgctgaactaggcgaggtggactgggcgagcgagcgagatggagtggacgacggtggagacgagggacggcgcgaagctgagcgtgcggctgttcaagccccccgcgtccggaacggggttggagccggagccgagggaggatgtggcggtggtgctggtgcatccctacaccatcctcggcggcgtgcagggcctgctgcgggggatggcggagggcgtcgcgcggcggggttacaccgccgtcaccttcgacatgcgcggcgcgggccggtccagaacctgctcgaccacctcgccgaccccgtcaacaacaacgtgctnaccagcctcaagttccactagaacgttggtgcatcagcatacctgctgccgccgccgcagttgtttgctgtggaaagctagatgcatgcgtgttgtaaaggaacctgaagcgttgcatcggtcatgattcatgcatggccagcctgctgcctgtaacaacaaactagtattgatcttattgaga

SEQ ID NO: 5518 - protein, 136 aa, Zea mays
  misc_feature: Ceres CLONE 321412-F
  misc_feature (95)..(95): Xaa is any aa, unknown, or other
MEWTTVETRDGAKLSVRLFKPPASGTGLEPEPREDVAVVLVHPYTILGGVQGLLRGMAEGVARRGYTAVTFDMRGAGRSRTCSTTSPTPSTTTCXPASSSTRTLVHQHTCCRRRSCLLWKARCMRVVKEPEALHRS

SEQ ID NO: 5519 - DNA, 497 bp, Zea mays
  misc_feature: Ceres CLONE 321421-F
  misc_feature: Translation starting site: 123
  misc_feature (117)..(117): n is a, c, t, g, unknown, or other
  misc_feature (259)..(259): n is a, c, t, g, unknown, or other
  misc_feature (397)..(397): n is a, c, t, g, unknown, or other
atcaatagccagttctaatctcaggttgggggaaataggcctcgcgggtcgcaaaccgctctctgctgatttgggatttgggaggcgctcgagttttcaggtaaactatagtttagngacccatggctcgtactaagcaaactgctcgcaagtccactggagggaaggctcctaggaaacaactysccaccaaggctgcccgtaagtctgcacctacaactgggggagtaaagaagcctcaccgttaccgccctggaantgttgctcttcgtgaaatccgcaagtatcagaagagcactgacctgctcataaggaagcttccgttccaaaggcttgtcagggagattgcccaggatttcaagactgatcttcgtttcbagagccatgcggtgcttgnctgcaggaggctgcggaggcgtacctggtgggtctattcgaggacactaatctgtgcgccatccatgccaagcgcgtgaccatcatgcccaaggacattc

SEQ ID NO: 5520 - DNA, 499 bp, Zea mays
  misc_feature: Ceres CLONE 321425-F
  misc_feature: Encodes the peptide sequence at SEQ ID NO. 5521
actaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcacgctctcagacgttatgaatctggggaagagcgctgcattgctttgtaaactatgcg

SEQ ID NO: 5521 - protein, 127 aa, Zea mays
  misc_feature: Ceres CLONE 321425-F
  misc_feature: SWISSPROT Homolog: EC 1.6.5.3 NADH dehydrogenase (ubiquinone)
MASLLARQAAQALRARQTAQLGPAASAMQGHLRTYMNAGIPKRFKEDEEKEQLAKDLAKDWNAVFERSINTLFLTEMVRGLMLTLKYFFDRNVTINYPFEKGPLSPRFRGEHALRRYESGEERCIAL

SEQ ID NO: 5522 - DNA, 434 bp, Zea mays
  misc_feature: Ceres CLONE 321469-F
  misc_feature: Encodes the peptide sequence at SEQ ID NO. 5523
  misc_feature (418)..(418): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcttcaagaactacccggagctggcgcaggaggggcttgccgacgatgaatcagcgtctggacatctcgaacgcggcggtgacgcanatggcgacggaggcgt

SEQ ID NO: 5523 - protein, 116 aa, Zea mays
  misc_feature: Ceres CLONE 321469-F
  misc_feature: SWISSPROT Homolog: EC 2.3.1.74 Naringenin-chalcone synthase
  misc_feature (112)..(112): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEIFKNYPELAQEGLADDESASGHLERGGDAXGDGG

SEQ ID NO: 5524 - DNA, 488 bp, Zea mays
  misc_feature: Ceres CLONE 321483-F
  misc_feature: Encodes the peptide sequence at SEQ ID NO. 5525
agaaccctaatccaagcgagttttgttcggatctcacccgattacgataaggatgacgggctcaatggatctcccggccaagggcgggttcagcttcgacctgtgccgccgcaacagcatgctggagargaacgggctcaaactcccgggattcaggaagaccggaacaaccatcgtcggcctcgtctttcaggatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcacagctacagctgcaccgttatgcaacgggtcgcgaatctagagtcgtaactgctcttacactgctgaagtcacatctctttaggtatcaaggccatgccagtgctgcccttgttcttggtggagtggattgtactggac

SEQ ID NO: 5525 - protein, 145 aa, Zea mays
  misc_feature: Ceres CLONE 321483-F
  misc_feature (35)..(145): Pfam Name: Proteasome Pfam Description: Proteasome A-type and B-type
  misc_feature: SWISSPROT Homolog: EC 3.4.25.1 Proteasome endopeptidase complex
  misc_feature (26)..(26): Xaa is any aa, unknown, or other
MTGSMDLPAKGGFSFDLCRRNSMLEXNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQGHASAALVLGGVDCTG

SEQ ID NO: 5526 - DNA, 523 bp, Zea mays
  misc_feature: Ceres CLONE 321496-F
  misc_feature: Encodes the peptide sequence at SEQ ID NO. 5527
aagtcatcgattcatccagcagaagcaagcatcacacaaaaccgatcaatctcgcagagggagaaccaaccaatccatcatctgtctcgactctctcgcgtckccgccggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtcgcggcagcgggtccaggccgaccgcgccggcggccgcaaccctacctggaacgccacgctccgcttcgccgtcccggcaaccggcgcctcctcctccctccacatcctcctccgcgccgagcgcgccctcggcgacgcgacgtcggcgaggtccacatcscgctctccgagctcctctccggcgccccgacggccccgtccccgccaagttcgtcgcctaccaggtccgcaagatctcctcgggcaagccca

SEQ ID NO: 5527 - protein, 123 aa, Zea mays
  misc_feature: Ceres CLONE 321496-F
  misc_feature (7)..(92): Pfam Name: C2 Pfam Description: C2 domain
MATTRPLELTLISAKDLKDVNLLSKMEVYAVASLSGDPRSRQRVQADRAGGRNPTWNATLRFAVPATGASSSLHILLRAERALGDATSARSTSRSPSSSPAPRRPRPRQVRRLPGPQDLLGQA

SEQ ID NO: 5528 - DNA, 479 bp, Zea mays
  misc_feature: Ceres CLONE 321547-F
  misc_feature: Encodes the peptide sequence at SEQ ID NO. 5529
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgcgacgatgaatcagcgtctggacatctcgaacgcggcggtgacgcagatggcgacggaggcgtcccctgtcgtgcgtccgctcgtggggcggcgcgctctcgttccatca

SEQ ID NO: 5529 - protein, 97 aa, Zea mays; identical to SEQ ID NO: 2271
  misc_feature: Ceres CLONE 321547-F
  misc_feature: SWISSPROT Homolog: EC 2.3.1.74 Naringenin-chalcone synthase

SEQ ID NO: 5530 - DNA, 503 bp, Zea mays
  misc_feature: Ceres CLONE 321551-F
  misc_feature: Encodes the peptide sequence at SEQ ID NO. 5531
aaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcaccccacctcgttgtacgtctcgtc

SEQ ID NO: 5531 - protein, 139 aa, Zea mays
  misc_feature: Ceres CLONE 321551-F
  misc_feature (10)..(133): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITPPRCTSR

SEQ ID NO: 5532 - DNA, 409 bp, Zea mays
  misc_feature: Ceres CLONE 321553-F
  misc_feature: Encodes the peptide sequence at SEQ ID NO. 5533
gactcagtggcacgggagcggacgctgccactcgcgatatttgcgagagagagagagagagagagggcccgagagccgaggacgagtgcagtctggctggcgtgatgctgcttcggagcgcgtcctcgccgctgctcaactgcgggcgcgcgcmggctgccgcggcttcggtcgagcacctcgcggtggtttcgccgttgttatcaccggcagtggcggcgcctaggcaggggccggtgctgtgccgcgccatgtccgagggggacctcgccgcgccgctcgtgcccaagaaggacgatggacacgggagggcgccgaggctgtcggcgtccttgtcctcgtccgcctccatcttcgtcgaggaggaggacggcgagggcgaggaggaggaggaggacctggtcgcggt

SEQ ID NO: 5533 - protein, 101 aa, Zea mays
  misc_feature: Ceres CLONE 321553-F
  misc_feature (17)..(17): Xaa is any aa, unknown, or other
MLLRSASSPLLNCGRAXAAAASVEHLAVVSPLLSPAVAAPRQGPVLCRAMSEGDLAAPLVPKKDDGHGRAPRLSASLSSSASIFVEEEDGEGEEEEEDLVA

SEQ ID NO: 5534 - DNA, 474 bp, Zea mays
  misc_feature: Ceres CLONE 321566-F
  misc_feature: Encodes the peptide sequence at SEQ ID NO. 5535
gctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggaggactgggacgaagacagcgatgacgactgctacgatgatctgtgcgaggagatgagcaggatgaccgtgttggaggaggaggagaagaagaagaccgtgctgccgcatttcgaggggaagcacaccaggtcatctacaacagtgacgacgagatcgagcgggtggaggaggcggatgcagctgaggcgacggcg

SEQ ID NO: 5535 - protein, 125 aa, Zea mays
  misc_feature: Ceres CLONE 321566-F
  misc_feature (10)..(75): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEEDWDEDSDDDCYDDLCEEMSRMTVLEEEEKKKTVLPHFEGKHTRSSTTVTTRSSGWRRRMQLRRR

SEQ ID NO: 5536 - DNA, 516 bp, Zea mays
  misc_feature: Ceres CLONE 321574-F
  misc_feature: Encodes the peptide sequence at SEQ ID NO. 5537
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcctgtcgtgcgtccgctcgtggggcggcgcgctctcgtccatyacccacctcgtgtacgtctcgtcgagcgaggcgcgcttcc

SEQ ID NO: 5537 - protein, 144 aa, Zea mays
  misc_feature: Ceres CLONE 321574-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (131)..(131): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASCRASARGAARSRPXPTSCTSRRARRAS

SEQ ID NO: 5538 - DNA, 469 bp, Zea mays
  misc_feature: Ceres CLONE 321577-F
  misc_feature: Encodes the peptide sequence at SEQ ID NO. 5539
atcacacccaacgcaacatcagcgaaaacgcgcagagaaagatcactgatacaatggccatcaggggcagcatcggcttcgtagtgctctgcgtcgcgctggtgctgcacgccgcggcgacggcggcggcggccagggccgtgcctatgccgggcgcctcctcgacgtccaccggcagcaccgcgtcgctcccggccgcggccggcaccaagaacgacgactctggctcgggcgtcgccggcgtggcggacaagaagaacctcttcgtgggcgtgggaggcatgggcgacctcccgggcttcccggccgtgggcggcgggtacggcggcggcttcggcaacaacggcgggggcgtcttcagcggcgtcacgggcccgctgggcggcgtcgggggcggagacggaggcggtgggcacgccttccggtgtcccttcttcgtcgggctcgggcttcccccaacgatcggaat

SEQ ID NO: 5539 - protein, 138 aa, Zea mays
  misc_feature: Ceres CLONE 321577-F
MAIRGSIGFVVLCVALVLHAAATAAAARAVPMPGASSTSTGSTASLPAAAGTKNDDSGSGVAGVADKKNLFVGVGGMGDLPGFPAVGGGYGGGFGNNGGGVFSGVTGPLGGVGGGDGGGGHAFRCPFFVGLGLPPTIG

SEQ ID NO: 5540 - DNA, 472 bp, Zea mays
  misc_feature: Ceres CLONE 321585-F
  misc_feature: Encodes the peptide sequence at SEQ ID NO. 5541
aacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgcggaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcagccgccgaggaggaggc

SEQ ID NO: 5541 - protein, 108 aa, Zea mays
  misc_feature: Ceres CLONE 321585-F
MATAEVQTPTVVAAEEAPVVETPPPAVVPEESAPAEAEAEAEAEAAAPADPEELPAAEQQAAAEPEAAAPAGAEEPAAAEPAAEAEAAAPAGPEETPAVEQEAAAEEE

SEQ ID NO: 5542 - DNA, 483 bp, Zea mays
  misc_feature: Ceres CLONE 321707-F
  misc_feature: Encodes the peptide sequence at SEQ ID NO. 5543
acttcctctcccttcctcactcagccaaagctgactggagcctataagcgaagcgccagaagagctcttcccgatagccatggccaagcccccgcttcaaacggccgcgatcatcctcctcgtgctcctcgcggccgcatcgtgcctccacaccgtcgatgccgccgctttagggttctgctggggcaagtgcagcgttcggtgcgcgggggcgaccgcgcggcaggcgcgagccgcgtgcatgagctcttgcggcctctgctgcgaggcatgcaactgcgtgccacgcgacatccatgactgcccctgctaccgcaacatgctcaccgccggccccaagaagaggcccaagtgcccctgagactgagactgtgaggctgactcacatggcggcatcaatgggactgcgactgttgcctgcaactgcgattcaatccatgctgagccagacaacctgttatgttatggatccagatatctata

SEQ ID NO: 5543 - protein, 93 aa, Zea mays
  misc_feature: Ceres CLONE 321707-F
  misc_feature (1)..(93): Pfam Name: GASA Pfam Description: Gibberellin regulated protein
MAKPPLQTAAIILLVLLAAASCLHTVDAAALGFCWGKCSVRCAGATARQARAACMSSCGLCCEACNCVPRDIHDCPCYRNMLTAGPKKRPKCP

SEQ ID NO: 5544 - DNA, 525 bp, Zea mays
  misc_feature: Ceres CLONE 321744-F
  misc_feature: Encodes the peptide sequence at SEQ ID NO. 5545
accgcaaattgcccctatctatccctccctacaaatcgaaacaaagaaagaaaaaatcgagaggacgccwtgggccgattctctgcgtgasgktggggcgtcsctcgccgagttttctccrrrccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgctactctgtacgattaatcgatgccttgagcttgtaacttgttcgcatccttgtaggtgcgatgcttgtygggtcataaactctgatgatatcgagatttggtgatcaggaataatgcgt

SEQ ID NO: 5545 - protein, 72 aa, Zea mays
  misc_feature: Ceres CLONE 321744-F
  misc_feature (1)..(56): Pfam Name: 4F5 Pfam Description: 4F5 protein family
MTRGNQRDRDRERAAARKPNAKNSQDGLTPEQRRERDKKALEEKAAKKAQQAAAGGTGTSTDNNKNKAGGKK

SEQ ID NO: 5546 - DNA, 180 bp, Zea mays
  misc_feature: Ceres CLONE 321778-F
ctcgttcttccagcgaagcaagcagcctaaaaaaaccgtatcgtctcgcctgttcagtttccttctcttcccgcagcccggtttgccgagccaggttccaccgttccagagtagccaagcgaatcccgtgtctbgttcgcgcgatggcggaggagcagtccaacccccagcaccagcaag

SEQ ID NO: 5547 - DNA, 511 bp, Zea mays
  misc_feature: Ceres CLONE 321813-F
  misc_feature: Encodes the peptide sequence at SEQ ID NO. 5548
accaccagttccttgttcggtcggaacgcagcgcagcggcggcggcgatagggagagaggagagagtctgcaggatccagcagactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcgggcagctgctcctgcgggatgaggctgaggatgatgatgaccttgatcctttttggtgatgaaactgaggaggachagaaggc

SEQ ID NO: 5548 - protein, 111 aa, Zea mays
  misc_feature: Ceres CLONE 321813-F
  misc_feature (110)..(110): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAGSCSCGMRLRMMMTLILFGDETEEDXK

SEQ ID NO: 5549 - DNA, 253 bp, Zea mays
  misc_feature: Ceres CLONE 321873-F
  misc_feature: Encodes the peptide sequence at SEQ ID NO. 5550
atgctgctccgccgccttctgcactccacacgccacttccggcacggcctccggaccgtaactccggccaacaccaccaccaccacttcctcctcctccaccccccttccatttcgctgcttcccggacctccccctctctcgcgtcctctccccgcggctcctctccacctccggccgcgacgacgaccgcaacaagccgtggagcttcgaggcggactcgggcgatccggaccccttcgccaatgaggacg

SEQ ID NO: 5550 - protein, 84 aa, Zea mays
  misc_feature: Ceres CLONE 321873-F
MLLRRLLHSTRHFRHGLRTVTPANTTTTTSSSSTPLPFRCFPDLPLSRVLSPRLLSTSGRDDDRNKPWSFEADSGDPDPFANED

SEQ ID NO: 5551 - DNA, 478 bp, Zea mays
  misc_feature: Ceres CLONE 321892-F
  misc_feature: Encodes the peptide sequence at SEQ ID NO. 5552
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccrgacgatgaatcagcgtctggacatctcgaacgcggcggtgacscagatggcgacggaggcgtccctgtcgtgcgtccgctcgtggggcggcgcgctctcgtcatca

SEQ ID NO: 5552 - protein, 131 aa, Zea mays
  misc_feature: Ceres CLONE 321892-F
  misc_feature (10)..(131): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (111)..(111): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPDDESASGHLERGGDXDGDGGVPVVRPLVGRRALVI

SEQ ID NO: 5553 - DNA, 482 bp, Zea mays
  misc_feature: Ceres CLONE 321895-F
  misc_feature: Encodes the peptide sequence at SEQ ID NO. 5554
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctccgtccatca

SEQ ID NO: 5554 - protein, 131 aa, Zea mays
  misc_feature: Ceres CLONE 321895-F
  misc_feature (10)..(129): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSVH

SEQ ID NO: 5555 - DNA, 486 bp, Zea mays
  misc_feature: Ceres CLONE 321897-F
  misc_feature: Encodes the peptide sequence at SEQ ID NO. 5556
aagaatatgttgggctcagggctcacagggcagacagcaacggcatgccggccgatccgccatcgtccggtcccatcggcgtccgtgctagctgacggtgctataggtcctagctaataattccatcgcatggcatccgtgcaggcgacaagtcgatgatccggaagcggtacatgcacctgacggaggagttcctgtcggagaacccgagcatgtgcgcgtacatggcgccgtcgctggacgcgcggcaggacgtcgtggtgacggaggtgccgaagctggggaaggcggcggcgcagawggcgatcaaggagtgggggcagcccaagtcgcggatcacgcacctggtgttctgcaccacgtcgggggtggacatgccgggcgccgactaccagctgaccaaggcgctgggcctgcggccctccgtgaaccgcctgatgatgtaccagcaggggtgcttcgcgggcggcacggtgctgcgcgtgg

SEQ ID NO: 5556 - protein, 110 aa, Zea mays
  misc_feature: Ceres CLONE 321897-F
  misc_feature (1)..(110): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (49)..(49): Xaa is any aa, unknown, or other
MIRKRYMHLTEEFLSENPSMCAYMAPSLDARQDVVVTEVPKLGKAAAQXAIKEWGQPKSRITHLVFCTTSGVDMPGADYQLTKALGLRPSVNRLMMYQQGCFAGGTVLRV

SEQ ID NO: 5557 - DNA, 975 bp, Zea mays
  misc_feature: Ceres CLONE 321923
  misc_feature: Encodes the peptide sequence at SEQ ID NO. 5558
tctcgtttctgccccctctgcttgcccccctttcatctcaggcgtcgaagagagagagagagagagagaggagttgcaagttggtgagatggatctgttggagcggaatattaagacggagacggaggagacgcgcaaggaacaggagcgtaaggaggaggaggcggaggcggaggcggaggcgggggagaggaagacccaggagccgccgcagcarggccagggcctcagcctctcactcgcccaacggcagtggcaggtctggaatgttgccgatgtcgaacgtgtccgctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatgagcacttctgtagcaactgggcaacctcaggttgttgctgaacctagctcgatatgcaaacttcaggctgatctccccattgccaggaggcactctcttcagcgtttccttgagaaacgccgtgacagggtcgtgagcaaagctccatacagcaccgccaagtcgtccgatggcatggagtcaccgaggattgaggtgacagcggagggcaaggcccagtaacttgaaaggtccccgcggagtcccatcggtgaaggctgacgttgtgggaaggggcagggacgcgctgttgttgccttatgttatgtggcggcggcagcgtggaaccgcactaataatgtggaccggaacctctgttaccgtcgtttgtgctgtcgcgtgctaggtttatgctgaagtggattcctttactccgcacaccgaactgtgtctgttgtacatcacgccgtgacgccggtggtctcgtctgtctgacttcgttacatggatcgtctagtagtaacggaatgcgaaaaaacaaaaaaaa

SEQ ID NO: 5558 - protein, 134 aa, Zea mays
  misc_feature: Ceres CLONE 321923
MLPMSNVSANPSQLTIFYGGSVCVYDSVPPEKAQAIMLIAAAAAAAAATKSSAAPTVKPPMSTSVATGQPQVVAEPSSICKLQADLPIARRHSLQRFLEKRRDRVVSKAPYSTAKSSDGMESPRIEVTAEGKAQ

SEQ ID NO: 5559 - DNA, 540 bp, Zea mays
  misc_feature: Ceres CLONE 321964-F
  misc_feature: Encodes the peptide sequence at SEQ ID NO. 5560
aagttaggcagtgaaccaaacaagcccctagtcttccctcctgctggcggcgtgcggagggccggaggccggggtcgacaagaggagatgacgttggcggcggggctgggttacgccctgatcgcgctgggccccgccttctccctcttctccggcgtcgtcgtcaggaagcccttcctcgtcctcaccctcctctctagcaccttattttggcttataagtttgatagtcctctcgggaatatggagaggatttcttcctataaagtcaggagcttggtgggcatatgtgattctgatccttacatctgtcgcattgcaagaaggcactcgtcttgtgttttggatgctttacaagaaaatggaagagatgctagatgcttttgctgatagaatatctaagccacgtcttagattgactgacaagatgctgatttctttagctggtggtttaggccatggagtggctcatgcagtctttttctgtctcagtcttttgactccagcgtttggtcgagccacatyttatactgaaaggtgc

SEQ ID NO: 5560 - protein, 151 aa, Zea mays
  misc_feature: Ceres CLONE 321964-F
  misc_feature (1)..(151): Pfam Name: Aph-1 Pfam Description: Aph-1 protein
  misc_feature (146)..(146): Xaa is any aa, unknown, or other
MTLAAGLGYALIALGPAFSLFSGVVVRKPFLVLTLLSSTLFWLISLIVLSGIWRGFLPIKSGAWWAYVILILTSVALQEGTRLVFWMLYKKMEEMLDAFADRISKPRLRLTDKMLISLAGGLGHGVAHAVFFCLSLLTPAFGRATXYTERC

SEQ ID NO: 5561 - DNA, 500 bp, Zea mays
  misc_feature: Ceres CLONE 322003-F
  misc_feature: Encodes the peptide sequence at SEQ ID NO. 5562
aacctctagctgattgatctctggtttaccactctttccttccctccttcaattctaaataccacaaatcaaagttgctttgcgatggtgagcagcagcatggacacaacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtc

SEQ ID NO: 5562 - protein, 138 aa, Zea mays
  misc_feature: Ceres CLONE 322003-F
  misc_feature (10)..(138): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVS

SEQ ID NO: 5563 - DNA, 492 bp, Zea mays
  misc_feature: Ceres CLONE 322025-F
  misc_feature: Encodes the peptide sequence at SEQ ID NO. 5564
aaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcaccacctcgtgtac

SEQ ID NO: 5564 - protein, 135 aa, Zea mays
  misc_feature: Ceres CLONE 322025-F
  misc_feature (10)..(134): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITTSC

SEQ ID NO: 5565 - DNA, 436 bp, Zea mays
  misc_feature: Ceres CLONE 322083-F
  misc_feature: Encodes the peptide sequence at SEQ ID NO. 5566
gatattttccccttcagccccattcgcaaccgttgtggcgcgtcgatccccatcgcctctccccatcccctctcctgtctgaaaaccagcacgccacgtcccaccgccaaccaccgcgctccggctctccccaattctaagcgagacggggcacaggaagaggagagcctaaaaccctaaccccccgaatcggatccggccgccggagcgcggaaccccaccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaaccggccccgacagcctcaagcttcttgaagatgcggaagccaaactggaggagg

SEQ ID NO: 5566 - protein, 68 aa, Zea mays
  misc_feature: Ceres CLONE 322083-F
  misc_feature (9)..(68): Pfam Name: TOM20_plant Pfam Description: Plant specific mitochondrial import receptor subunit TOM20
MEMGGMSDAERLFFFEMACKNSEVAYEQNPNDADNLTRWGGALLELSQVRTGPDSLKLLEDAEAKLEE

SEQ ID NO: 5567 - DNA, 524 bp, Zea mays
  misc_feature: Ceres CLONE 322092-F
  misc_feature: Encodes the peptide sequence at SEQ ID NO. 5568
acactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgaaccggagatagccgccgagaccaaagaggtggcggctgtggaggc

SEQ ID NO: 5568 - protein, 128 aa, Zea mays
  misc_feature: Ceres CLONE 322092-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVAAVE

SEQ ID NO: 5569 - DNA, 435 bp, Zea mays
  misc_feature: Ceres CLONE 322134-F
  misc_feature: Encodes the peptide sequence at SEQ ID NO. 5570
atctgaagcaccctgttcgcaaaacctctcctgctcctgccgccgccgccatggagagtgcgccgcaaacccccaccatggcggccgccggcgatgtccttcgcgtggccgacctcccgggacgaggtcgcggtctcgtggccgcccgcaacgtccgcgagggtgaggtgctcctctccgagcctcccgtcctcctctacccgtcgaccctctcctccctccgctcatactgctccgcctgcttccgctccctcccccccgccgccacgattccctgcgtttcctgccgcgccgctgccttctgctccccggcctgcgccgccgcttcgcacccgcacctcctctgtgccgcgctctcccacggcggcggcgctggcctcgccgccgcgctcccaccgaggcgatccaagagccgctcctcttccttctctccgc

SEQ ID NO: 5570 - protein, 128 aa, Zea mays
  misc_feature: Ceres CLONE 322134-F
  misc_feature: SWISSPROT Homolog: EC 2.1.1.43 Histone-lysine N-methyltransferase
MESAPQTPTMAAAGDVLRVADLPGRGRGLVAARNVREGEVLLSEPPVLLYPSTLSSLRSYCSACFRSLPPAATIPCVSCRAAAFCSPACAAASHPHLLCAALSHGGGAGLAAALPPRRSKSRSSSFSP

SEQ ID NO: 5571 - DNA, 433 bp, Zea mays
  misc_feature: Ceres CLONE 322159-F
  misc_feature: Encodes the peptide sequence at SEQ ID NO. 5572
ctggcagtcgcgtcgacctccccgccgcgcccacggcactcgccactccacccaccaggccaagcacgcggcggcgacgccaaagcatcagggcaccaatggttgtgctccccgcggccccgcggcccctactcctacagtcctaaataatagccttccattccaatctgttcccacagttcagtcgcacactcgggcgggtcaaattcgactcgggaggaaccaaccacccggaaattcccccctcctccagtctccacttgatcggcgaggcgctgcggccgcgggcgaatggcgtcggaggcggagtcgcccgtggtgatccacgcgtggtcggcgccgcgctccctcagcaccagcctcatgtactccttcgcccagagggacgacatggaggtgcttgacgagcctctctacgcaaatttcctgcgtg

SEQ ID NO: 5572 - protein, 47 aa, Zea mays
  misc_feature: Ceres CLONE 322159-F
MASEAESPVVIHAWSAPRSLSTSLMYSFAQRDDMEVLDEPLYANFLR

SEQ ID NO: 5573 - DNA, 494 bp, Zea mays
  misc_feature: Ceres CLONE 322189-F
  misc_feature: Encodes the peptide sequence at SEQ ID NO. 5574
aaaaatttcgatctcatttgaaatcaacccatcctcgtttcctccgtctaargcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaaccgagaaggagta

SEQ ID NO: 5574 - protein, 142 aa, Zea mays
  misc_feature: Ceres CLONE 322189-F
  misc_feature (4)..(142): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNREGV

SEQ ID NO: 5575 - DNA, 489 bp, Zea mays
  misc_feature: Ceres CLONE 322210-F
  misc_feature: Encodes the peptide sequence at SEQ ID NO. 5576
ataaaagtgccgaagacgaggaccccgtcttttgctggcacggcagttgccccaccccaccaagtcaaacgtccccagcctcctaaaatttcccctttccccaactaacacgacacccccttcccttcctccgatccccccgcctcccccaaaatccgacgcgtaatcgccgccatggccgccgccggcaagctcctcctcctggtcgccgccgtcctggcggcttccctcgtcgccgacgcgcgcccgtgcggccacgcgcagacgctcctcgtctccttctcctccgtcctcaggccgaacccggaccccaccaacccgacgccgctcaccaccacagtcgtcaccgtcctccgcgtccgccgcctcggcccgcaccagatccgccgccccgtggcgctccccgccgtcgagtcggaggtcgccgcctcgtccgcccaggaccgcgccaaggacatcctcgtcgtcgtctccggcctcctcttcggc

SEQ ID NO: 5576 - protein, 105 aa, Zea mays
  misc_feature: Ceres CLONE 322210-F
MAAAGKLLLLVAAVLAASLVADARPCGHAQTLLVSFSSVLRPNPDPTNPTPLTTTVVTVLRVRRLGPHQIRRPVALPAVESEVAASSAQDRAKDILVVVSGLLFG

SEQ ID NO: 5577 - DNA, 503 bp, Zea mays
  misc_feature: Ceres CLONE 322214-F
  misc_feature: Encodes the peptide sequence at SEQ ID NO. 5578
gaaaaagcctagttcgcgttactcgacacacctaggaccgtgtccgactcgagcccaaaccgcgtcaccccctcccccaatcgtctcgctcgcaagtcgcatcgcacgtacggtctcaggcgcatcggcctcgccgctgcacaacgccggagacgagacgacggcggctgcgggatgacggtcttccacttcctcaactgcgccttcctcaccttcggccctcacgtcgtctactactccgccacgcccctgtcagagtatgatacaatcggcacttctataaaagcagctgctgtttatcttggaactgcgcttgtaaagcttgtttgcttggcaacattgctcaaagtacctgagaatgatagctttgacccctatcaggagttaatgaaagtttttattggattcatagatgtagctggactgtattttgctttgacccagctgacccacagaaacatctctcagaatcataagttccaggctgttggtcttggttgggc

SEQ ID NO: 5578 - protein, 109 aa, Zea mays
  misc_feature: Ceres CLONE 322214-F
MTVFHFLNCAFLTFGPHVVYYSATPLSEYDTIGTSIKAAAVYLGTALVKLVCLATLLKVPENDSFDPYQELMKVFIGFIDVAGLYFALTQLTHRNISQNHKFQAVGLGW

SEQ ID NO: 5579 - DNA, 457 bp, Zea mays
  misc_feature: Ceres CLONE 322216-F
  misc_feature: Encodes the peptide sequence at SEQ ID NO. 5580
aagccgccctgatctccagacccaggccaacaagcaagagcattactactgctgcttccgaccgaaacctttcttggaacgcaagaaggatctccaccccgaccgacctatcctaatcggcgatggcgacggtggcgatggacatctcgaagcccacgccggtggcgtccggcgacgaggccgcggcggcggccaaggggaggagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagagttgcagttgcttcaagagcctggctcatatgttggtgaggtggtgaaggtcatggggaaatcgaaggttctggtgaaggtacaccccgaaggcaaattatgttg

SEQ ID NO: 5580 - protein, 111 aa, Zea mays
  misc_feature: Ceres CLONE 322216-F
MATVAMDISKPTPVASGDEAAAAAKGRSGGGGEGLRQYYLQHIHDLQLQIRQKTHNLNRLEAQRNDLNSRVRMLREELQLLQEPGSYVGEVVKVMGKSKVLVKVHPEGKLC

SEQ ID NO: 5581 - DNA, 511 bp, Zea mays
  misc_feature: Ceres CLONE 322262-F
  misc_feature: Encodes the peptide sequence at SEQ ID NO. 5582
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgcttctcgtcatcacccacctcgtgtacgtctcgtcgagcgaggcgc

SEQ ID NO: 5582 - protein, 142 aa, Zea mays
  misc_feature: Ceres CLONE 322262-F
  misc_feature (10)..(142): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALLVITHLVYVSSSEA

SEQ ID NO: 5583 - DNA, 480 bp, Zea mays
  misc_feature: Ceres CLONE 322294-F
  misc_feature: Encodes the peptide sequence at SEQ ID NO. 5584
atacggcataccacactagagccgccgcgcgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggccaaggcctggtcagggcccgccgcgccaggcggtgcagctcctgcagctgcagctgctgctgctcctcgta

SEQ ID NO: 5584 - protein, 130 aa, Zea mays
  misc_feature: Ceres CLONE 322294-F
  misc_feature (1)..(114): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGQGLVRARRARRCSSCSCSCCCSS

SEQ ID NO: 5585 - DNA, 532 bp, Zea mays
  misc_feature: Ceres CLONE 322334-F
  misc_feature: Encodes the peptide sequence at SEQ ID NO. 5586
gatttgacccatctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtsgacttcaaggacgtggccaccggcgggcccgacgcgctctccacccgcgacaagaaggtcgccgcctgcaaggccgccaaggcgcgcctcgaggagaggttcaagaccggcaagaacaggtggttctttaccaagctccgcttctagatggtcggcgtcccgaatggtgccccctcggtttcttgtgtatgggacacactcc

SEQ ID NO: 5586 - protein, 137 aa, Zea mays
  misc_feature: Ceres CLONE 322334-F
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVVRRDSAKKTAKKSRVKCFIKLVNFTHLMPTRYTLDVDFKDVATGGPDALSTRDKKVAACKAAKARLEERFKTGKNRWFFTKLRF

SEQ ID NO: 5587 - DNA, 462 bp, Zea mays
  misc_feature: Ceres CLONE 322437-F
  misc_feature: Encodes the peptide sequence at SEQ ID NO. 5588
aacaccacgaaaatctgacatctcatcttgatccatccagctttgcctcgatcgccggccggtagccatgtcccccatggaagaagccgctggtggtggtctcgacgactatgaccgcttgagcgagctgaaggcgttcgmycgacagcaaggccggcgtcaagggcctcgtggacgctggcgtcacgacatccctgccatcttccgcggccatctccttcaggaagggccgaaggtatcgtccgctagcagtagcagcagtactagtcttagcattatcccggtcatcgacctctcggcggcggacgcagtcgcacgggaggaggtggtcgcccaggtgaaggctgcagccgagacggtggggttcttccagctggtgaaccacggcgttcccagcgagctcctgtccgagatgctggcgtcggtgaggcggttcaacgagragccccacgaggtgaagcg

SEQ ID NO: 5588 - protein, 131 aa, Zea mays
  misc_feature: Ceres CLONE 322437-F
  misc_feature: SWISSPROT Homolog: EC 1.14.11.20 Desacetoxyvindoline 4-hydroxylase
  misc_feature (25)..(25): Xaa is any aa, unknown, or other
  misc_feature (126)..(126): Xaa is any aa, unknown, or other
MSPMEEAAGGGLDDYDRLSELKAFXRQQGRRQGPRGRWRHDIPAIFRGHLLQEGPKVSSASSSSSTSLSIIPVIDLSAADAVAREEVVAQVKAAAETVGFFQLVNHGVPSELLSEMLASVRRFNEXPHEVK

SEQ ID NO: 5589 - DNA, 887 bp, Zea mays
  misc_feature: Ceres CLONE 322440-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnnccgattgctgacggggccccgcgctcgagtcgacggtatcgataagcttttttttggttttgtgtgattttttttttttttttttttttttttttttttttttttttttttttttttttttttttttttttttttttttttttttttgggaagaaaaaaaaatttgggcccttccgaatttccaatccattaaattaaagggggttaaaaaaacaaaaccaccccccaaaggatccaaggcccccaaaaaaaggaaaaaaaggtggccggggaaccaattttttcccaaaaggaaaccttttttaaagaccggccgaaacaattttgaaaaacttttttttccatgggctccccggggagtttttcaaaaaagccctttataaaggggttccaaaaggaaatggccttgggggaaatgccaatttcggggggcccccgcgttcggaccttaaaaaaggaaaatttggggggccccccggttttttgggggtttttcttgccctttttgcggccgcccccctttaccggggggatttggagggccggggggggcgtttttcgaaaaggggggttttttaaccggggggggggttttttttcccgccttctcccatggggggggggggggtttttttggccccgggggggttttttttggggccgtggggggggccaaaaggggtggggggttttcctggggtccaaagggggaatgggggggggcaacaaaaaaaacacttgggcggggaacacccgaaaaggggagggtttttcttttttttttggaaaagggggggttctggggaaaagggttccctggggaaaattctccggcacccggggggggcacccctttttttcccaaaggggcgccgcccccccgg

SEQ ID NO: 5590 - DNA, 197 bp, Zea mays; identical to SEQ ID NO: 3377
  misc_feature: Ceres CLONE 322441-F

SEQ ID NO: 5591 - DNA, 469 bp, Zea mays
  misc_feature: Ceres CLONE 322444-F
  misc_feature: Encodes the peptide sequence at SEQ ID NO. 5592
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctct

SEQ ID NO: 5592 - protein, 128 aa, Zea mays
  misc_feature: Ceres CLONE 322444-F
  misc_feature (10)..(128): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGAL

SEQ ID NO: 5593 - DNA, 512 bp, Zea mays
  misc_feature: Ceres CLONE 322447-F
  misc_feature: Encodes the peptide sequence at SEQ ID NO. 5594
atcttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcga

SEQ ID NO: 5594 - protein, 140 aa, Zea mays; identical to SEQ ID NO: 5477
  misc_feature: Ceres CLONE 322447-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 5595 - DNA, 490 bp, Zea mays
  misc_feature: Ceres CLONE 322582-F
  misc_feature: Encodes the peptide sequence at SEQ ID NO. 5596
aaatcacctcacaacaagctgccccgcagcaacgaacacgaaccttggcagaacgaagctgaagtagttcgttgtgaacccagtatggcaaacgcgccgaggatcctggccctcggcctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgttcttcaacggcatcaagaaccaggccgggagcgggtgcgagggcaagaacttctacacccggagcgcgttcctgagcgccgtcaacaagtacccgggcttcgcccatggccggkacggaggtggagggcaagcgcgagatcgcgccttct

SEQ ID NO: 5596 - protein, 135 aa, Zea mays
  misc_feature: Ceres CLONE 322582-F
  misc_feature (26)..(59): Pfam Name: Chitin_bind_1 Pfam Description: Chitin recognition protein
  misc_feature: SWISSPROT Homolog: EC 3.2.1.14 Chitinase
  misc_feature (124)..(124): Xaa is any aa, unknown, or other
MANAPRILALGLLLALLCAAAGPAAAQNCGCQPNFCCSKFGYCGTTDDYCGDGCQSGPCRSGGGGGGGGGGGSGGANVANVVSDAFFNGIKNQAGSGCEGKNFYTRSAFLSAVNKYPGFAHGRXGGGGQARDRAF

SEQ ID NO: 5597 - DNA, 1084 bp, Zea mays
  misc_feature: Ceres CLONE 322588
  misc_feature: Encodes the peptide sequence at SEQ ID NO. 5598
accggaagttcgatgggaggaactgggaggattttttcaggaccagcgacatcgctggattctccaaggacgatgcagaggcggcggagtagcgggcaggtcagttcgtgttcttaccctcatgattcatgaggataagaacackaaccaaccagcctagcgacgccgacgccgccacgtcccaacgaaaaagaaacaaaaaagaagaagaggacagactgccagagtcatggcggccacgagctccgcctgcgcgtgcgcggcggtagcgctcgcgtccttcccgtccgccgcctccacctccgccccttcccgcgtctcggccagcagccaccgcggtcagcggcactccagggccgccaccgtcagatgttccagcacgtcgcccaacgtgtcccagggcgcgccggcgccggcgccgcccaagccgcaaatcgagctcgagttcgtcgggccgaagcccggtgccgacggctccttcccggtggaccgggcggaggcgaccagcggcgagaagctcctccgtgacgtcatgaacgagaacaagatcgagctctacgccgcatacggcaaggtgatgaactgcggtggcggcggaagttgcggcacttgcatcgtcgagataatcgatggaaaggagctcctgaatgagaggacgaacaccgagaatcggtacctgaagaagaaaccagactcatggaggctagcttgccagactattgtaggcaacaaagagaactctggcaaggttgtggtccaacggctgcctcagtggaagagatgaccgtgcagtgcagcaccacgttggtggatgatcgatcgtccagttgtatgtcactaaaacgccatgccctgtgcattagagaagagacagaatcacctcgtcatatcgcttgtgaccagttctctgatactagtttgcaagtctgggcttcggtccacagtatatatgtgggatatatatctgtaaacaaaaaaaaaacaagaaggcagggcatgttgggatatatatctgtaaacaaaaaaacaagtttgggcttcggtccacagtatataagctgttttcacaaaaaaaaaaaaaaaa

SEQ ID NO: 5598 - protein, 184 aa, Zea mays
  misc_feature: Ceres CLONE 322588
MAATSSACACAAVALASFPSAASTSAPSRVSASSHRGQRHSRAATVRCSSTSPNVSQGAPAPAPPKPQIELEFVGPKPGADGSFPVDRAEATSGEKLLRDVMNENKIELYAAYGKVMNCGGGGSCGTCIVEIIDGKELLNERTNTENRYLKKKPDSWRLACQTIVGNKENSGKVVVQRLPQWKR

SEQ ID NO: 5599 - DNA, 505 bp, Zea mays
  misc_feature: Ceres CLONE 322613-F
  misc_feature: Translation starting site: 63
  misc_feature: SWISSPROT Homolog: EC 4.1.1.39 Ribulose-bisphosphate carboxylase
acaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtaacaaatgcatcctagctagtagttctttgcattgcagcagctgcagctagcgagttagtaataggaagggaactgatgatccatgcatggactgatgtgtgttgcccatcccatcccatttcccaaccccaaacgaaccaaaacacacgtactacgtgcaggtgtggccggcctacggcaacaagaagttcgagacgctgtcgtacctgccgccgctgtcgacggacgacctgcygaagcaggtggactacctgctgcgcaacggctggataccctggcctcgagttcagcaa

SEQ ID NO: 5600 - DNA, 438 bp, Zea mays
  misc_feature: Ceres CLONE 322616-F
  misc_feature: Encodes the peptide sequence at SEQ ID NO. 5601
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctg

SEQ ID NO: 5601 - protein, 118 aa, Zea mays
  misc_feature: Ceres CLONE 322616-F
  misc_feature (10)..(118): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASL

SEQ ID NO: 5602 - DNA, 665 bp, Zea mays
  misc_feature: Ceres CLONE 322700-R
cgattgggtaccgggccccccctcgaggtcgacggtatcgatattttttttttttttttttaccggcgaccgaattgctgagattttttttatatctttgctgcttgctgctaggcgaggagcatctggaagagcatgtcgttccagatgtcgatgggtcccgggaggcaccagtggatgcagtcgttgtagagctgcaccttctcgttgggccagtgcccgtagcggctggggtggccgtcgggccgcatgagcatcgccgccgtggcgtccatgagcatgagccgccgccccttgtcggcggcggccttctccgcggcgcggaactcctccatctgtgcggtgtagaagtgcaggtcgcggccctccatggcggtctggttcgcccgcagcggctgcgtgcgcctgcagtcgccgccgtggtcccaggtcccgttctcgaagtgcgacatcggggagagcatgcgcacgatgacgcgccgcggaggtgctccaggtcgttgatggcgcgcagcggcacgcgccacgcgcggcgctgcgagtagtagagcgtcaggtcgggcacgccgtactgggggctgcagaagctgcacccgacgaggcgccgccgctcttagaagagggaggggggggagaaccagttggccgcccgacccagcacgtag

SEQ ID NO: 5603 - DNA, 444 bp, Zea mays
  misc_feature: Ceres CLONE 322704-F
  misc_feature: Encodes the peptide sequence at SEQ ID NO. 5604
aatccaacaagcacaaacctgcagtcatctatctcctccatcaccaccaccaagctcaacaacagccagctcgcgaaaataatgaagagccgcagcatggcatcatcgcccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggcccgaggtcac

SEQ ID NO: 5604 - protein, 121 aa, Zea mays
  misc_feature: Ceres CLONE 322704-F
MKSRSMASSPALLVLALALVAATAPQVAEAKKKRAAESGEAAEAKKIQDDFCSTLCEGKKGTDLVVCKESCALSQQSNLVLYGRIQCKGKCTEQKGITAPAMKVCQEECDKAYVVKAARGH

SEQ ID NO: 5605 - DNA, 519 bp, Zea mays
  misc_feature: Ceres CLONE 322715-F
  misc_feature: Encodes the peptide sequence at SEQ ID NO. 5606
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgcgacgatgaatcagcgtctggacatctcgaacgcggcggtgacgcagatggcgacggaggcctccctgtcgtgcgtccgctcgtggggcggcgcgctctcgtccatcacccacctcgtgtacgtctcgtcgagcgaggcgcgcttcc

SEQ ID NO: 5606 - protein, 97 aa, Zea mays; identical to SEQ ID NO: 2271
  misc_feature: Ceres CLONE 322715-F
  misc_feature: SWISSPROT Homolog: EC 2.3.1.74 Naringenin-chalcone synthase

SEQ ID NO: 5607 - DNA, 491 bp, Zea mays
  misc_feature: Ceres CLONE 322719-F
  misc_feature: Encodes the peptide sequence at SEQ ID NO. 5608
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaacaacaagg

SEQ ID NO: 5608 - protein, 143 aa, Zea mays
  misc_feature: Ceres CLONE 322719-F
  misc_feature (24)..(143): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTTR

SEQ ID NO: 5609 - DNA, 475 bp, Zea mays
  misc_feature: Ceres CLONE 322728-F
  misc_feature: Encodes the peptide sequence at SEQ ID NO. 5610
ataaccatttcgctagctccatagcacttgttccagctagctaggagagagagctttgtttaggtaatttagctttgtgtatatcttcttggttctagctctttgaaattttttttatctgggtgcaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgcggcgcctttgatagtgacatgtcacgctcacgcggctacgccggcttcggcagcggcgctg

SEQ ID NO: 5610 - protein, 112 aa, Zea mays
  misc_feature: Ceres CLONE 322728-F
  misc_feature (62)..(90): Pfam Name: zf-RanBP Pfam Description: Zn-finger in Ran binding protein and others
  misc_feature (4)..(33): Pfam Name: zf-RanBP Pfam Description: Zn-finger in Ran binding protein and others
MNRKPGDWDCRACQHLNFSRRDACQRCSEPRGVGDRSGGGGDLGGRGGSSFGGGFGAGSDVRPGDWYCSCGAHNFASRSNCFRCSAYKEEAAAPLIVTCHAHAATPASAAAL

SEQ ID NO: 5611 - DNA, 483 bp, Zea mays
  misc_feature: Ceres CLONE 322731-F
  misc_feature: Encodes the peptide sequence at SEQ ID NO. 5612
aagatcgagcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggcggagatccggcggcgggggcggtcctggcgcgtgctacaagtgcggcgagcccggccacat

SEQ ID NO: 5612 - protein, 134 aa, Zea mays
  misc_feature: Ceres CLONE 322731-F
  misc_feature (6)..(73): Pfam Name: CSD Pfam Description: 'Cold-shock' DNA-binding domain
MAAAARQRGTVKWFNDTKGFGFISPEDGSEDLFVHQSSIKSEGFRSLAEGEEVEFSVSEGDDGRTKAVDVTGPDGSFVRGGGGGGGGGGGGYGSRGGGGSGGGGRSYGGSWGGGGDPAAGAVLARATSAASPAT

SEQ ID NO: 5613 - DNA, 443 bp, Zea mays
  misc_feature: Ceres CLONE 322774-F
  misc_feature: Encodes the peptide sequence at SEQ ID NO. 5614
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaa

SEQ ID NO: 5614 - protein, 114 aa, Zea mays
  misc_feature: Ceres CLONE 322774-F
  misc_feature (4)..(114): Pfam Name: Actin Pfam Description: Actin
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNP

SEQ ID NO: 5615 - DNA, 547 bp, Zea mays
  misc_feature: Ceres CLONE 322781-F
  misc_feature: Encodes the peptide sequence at SEQ ID NO. 5616
ctctcccgcagccgccacctcaacccaggaacagagcgaggcgacgccgcggcacctcttctccggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccacagttttgagac

SEQ ID NO: 5616 - protein, 153 aa, Zea mays
  misc_feature: Ceres CLONE 322781-F
  misc_feature (22)..(146): Pfam Name: Ribosomal_L28e Pfam Description: Ribosomal L28e protein family
LPQPPPQPRNRARRRRGTSSPVVRKNNSFLVKQFGNGNAKVQFTKEPNNLYNIHSFKHSGLANKKTVTIQPAAKDSAVVLSTTKTKKQNAPAKLSHKSVMRKEFRKMAKAVKNQVSDNYYRPDLTKPALARLSSVYRSLQVAKSGVKKKNRQS

SEQ ID NO: 5617 - DNA, 446 bp, Zea mays
  misc_feature: Ceres CLONE 322803-F
  misc_feature: Encodes the peptide sequence at SEQ ID NO. 5618
  misc_feature (442)..(442): n is a, c, t, g, unknown, or other
aktccacatccacagcacttttactgtcctctaaatttatctttgttgactttattaaaaaaagagattatcttcattttgcagctttgartcgcctctcagaaccgagatcctcaaaacccsttttsscctcctcccttctcccctctcggatcgagtgcttgavstccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggmccagcagaacatcaaccgcttcggtcgcctcaacaaccgcctccacgagctccaggaagagatcaagctcgcaaaggcagacgaatsagaaccttgatsatsctgggaatgarctcatcttntscg

SEQ ID NO: 5618 - protein, 46 aa, Zea mays
  misc_feature: Ceres CLONE 322803-F
  misc_feature (15)..(15): Xaa is any aa, unknown, or other
  misc_feature (44)..(44): Xaa is any aa, unknown, or other
MQQGDGTEAQVTWEXQQNINRFGRLNNRLHELQEEIKLAKADEXEP

SEQ ID NO: 5619 - DNA, 222 bp, Zea mays
  misc_feature: Ceres CLONE 322811-F
  misc_feature (126)..(126): n is a, c, t, g, unknown, or other
  misc_feature (203)..(203): n is a, c, t, g, unknown, or other
taggcgcacgagcggaacacgaacacgaacaccataacgcggcggccatggtcggcggcggcggcgacccaaggccggagacgagcccttctccgacggaacgccacggagtcggacaccgacgangtctcctccgcagggattagtgctcgccgccccggcccaccactaacccgatcctgactcgcctcgcgttgtcgsgnaacccgagcccgctggccg

SEQ ID NO: 5620 - DNA, 470 bp, Zea mays
  misc_feature: Ceres CLONE 322813-F
  misc_feature: Encodes the peptide sequence at SEQ ID NO. 5621
  misc_feature (149)..(149): n is a, c, t, g, unknown, or other
  misc_feature (389)..(389): n is a, c, t, g, unknown, or other
  misc_feature (396)..(396): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
aacgaaggatgtttctgaatctgaatccgaagaggatgatgatgatgatgaggatgaaagcggagacgatgaaaatggtggtgtagaagagtcaaagggcaggcgtggcgtaaacccgctaatagagggagaggcaggggaggcaaaanggcgacccctgaggcaaagcatctggaaggggcagaggccgccccaagaaaaccgagagttctgctcagaaagccggagaacctcgggcagaggaaaaassacgacggccacgcaagkatggtccgccctacagtaatgcggcgttgaaaatcagtaacgcctgakgtgatcccattgassattgaggattcattttggtacaatgcccgttgcactctgcccattttsstssactsstnattgttncagctatccaatcssaragacattrttagtctcttccccctcccccaatktccgaaatcnnntttgccatccca

SEQ ID NO: 5621 - protein, 94 aa, Zea mays
  misc_feature: Ceres CLONE 322813-F
  misc_feature (50)..(50): Xaa is any aa, unknown, or other
  misc_feature (83)..(83): Xaa is any aa, unknown, or other
  misc_feature (89)..(89): Xaa is any aa, unknown, or other
TKDVSESESEEDDDDDEDESGDDENGGVEESKGRRGVNPLIEGEAGEAKXRPLRQSIWKGQRPPQENREFCSESRRTSGRGKXTTATQXWSALQ

SEQ ID NO: 5622 - DNA, 130 bp, Zea mays
  misc_feature: Ceres CLONE 322834-F
agcgcgctaggcgacgagcggaacacgaacacgaacaccataacgcggcggccatggtgggcggcggcggcgacccaaggccggagacgagcccttctccgacggagacgccacggagtcggacaccgac

SEQ ID NO: 5623 - DNA, 126 bp, Zea mays
  misc_feature: Ceres CLONE 322862-F
gcaccgcactgcatcgaccagctacacgaatcagacggcgtcatggccggcacgtgcgcccacgtcgagttcctccgcgcgcagggcttgggcgctggtgctggccgccgtgggcctgctcgtggc

SEQ ID NO: 5624 - DNA, 387 bp, Zea mays
  misc_feature: Ceres CLONE 322883-F
  misc_feature: Encodes the peptide sequence at SEQ ID NO. 5625
  misc_feature (295)..(295): n is a, c, t, g, unknown, or other
cgcactcaccgccgccctcccgcccctcacctgcccgcgggagtgtcggagtaaaccctaccggacctatcgtcacgcgactgcgggagttgcttgcttcttctgccgctctctcgctccgtcccttccgcccatggagacctcgctgcgcttgcsatgggcggcggcctccgcatccacgccaaggagaagctgcccctcggccacagctcgctgctgcaggctcatgcggacgtccgacctccacacaagccccgccggagttactaccccgagttacctcgctctctttgtnaggcacttctactcgcagctatcagccaatctcggagctgggcgtccagttgcacaacggcgatgacctcgcctacatttttssgcgccaag

SEQ ID NO: 5625 - protein, 75 aa, Zea mays
  misc_feature: Ceres CLONE 322883-F
  misc_feature (8)..(8): Xaa is any aa, unknown, or other
METSLRLXWAAASASTPRRSCPSATARCCRLMRTSDLHTSPAGVTTPSYLALFVRHFYSQLSANLGAGRPVAQRR

SEQ ID NO: 5626 - DNA, 94 bp, Zea mays
  misc_feature: Ceres CLONE 322933-F
cgagaccagcgccagacgcagacggccccgaacgccggcgsaaggcatcaggtcgtcgactccgagcatcgacccgccgcgatggagaagggaa

SEQ ID NO: 5627 - DNA, 499 bp, Zea mays
  misc_feature: Ceres CLONE 322943-F
  misc_feature: Encodes the peptide sequence at SEQ ID NO. 5628
  misc_feature (361)..(361): n is a, c, t, g, unknown, or other
  misc_feature (397)..(397): n is a, c, t, g, unknown, or other
  misc_feature (446)..(446): n is a, c, t, g, unknown, or other
ctattctttctcccgttcacccgtgcacgctctttcccttcctcgtgccgacgaccgggcgaccgccgcgccccggcccgcgcccccttgtctcaggccactcgccggcaacgagcagccaccaggtccgcagatggcaccgacttttatggagctagcactcgagcaggctaagtttgcgctggataacctcgaggtccctgttgggtgtgtgattgtggaggacgggaaagtgatttcctctgggagcaacaagacgaatgccactcggaatgctaccagacatgctgagatggaagctattsacgtcctgcttcgggagtggcagagcatgggtcttgatcagccacaggtcgcgganaaatctccaggatscgacctttatgtcacgtgtganccctgtataatstgcgcgacggcattctcgataatycggataagagaantatactttggttttgccaacgacaattttsgtggatctggatcaatcatctca

SEQ ID NO: 5628 - protein, 122 aa, Zea mays
  misc_feature: Ceres CLONE 322943-F
  misc_feature (1)..(109): Pfam Name: dCMP_cyt_deam_1 Pfam Description: Cytidine and deoxycytidylate deaminase zinc-binding region
  misc_feature: SWISSPROT Homolog: EC 3.5.4.1 Cytosine deaminase
  misc_feature (58)..(58): Xaa is any aa, unknown, or other
  misc_feature (76)..(76): Xaa is any aa, unknown, or other
  misc_feature (81)..(81): Xaa is any aa, unknown, or other
  misc_feature (88)..(88): Xaa is any aa, unknown, or other
  misc_feature (92)..(92): Xaa is any aa, unknown, or other
  misc_feature (105)..(105): Xaa is any aa, unknown, or other
  misc_feature (115)..(115): Xaa is any aa, unknown, or other
MAPTFMELALEQAKFALDNLEVPVGCVIVEDGKVISSGSNKTNATRNATRHAEMEAIXVLLREWQSMGLDQPQVAXKSPGXDLYVTCXPCIXCATAFSIIRIREXYFGFANDNFXGSGSIIS

SEQ ID NO: 5629 - DNA, 419 bp, Zea mays
  misc_feature: Ceres CLONE 322976-F
  misc_feature: Encodes the peptide sequence at SEQ ID NO. 5630
  misc_feature (251)..(251): n is a, c, t, g, unknown, or other
ctcgccgagaaagaaaaacagacacacgtcactgttcgccttgcccggtcgtttctgctccattcctcctcctgcaagccgcaaaggaatcaggcggagtggcgcgatgggagagcaggtcgtgacggagcagatccagcggaagttggaggaggtcaacgctaccgtccaacagcacctcgcgggtgtccaggaccacatcaacttcaccatgcagcaagcatacttcaagtgcgcatatggttgctttnatcggcgccatactcaggaagcgatcagcaactgtgtgtagaattscagtgtgcctgtccttgctgccaacaatgtttttgagagtgagatggccaagtttcagggaatbsttgaaccggtcattgagggtctctcaagataagtktgargctgccaatctccagaag

SEQ ID NO: 5630 - protein, 61 aa, Zea mays
  misc_feature: Ceres CLONE 322976-F
  misc_feature (49)..(49): Xaa is any aa, unknown, or other
MGEQVVTEQIQRKLEEVNATVQQHLAGVQDHINFTMQQAYFKCAYGCFXRRHTQEAISNCV

SEQ ID NO: 5631 - DNA, 366 bp, Zea mays
  misc_feature: Ceres CLONE 322986-F
  misc_feature (124)..(124): n is a, c, t, g, unknown, or other
  misc_feature (132)..(132): n is a, c, t, g, unknown, or other
  misc_feature (208)..(208): n is a, c, t, g, unknown, or other
  misc_feature (297)..(297): n is a, c, t, g, unknown, or other
  misc_feature (300)..(300): n is a, c, t, g, unknown, or other
aatcggcctcgtcgcagtcggggccacctgctccgggtcccaacaagccgtccacagccggatccscgcycgctattaaaggcgcggcggggggaggcatcgtcctctccgtgctttctcagangcgggttngcttctcctcccccaccggttcgtgttcaggttctggttcgtgggcgagagggaagagatgcggcgtcggacgttnagtaccgttgcttcgttggcggcctcgctgggccaccgacgaccackccctcaacaacgccttcagcacctacggcgaggtcctcgagntcnaagatcatcctggatcgggagacgcagaggtcccgcggcttcgggcttcgtcaccttctccacgga

SEQ ID NO: 5632 - DNA, 1095 bp, Zea mays
  misc_feature: Ceres CLONE 323011
  misc_feature: Encodes the peptide sequence at SEQ ID NO. 5633
gaatcccacacgcgtccagcagcaactgactgctcgtccgttctacgtttcttggccaccatggacctggaacgcggcgacaagaagccgccgccgccgccgccgcccgctccacggaccgctgctgcgaccactacgacgacgacgacgccggcctgcagcggtaagaagcggccgccgctcagggacagcctcgtggcgctgcagccggtgctgctgcgcgcggcggcggccctagccgcggccgccgccgccgcggtgatggcgctcgacgcccagtcctacaccgcggtggtcgccatcgtcggcacccgcccgctcacgcagaccttcactgccaagttcagcgacacgccggcgttcgtgtacttcgtcatagccaacgccatcgctgccgcgtacaacctcctggtgctgctcgtccggcgccggcggaggactacggcgggcttggtcgtgcgcatgcttgacatggtggtcatggcgctgctggcgaccggcgccgccgcggcggcgtcgatggccgagctaggaaggaacggcaacgcgcgcgcgcggtggaacccggtgtgcgacaggttcggctccttctgccgccgcggcggcgccgcgctggcggcgtcgttcgtcggcgtcgcgctcatgctggcgctcaacctgctctcagccgcgtccggtgccgggtgctagctccgcgggccagtgagtggcccgtgccgtcccagacagctctgtactcatgaggggccgtgggggagctgaatcgcggcgtgaaactggagttctgccggtgcacgtttggtgtagaattatttgcatttcttcaacatgtgagtttgaaatgggtttcttggttcttacaaaaaaaaaacataatgaaccatgtcatacctctgcatctgaatgtaagtcaacacaaatgttgccttatccgctcagaagcaagaggtgtcgtggtgtagttggttatcacgtcagtctaacacactgaaggtctccggttcgaacccgggcgacgccatgttttgtttgtttatttttttgtgccctgttttgcgttgtcggctgatttttttcccccgaaaaaaaaaaaaa

SEQ ID NO: 5633 - protein, 209 aa, Zea mays
  misc_feature: Ceres CLONE 323011
  misc_feature (43)..(194): Pfam Name: DUF588 Pfam Description: Domain of unknown function (DUF588)
MDLERGDKKPPPPPPPAPRTAAATTTTTTTPACSGKKRPPLRDSLVALQPVLLRAAAALAAAAAAAVMALDAQSYTAVVAIVGTRPLTQTFTAKFSDTPAFVYFVIANAIAAAYNLLVLLVRRRRRTTAGLVVRMLDMVVMALLATGAAAAASMAELGRNGNARARWNPVCDRFGSFCRRGGAALAASFVGVALMLALNLLSAASGAGC

SEQ ID NO: 5634 - DNA, 242 bp, Zea mays
  misc_feature: Ceres CLONE 323020-F
  misc_feature: Encodes the peptide sequence at SEQ ID NO. 5635
  misc_feature (73)..(73): n is a, c, t, g, unknown, or other
aaccctagccaccgttggtgcctcggcggcatgcctcgtttgcyttcgtctccgctcggtacgccgcggatgnaggcggacttcctccgcatctccgcctcgcaggaagaccttctcgcccgcgcccccttcatcaccttcgacccggaggaggaggaggaggaggccgaggtgtccagtacgccgcctctcacacaccaggccccgcagaggcagggggaagagggcatcgcatgtgctcc

SEQ ID NO: 5635 - protein, 57 aa, Zea mays
  misc_feature: Ceres CLONE 323020-F
  misc_feature (2)..(2): Xaa is any aa, unknown, or other
MXADFLRISASQEDLLARAPFITFDPEEEEEEAEVSSTPPLTHQAPQRQGEEGIACA

SEQ ID NO: 5636 - DNA, 374 bp, Zea mays
  misc_feature: Ceres CLONE 323025-F
  misc_feature: Encodes the peptide sequence at SEQ ID NO. 5637
atcagcgagccaaacatgcccgtccgcccagtctcgctccaaaccaaagccatcggaggagcaactggacgaccatggcctcgccgctgctcaagtcacactctcagctcgccgccgccgccgccctgcactccgtgaggaagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtsgagcacgtggacatctcgcgggactacgtcgtgaccaagtccatctggcatctcagcgacgtagccctcaagagcgtctataccttctacg

SEQ ID NO: 5637 - protein, 124 aa, Zea mays
  misc_feature: Ceres CLONE 323025-F
SASQTCPSAQSRSKPKPSEEQLDDHGLAAAQVTLSARRRRRPALREEADRCPATLHLGKFHDHGLRSGRSKRSGSARVGAFPSLDVVPLMVTMVEHVDISRDYVVTKSIWHLSDVALKSVYTFY

SEQ ID NO: 5638 - DNA, 414 bp, Zea mays
  misc_feature: Ceres CLONE 323032-F
  misc_feature: Pfam Name: Cytochrom_B561 Pfam Description: Cytochrome b561
aaggctgaagagagagagatcgaaaagggattatagtagctgggtttggtttgtggctggctggctggctggataccacaccggtaatagcggccgagagagcaaccacgtccacggccatttaactgtcatctctcctcctgatttccttctctcctttcctttttgctccgatccgatccgatcaatgaccaagtgaagggtggttcggtggacgcgcgcacgctggtggcgcacgtcctggcagcgggcgccgtcgtgctggtgctcctgtggtgcatccacttccgcggcggcctcgcctccgctcccaggacaagccgctcatcttcaacgtccaccccgtgctcatggtcctcggccccatcgtcctcggcggagaagccatcctcagctaccggtctctcccgctcg

SEQ ID NO: 5639 - DNA, 217 bp, Zea mays
  misc_feature: Ceres CLONE 323037-F
  misc_feature: Encodes the peptide sequence at SEQ ID NO. 5640
  misc_feature (99)..(99): n is a, c, t, g, unknown, or other
  misc_feature (101)..(101): n is a, c, t, g, unknown, or other
  misc_feature (184)..(184): n is a, c, t, g, unknown, or other
atcctcgttcctatcgccagttcgccacctcctttgctctcgcctcgcgcgcgctcccccccgcgcatcgtgccgttcgccaccgcaccggccgatkknangtcgccgccgtgcccagatccgccgcggcctgccgtgcgggccccctgctcccggccgtccgagccgctgcgtgccacctggncctgccccggcgcgcgttctccgcatccgtcgc

SEQ ID NO: 5640 - protein, 71 aa, Zea mays
  misc_feature: Ceres CLONE 323037-F
  misc_feature (32)..(32): Xaa is any aa, unknown, or other
  misc_feature (33)..(33): Xaa is any aa, unknown, or other
  misc_feature (61)..(61): Xaa is any aa, unknown, or other
PRSYRQFATSFALASRALPPAHRAVRHRTGRXXVAAVPRSAAACRAGPLLPAVRAAACHLXLPRRAFSASV

SEQ ID NO: 5641 - DNA, 196 bp, Zea mays
  misc_feature: Ceres CLONE 323052-F
  misc_feature (108)..(108): n is a, c, t, g, unknown, or other
  misc_feature (110)..(110): n is a, c, t, g, unknown, or other
  misc_feature (120)..(120): n is a, c, t, g, unknown, or other
gactccaactctccctctctccttcgcctggcacatcctcggcagcgtggcagcctgcttcttcaccggcgcggcggcttgcttcttcgacgacgcggaggcctgcancngcctaccgancggacggatccgcggacgaacggatctccggcgcctggcagatcttcggcgcgcggcctaccggttgtggacggat

SEQ ID NO: 5642 - DNA, 237 bp, Zea mays
  misc_feature: Ceres CLONE 323100-F
ctggcttgctcgcatttcatgccatcgcgggatcgccattgcagcgctcactttaatttacgcagccagcggatgccgaccctcacctccgatgccatcatcgcgtccccgaggtggggcgtcctccccttatgcggcggcggcsstccggggcggaccgcgcactcgccgcccgtcgtcgtccggcgggcacggctgcgggtggccgccgctggaccgcgtggccgtctgggtcgg

SEQ ID NO: 5643 - DNA, 381 bp, Zea mays
  misc_feature: Ceres CLONE 323109-F
  misc_feature: Encodes the peptide sequence at SEQ ID NO. 5644
agattgcsatacacatccatccatccatccatccatccatccctaaaaatcaaggctacacaccaacttactttctaggtctcarattaaatggcctcctcgtcctcctccttgctgctggcgtcgatggcggtggcggcactctttgtcgtcggctcgtgtggcggcgcgctcaccttcacgatcggcaaggactccagctctaccaaactatccctcgtcactaacgttgccatctccgaggtgtcggtcaaggagaagggcgccctggactggtcggatgatctcaaggagtcgccagccaaaaccttcaccctcgatagcaaggagccgattaagggccccatctccgtccgcttcgctgtgaaaggtggtggctac

SEQ ID NO: 5644 - protein, 97 aa, Zea mays
  misc_feature: Ceres CLONE 323109-F
MASSSSSLLLASMAVAALFVVGSCGGALTFTIGKDSSSTKLSLVTNVAISEVSVKEKGALDWSDDLKESPAKTFTLDSKEPIKGPISVRFAVKGGGY

SEQ ID NO: 5645 - DNA, 246 bp, Zea mays
  misc_feature: Ceres CLONE 323162-F
  misc_feature: Encodes the peptide sequence at SEQ ID NO. 5646
  misc_feature (47)..(47): n is a, c, t, g, unknown, or other
attgctttgctcattctcgtgctcggcaggggaacggtgcgamgganggagcggcgatgcagatccgggtcagtgcgcgtgcggcgagtcgtcgtgcccggaatggccgtcgtggggctgcagggcgtggtgcagccgcassstccttcgccggcgacatccggggactccacatcggccgcctctgctcctccccttccccagcctccgcctcgtccaaggcaggtttcaccttcacggtggggt

SEQ ID NO: 5646 - protein, 81 aa, Zea mays
  misc_feature: Ceres CLONE 323162-F
  misc_feature (14)..(14): Xaa is any aa, unknown, or other
  misc_feature (15)..(15): Xaa is any aa, unknown, or other
  misc_feature (47)..(47): Xaa is any aa, unknown, or other
CFAHSRARQGNGAXXGAAMQIRVSARAASRRARNGRRGAAGRGAAAXSFAGDIRGLHIGRLCSSPSPASASSKAGFTFTVG

SEQ ID NO: 5647 - DNA, 165 bp, Zea mays
  misc_feature: Ceres CLONE 323164-F
  misc_feature (50)..(50): n is a, c, t, g, unknown, or other
  misc_feature (51)..(51): n is a, c, t, g, unknown, or other
  misc_feature (109)..(109): n is a, c, t, g, unknown, or other
  misc_feature (110)..(110): n is a, c, t, g, unknown, or other
aacgaactccagaaataatccgccctcgtatcctcacgcccacaaaacanncgaagaaaagaagagactgaacgccgcgagttcacgtgacgatggagaacgccgcctnngccatcgctaagccgtcgctgtccaagaagccctcgccgtcgttccgcctccgga

SEQ ID NO: 5648 - DNA, 290 bp, Zea mays
  misc_feature: Ceres CLONE 323171-F
  misc_feature: Encodes the peptide sequence at SEQ ID NO. 5649
  misc_feature (40)..(40): n is a, c, t, g, unknown, or other
  misc_feature (41)..(41): n is a, c, t, g, unknown, or other
  misc_feature (99)..(99): n is a, c, t, g, unknown, or other
  misc_feature (100)..(100): n is a, c, t, g, unknown, or other
agaaataatccgccctcgtatcctcacgcccacaaaacanncgaagaaaagaagagactgaacgccgcgagttcacgtgacgatggagaacgccgcctnngccatcgctaagccgtssgctgtccaagaagccctcgccgtcgttccgcctccggaacgcagcctcaacgcactgcgcctgcgccgcgtgttcgacctcttcgaccgcaacggcgacggcgagatcagcctcgacgagatggcctcggcgctcgacgcgctcggcctcggcgccgaccgctccggcctgg

SEQ ID NO: 5649 - protein, 69 aa, Zea mays
  misc_feature: Ceres CLONE 323171-F
  misc_feature (32)..(60): Pfam Name: efhand Pfam Description: EF hand
  misc_feature (6)..(6): Xaa is any aa, unknown, or other
  misc_feature (12)..(12): Xaa is any aa, unknown, or other
MENAAXAIAKPXAVQEALAVVPPPERSLNALRLRRVFDLFDRNGDGEISLDEMASALDALGLGADRSGL

SEQ ID NO: 5650 - DNA, 172 bp, Zea mays
  misc_feature: Ceres CLONE 323176-F
gaaaccgaacttgacaacttgtagatacgtgggcctcgtgacgggcgctttccccatctccacatcgccgccccgcgcasstaccgcatcggcgacggcgatgagacacgggacgaggctgctctgcacactagcgctgacgctgctatgcgtggccacccacttccagggt

SEQ ID NO: 5651 - DNA, 154 bp, Zea mays
  misc_feature: Ceres CLONE 323177-F
accagaatcccccgtcgacgcgcacsscagagctccgcatccgcaccggccgccggcggbtgggatggggaagctctccgccctgaagcgggaagsgtcggattggactaggcgctcggtgacttcctagtttagaagcggtaggtggaggcga

SEQ ID NO: 5652 - DNA, 391 bp, Zea mays
  misc_feature: Ceres CLONE 323202-F
  misc_feature: Encodes the peptide sequence at SEQ ID NO. 5653
  misc_feature (306)..(306): n is a, c, t, g, unknown, or other
atgaacctccagctttctctctctccttccctcctctccagttccacagaaggctccgtgcctagatcccgtggagaatgtgttggggatcaaggagtggttgattggatccatcccctcacgtgcttccctcatcaagtttcaaatccccatctgcgcgaggaactcctctctcaagatggttgcacggaggaatccatccattattgaagaaggtagtggatctgaagaaatccaggtggagcgtcctcgccgctcccagaccggtcatggtagaggccaagctcggggagatgttggtgggantagttctcaacaacctgaaatcgtccatgccgctcgagaagaacctgtccctcagccacctctscatccatcttcatcacgggct

SEQ ID NO: 5653 - protein, 71 aa, Zea mays
  misc_feature: Ceres CLONE 323202-F
  misc_feature (43)..(43): Xaa is any aa, unknown, or other
MVARRNPSIIEEGSGSEEIQVERPRRSQTGHGRGQARGDVGGXSSQQPEIVHAAREEPVPQPPLHPSSSRA

SEQ ID NO: 5654 - DNA, 277 bp, Zea mays
  misc_feature: Ceres CLONE 323211-F
  misc_feature: Encodes the peptide sequence at SEQ ID NO. 5655
ragctgctattgacagtatggtcaatgacaccttaatggatcatgatggtaagataatgagaaggcggacacatctgccaagaaaagcaagaaaaagaagaccaaaaccgagactgatggtgatgcaatggatgtggataagccctccaacgtggctgatggagaagctgagcttgtaaccgagaagaagaaaaagaaaaagaagcacaagctagaggaggcacaggaggagaacggtgcagcacatgctaatggcgacgctgaagagacccagact

SEQ ID NO: 5655 - protein, 50 aa, Zea mays
  misc_feature: Ceres CLONE 323211-F
MDVDKPSNVADGEAELVTEKKKKKKKHKLEEAQEENGAAHANGDAEETQT

SEQ ID NO: 5656 - DNA, 419 bp, Zea mays
  misc_feature: Ceres CLONE 323213
  misc_feature: Encodes the peptide sequence at SEQ ID NO. 5657
ggctgctgtctgtttgttgtgttagggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtggattcgaccaggctggctcgcgccaggcgctccttagtgcaccaaccaatcatgtggaatgtaaccctaaaaatgtcttaattatgatagtagcaaagtagttataaaattacagcaaaatatacatctcatgtgtgttgtgtattctggactttaccagttggacttgattattatagtagcatatgttatccttccaaaaaaaaaaaaaaaaaa

SEQ ID NO: 5657 - protein, 66 aa, Zea mays
  misc_feature: Ceres CLONE 323213
MSRSGQPPDLKKYMDKKLQIKMNANRVVIGTLRGFDQAGSRQALLSAPTNHVECNPKNVLIMIVAK

SEQ ID NO: 5658 - DNA, 378 bp, Zea mays
  misc_feature: Ceres CLONE 323285-F
  misc_feature: Encodes the peptide sequence at SEQ ID NO. 5659
  misc_feature (332)..(332): n is a, c, t, g, unknown, or other
agcagaaggggaagagtcagcaatggaggcgagggttgcaggagtgcccgaagacgaagagtctggcctcctcccccgcccgtccgcagccggccgacggctcctcccgcggcccccgcttcccgcctccaccggcagcctgggcgacggtggacggtcccctcgggcttccgctggaggacgcggagggccacgccgccgtttcttcatgtggggtttcgcgtgcytccccttcctctgggccatcaactgctgctacttctgggcccgtcctccgctcgtcggtcgcctcctcgcccgccgccttcgcccccatccgcccatattttttncggtcggcaattgggcttcaccatcttctccgtttttctggtcacc

SEQ ID NO: 5659 - protein, 118 aa, Zea mays
  misc_feature: Ceres CLONE 323285-F
  misc_feature (69)..(69): Xaa is any aa, unknown, or other
  misc_feature (104)..(104): Xaa is any aa, unknown, or other
MEARVAGVPEDEESGLLPRPSAAGRRLLPRPPLPASTGSLGDGGRSPRASAGGRGGPRRRFFMWGFACXPFLWAINCCYFWARPPLVGRLLARRLRPHPPIFFXVGNWASPSSPFFWS

SEQ ID NO: 5660 - DNA, 167 bp, Zea mays
  misc_feature: Ceres CLONE 323296-F
gaatatgggaaacatctcgccactgacagggtcacaaggtgagatcaggaagaactgcaggaggctcaacaatssaccactgagggyactgaagtcgcttgatgtgctgaattgttcgtgatgttggtggcgtattttctttcaaactaagtaagcatggctgtgat

SEQ ID NO: 5661 - DNA, 472 bp, Zea mays
  misc_feature: Ceres CLONE 323300-F
  misc_feature: Translation starting site: 81
  misc_feature: SWISSPROT Homolog: EC 1.11.1.11 L-ascorbate peroxidase
  misc_feature: SWISSPROT Homolog: EC 1.11.1.5 Cytochrome-c peroxidase
  misc_feature (437)..(437): n is a, c, t, g, unknown, or other
agcagatcttgtgaccctccctcagccgcgtcgsstcgcatcctacgatccaaagctctctctggtcgcaggtcgcagccatggcgaagaactacccgaccgtgagcgccgagtacagcgaggctgtggacaaggccaggcgcaasstccgagccctcatcgccgagaagagctgcgccccgctcatgctccgcctcgcgtggcactccgcggggacgttcgacgtgtcgtcagggaccggcggtcattcggcacgatgaagcatcagtcggaattggctcacggcgctaacgcggggctggacatcgcggtgcgtctgctcgagcccatcaaggaggagttcccaatcctctcttacgccgatttctaccagctcgcgggagttstcgccgtggaggtcaccggtggcctgagattcccttccaccccggtaggangacaagcctcagcccccacctgaggccgccttcct

SEQ ID NO: 5662 - DNA, 407 bp, Zea mays
  misc_feature: Ceres CLONE 323303-F
  misc_feature: Encodes the peptide sequence at SEQ ID NO. 5663
  misc_feature (46)..(46): n is a, c, t, g, unknown, or other
  misc_feature (141)..(141): n is a, c, t, g, unknown, or other
  misc_feature (239)..(239): n is a, c, t, g, unknown, or other
  misc_feature (347)..(347): n is a, c, t, g, unknown, or other
  misc_feature (403)..(403): n is a, c, t, g, unknown, or other
agtgaagtcgccggcgccgsscgacaggaggaaggagcagcagcgncaggggaggcccggcgatctcttctgttgcgtgcggcgagggagtaaaaggagccgcgacaggatgcactcctttgggcaccgcgccaacggtgncaacgttcgcggtcaccatactggccgcgatttgcttcgccgcctccttctccgacaacttcaacaccccgacacccactgcctccgttaagatcttnaatctaaactggttccagaaggaggccaacggcaacgacgaggttagcatgacgctgaacatttcggccgacctttcgtctcttttcacgtggaacacaaaacaggtntttatttttgtggcagcagagtatgagactccacagaatgctttgaatcaattttncctt

SEQ ID NO: 5663 - protein, 40 aa, Zea mays
  misc_feature: Ceres CLONE 323303-F
  misc_feature (39)..(39): Xaa is any aa, unknown, or other
MTLNISADLSSLFTWNTKQVFIFVAAEYETPQNALNQFXL

SEQ ID NO: 5664 - DNA, 350 bp, Zea mays
  misc_feature: Ceres CLONE 323306-F
  misc_feature: Encodes the peptide sequence at SEQ ID NO. 5665
  misc_feature (129)..(129): n is a, c, t, g, unknown, or other
  misc_feature (219)..(219): n is a, c, t, g, unknown, or other
  misc_feature (223)..(223): n is a, c, t, g, unknown, or other
  misc_feature (234)..(234): n is a, c, t, g, unknown, or other
  misc_feature (237)..(237): n is a, c, t, g, unknown, or other
aaaaacctaacgctctccgccgccacttctcctccggcatcgacgaggcgavsccagcgcccgagtccctctccctgctcccacgacccatggcggcggatatggcgtacgcgccgccgatgaaggcgngcaaggccgggttcgaggctggcatcatggatccgcagcacaggatccgcatcacgctctcctccaagagcgtcaagaacctcgagaaantctncggggatctcngtnaagggcgccaagggtaaggacctcaaggtcaagggccccgtgcggatcctaccaaggtgctccacatcaccaccaggaagtctccctgtggagaaggtaccaacacctgggat

SEQ ID NO: 5665 - protein, 54 aa, Zea mays
  misc_feature: Ceres CLONE 323306-F
  misc_feature (14)..(14): Xaa is any aa, unknown, or other
  misc_feature (44)..(44): Xaa is any aa, unknown, or other
  misc_feature (45)..(45): Xaa is any aa, unknown, or other
  misc_feature (49)..(49): Xaa is any aa, unknown, or other
  misc_feature (50)..(50): Xaa is any aa, unknown, or other
MAADMAYAPPMKAXKAGFEAGIMDPQHRIRITLSSKSVKNLEKXXGDLXXGRQG

SEQ ID NO: 5666 - DNA, 254 bp, Zea mays
  misc_feature: Ceres CLONE 323334-F
  misc_feature (74)..(74): n is a, c, t, g, unknown, or other
  misc_feature (75)..(75): n is a, c, t, g, unknown, or other
  misc_feature (142)..(142): n is a, c, t, g, unknown, or other
  misc_feature (248)..(248): n is a, c, t, g, unknown, or other
atcgccgctgctcgctcgcgttcgcggcgccctcgctccctgtcactccctcgtccccgccccatccacgccgnntcgccctccgcctccaaataaagtaaatgcgggtgacaggacgccaccaccaaatccacctgcgcgncttaacccatcgccgccccgctcgwtcccctccgccttcttcgccgccggcccccggactgcgaacgtcccaggagcctagaaggacccggcgccatggggttctnggagtt

SEQ ID NO: 5667 - DNA, 303 bp, Zea mays
  misc_feature: Ceres CLONE 323337-F
  misc_feature: Encodes the peptide sequence at SEQ ID NO. 5668
  misc_feature (129)..(129): n is a, c, t, g, unknown, or other
  misc_feature (136)..(136): n is a, c, t, g, unknown, or other
tttgtctcctgaagcaagcgcmraattgccagctcttcccgcttttcccctcacccgccgcccatccgatgccagacgccgcggtcgcctcgtcctttccctcgtcgtcttcgttgctgtctccgccgncgcagynctcgcctacctatctttcccctctgccgggcggacatcgccccggcgttccggacggaggtcgactgctgcaggggtatggagggcctcgagctctggggcccggcggtcaagtggggctcagaccaccgcctgccctccgccgccgcctgctgcgccgcctgcaag

SEQ ID NO: 5668 - protein, 30 aa, Zea mays
  misc_feature: Ceres CLONE 323337-F
MEGLELWGPAVKWGSDHRLPSAAACCAACK

SEQ ID NO: 5669 - DNA, 374 bp, Zea mays
  misc_feature: Ceres CLONE 323354-F
  misc_feature: Translation starting site: 103
  misc_feature (6)..(6): n is a, c, t, g, unknown, or other
  misc_feature (312)..(312): n is a, c, t, g, unknown, or other
atcaanatargrcttcacacgcacaacsscgccgccgcacgccgggatctcgatagactctggctgccgcggaaasgaaagaatgcagggatcgtggccaagatgcagatcttcgtgaagacgctgtcgtcgacaaggacgatcacgctggaggttgagccttcggacacggtggcggacgtgaaggccaaggtgtacgagtccgagggcgtcccgcggccgagcagcgcctcatcttcgcggggaagcagctgcgcgacggccacacgctggctgactacaacatccsscaaggagacgatgctgtccttntgctgccgcctcctcggaggccgttaagaagcgcaatagaaagacgttcaccactcccaaga

SEQ ID NO: 5670 - DNA, 801 bp, Zea mays
  misc_feature: Ceres CLONE 323359-R
tcgaggtcgacggtatcgataagcttttttttttttttttttgaaaaatggcaacattgatttaattcccctttacttttgcaacacaagaaatctagtcatcacaagtctcgttggcagcttccaaaactaaaaggagttggagaagatttaccacaatacgtagacatatattagctaaaccctgaatctgtatagtataatcaacatcacatcgaggagaaaatgaatgggagatggctgcattcccatgtcatccacgtggtcgtctagagctcaaactcctcctcacggagcgccatctctgcggcttcctcatcatcctcgtcaagtgcgaagtactggttcctctcagctggcctgaacatgtagaacatgaacatgccccaacgccatggtggccacctcctccgctgcaacgctgacccatctgtacttgtagttagtaattgtcttgagggcatacacaatgatcctggtgaagtagaggtatccaataacggccacatagaactggcggaagagcatgagcttggcaagggttctggctgccttgccgtctgtcttggatgactcccgcagagggcgcatcgaccaccccactgggaaagagacagcacagcagcaagcggactcaacaaacaagaagatctggttccatgtcacccatccctgcaagaaaaggaccgtctcgcccaaccacagcagcaagcgattgtttgctgcaaccctgcaggagggatcacccaccctggaacatttttcttccccttggtcccgggaaggaatgtggcttcaggg

SEQ ID NO: 5671 - DNA, 119 bp, Zea mays
  misc_feature: Ceres CLONE 323362-F
gaatagaggacagctagctgcagcatcccgtccaacagcaggaccarcgaaggtttacctccgcctcgcgagtcgggaccatgtggacgggcagcccgctgctccgggacgttggcgcc

SEQ ID NO: 5672 - DNA, 361 bp, Zea mays
  misc_feature: Ceres CLONE 323369-F
  misc_feature (158)..(158): n is a, c, t, g, unknown, or other
aacgtacgagtgcaggaaacaagataagtcgcggtttgcgaggcgagaagccggatgagtgtccactgtccacaagtccagattccaattccagtccgatcgtgagctcagctcagctccgctagtcctctccccgcacgcaccaccaccagcagcankscagcaccatgggcggcgcctgctcctcacgctgctcctcgcggccgtgccctctccttgggcggcggcggcggcgcgcacccgggctactccgacgacgacgagagcgcctgcacggtggacgcgggcgcgaasstgctgcggcggatggaggagcgcgggcccgacagcgcatcatcgacatcacgcacgcggtcgtssc

SEQ ID NO: 5673 - DNA, 275 bp, Zea mays
  misc_feature: Ceres CLONE 323386-F
  misc_feature: Encodes the peptide sequence at SEQ ID NO. 5674
  misc_feature (41)..(41): n is a, c, t, g, unknown, or other
  misc_feature (55)..(55): n is a, c, t, g, unknown, or other
  misc_feature (113)..(113): n is a, c, t, g, unknown, or other
gcaggcctaggcttttttgaggagcgcggactagggagtanggagacgggacggnagagagagagagaggcgcgtgcgttcgtggtcggtgccggtgcgtgcgtggcgtggtngccgctgccgtacgtgatccgtccaccccctctcctcttccgacgccggcgacassgggaggtactcgggggaggaatggccgtggcaagggctccgctcggcgcggttgctgcgatggcggtggccgctctcgtcttcgccatactcatgaccgccgccgc

SEQ ID NO: 5674 - protein, 91 aa, Zea mays
  misc_feature: Ceres CLONE 323386-F
  misc_feature (14)..(14): Xaa is any aa, unknown, or other
  misc_feature (19)..(19): Xaa is any aa, unknown, or other
  misc_feature (38)..(38): Xaa is any aa, unknown, or other
  misc_feature (56)..(56): Xaa is any aa, unknown, or other
  misc_feature (57)..(57): Xaa is any aa, unknown, or other
AGLGFFEERGLGSXETGRXREREARAFVVGAGACVAWXPLPYVIRPPPLLFRRRRXXEVLGGGMAVARAPLGAVAAMAVAALVFAILMTAA

SEQ ID NO: 5675 - DNA, 387 bp, Zea mays
  misc_feature: Ceres CLONE 323390-F
  misc_feature: Translation starting site: 53
  misc_feature: Pfam Name: PurA Pfam Description: PurA ssDNA and RNA-binding protein
  misc_feature (372)..(372): n is a, c, t, g, unknown, or other
gtttaaacccaaaccctaattgcgacctctgttcccccaaaaccctacggccatggacggcggaggcggtggtgtagggggaggcggagttggggcaggtgtcatggtgggcggcggcgttggcgttggcgttggcggagacgtggagctcgtcagcaagacgctgcagttcgagcacaagctgttctacttcgatctgaaggagaacccgcggggaggtacctcaagatctccgagaagacctcggccacgcgctccaccatcatcgtccccgtcgacggcgtggcctsgttcctcgacctcttcgactactacatccgcaccgacgagcgcgacgccttcagcaaggagctgcgactccagaccaaggtnttctatttcgatatc

SEQ ID NO: 5676 - DNA, 348 bp, Zea mays
  misc_feature: Ceres CLONE 323419-F
  misc_feature: Translation starting site: 160
  misc_feature (69)..(69): n is a, c, t, g, unknown, or other
  misc_feature (163)..(163): n is a, c, t, g, unknown, or other
  misc_feature (230)..(230): n is a, c, t, g, unknown, or other
  misc_feature (303)..(303): n is a, c, t, g, unknown, or other
  misc_feature (321)..(321): n is a, c, t, g, unknown, or other
caaaaaattagggagttttcttctcccgtccaccttgcgtgctcgcgcgcgavtcctcgtggcgcssrnactaggcgaccgcgccgcccctacgccacgtgctcgagtctagcctcgtcgattgcttccccagtttaattgatctacaagcttcagaacatgnttcaagaatacatttcagttctgggttcctgtccattctttatagcctcgggaccaagccattgcanatatgggataaggaagttgtgaatgggcacattaaacgaccccaagatgaagatatccaatctaatgtacttnaaattgttggaacaaatntacagtcaacttacatcacatgcscag

SEQ ID NO: 5677 - DNA, 427 bp, Zea mays
  misc_feature: Ceres CLONE 323422-F
  misc_feature: Encodes the peptide sequence at SEQ ID NO. 5678
  misc_feature (272)..(272): n is a, c, t, g, unknown, or other
  misc_feature (274)..(274): n is a, c, t, g, unknown, or other
  misc_feature (276)..(276): n is a, c, t, g, unknown, or other
aagcagcatcgcctcccaagtccacaaaccacaacttacgccgccgctcgctccaccgcgcaagagtctgctgctgccgctcacccacccccgctcgcgcagaaggccgccgcagctctcactactggtgccctaaacgccgatatccctcttcgcctccctttccccacccaaaaccccggccttcagggttccggcaccatgccgcaggagatcacatcgagctgcaccagaagcgccatggcaagcgcctggaccacgaagagcgcaananansggaggcccgcgaggtgcacaggcgctcgaaggatgcccgcaatytgattggtgctaagggcaagaggttcgccaagaaacgctatgctgagaaggcacagatgaagaagaccctgaaarkgcacgacgaatcarataarcgacagaaggt

SEQ ID NO: 5678 - protein, 141 aa, Zea mays
  misc_feature: Ceres CLONE 323422-F
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (132)..(132): Xaa is any aa, unknown, or other
  misc_feature (137)..(137): Xaa is any aa, unknown, or other
AASPPKSTNHNLRRRSLHRARVCCCRSPTPARAEGRRSSHYWCPKRRYPSSPPFPHPKPRPSGFRHHAAGDHIELHQKRHGKRLDHEERXXXEAREVHRRSKDARNLIGAKGKRFAKKRYAEKAQMKKTLKXHDESXKRQK

SEQ ID NO: 5679 - DNA, 218 bp, Zea mays
  misc_feature: Ceres CLONE 323423-F
  misc_feature: Encodes the peptide sequence at SEQ ID NO. 5680
gaagaagccgcgtgcgtgttatcctttgagcagtttgggcgctgagcaagtccagtgagagagggagagcggcgagaggatggctgggatggcgtcgctgcagggcgccatggcgtcgctctccatctccgcgctaggcgscgacggcgagcagcagcagcttctggggcaaccggctcgccacctactccgcgccgcagcctgggggtaaggtttat

SEQ ID NO: 5680 - protein, 43 aa, Zea mays
  misc_feature: Ceres CLONE 323423-F
  misc_feature (21)..(21): Xaa is any aa, unknown, or other
MAGMASLQGAMASLSISALGXDGEQQQLLGQPARHLLRAAAWG

SEQ ID NO: 5681 - DNA, 383 bp, Zea mays
  misc_feature: Ceres CLONE 323428-F
  misc_feature: Encodes the peptide sequence at SEQ ID NO. 5682
catttccttcgttcggtcgtttccctactatcctcctcgcgttcatctcgcccgtacgccgacgctgccgcctggskcgcaccgcccgccggcagtgcctcagtccagatcaagcccctcttcccagatcgggtcctagttgggctaccgcagccctacgccaggtgccgagtccctcgccgatttcttcggcggcgaagagtgcccaccagatccgcccctgatggacaacgtcgagtctgcccctgactcgccggcgcaggcgccgccgtcatccgcctcttctctccccaaggagcaatcgcaggttggaattggagctgaggctgcttcaggctcttgagttctaccctccatcaaaactcaaaggcgttcaccggcat

SEQ ID NO: 5682 - protein, 39 aa, Zea mays
  misc_feature: Ceres CLONE 323428-F
MDNVESAPDSPAQAPPSSASSLPKEQSQVGIGAEAASGS

SEQ ID NO: 5683 - DNA, 432 bp, Zea mays
  misc_feature: Ceres CLONE 323429-F
  misc_feature: SWISSPROT Homolog: EC 5.1.3.3 Aldose 1-epimerase
  misc_feature (307)..(307): n is a, c, t, g, unknown, or other
  misc_feature (316)..(316): n is a, c, t, g, unknown, or other
  misc_feature (349)..(349): n is a, c, t, g, unknown, or other
agatagagtagtagtaggttgttagctgaggggaggcatcgatggctggagcaagagaggaatcctgctcgtcctgtgcctggccgtcgtcttggtggcgctcgggagtggcggcgtggaggcgaggaakcgatggaagcagtccctggggttctacgagctgcgtcggggcgagttctccatggtcgtcatcaactggggcgccaccatcctctccgtcagctccccgataagaacgggcacatcgacgacgtcgttcttggctacaagaacatcggatcgtacgtgaacgacacgacctacttcngcgctggtngggcgcgtggcgaaccgcatcgccggcgggcgnttcaccatcagggaccacgcctaccacacgtatcggaacgacggcaacaacacgctccacggcggccaccgcgggttcaacca

SEQ ID NO: 5684 - DNA, 241 bp, Zea mays
  misc_feature: Ceres CLONE 323440-F
  misc_feature (99)..(99): n is a, c, t, g, unknown, or other
  misc_feature (100)..(100): n is a, c, t, g, unknown, or other
  misc_feature (108)..(108): n is a, c, t, g, unknown, or other
accatcaggtacaagaaacaacaagactgacagcgacgatgatgccacagctgcgtmgctcgtcgcgctggtcctcgtggccacggcyatagccgccgnnccggsttnggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaa

SEQ ID NO: 5685 - DNA, 315 bp, Zea mays
  misc_feature: Ceres CLONE 323443-F
  misc_feature: Encodes the peptide sequence at SEQ ID NO. 5686
  misc_feature (80)..(80): n is a, c, t, g, unknown, or other
acacgccttccaaggtccacacctaccccaagagccgcccgccccatcagccgccacgatgtgcaccctggagcagcggnccgsgtcttcgtcctcacccttaccggcgacgcgagcaccgcctgggccacgcctcatctcctcgctccgatccgccgtcgcctccgcggcgctggtgcggccaaggcggggcccggggcgcgctcgtcaccgtcggcgagggccgcttcttctccaacggcctcgacatcgggtgggcgggaactcccgcgcgcgcctaggcgagctcgttgacgcgctccgcccgctcgttgc

SEQ ID NO: 5686 - protein, 92 aa, Zea mays
  misc_feature: Ceres CLONE 323443-F
  misc_feature (28)..(28): Xaa is any aa, unknown, or other
TPSKVHTYPKSRPPHQPPRCAPWSSGPXLRPHPYRRREHRLGHASSPRSDPPSPPRRWCGQGGARGALVTVGEGRFFSNGLDIGWAGTPARA

SEQ ID NO: 5687 - DNA, 283 bp, Zea mays
  misc_feature: Ceres CLONE 323474-F
  misc_feature (247)..(247): n is a, c, t, g, unknown, or other
aactctcctgctggtccggcgcaggctccgctccgttcccccgctgtagttcgagtgttcgacccggcggccggcggcgacggctcgtggtttccagcgatgtcggcgcaggcgggtccagggacgtactccccggcggcggcsscagagacaggcggcgggagaggaaggaggagctgcggcgccacctcgccgaagacgccgactggccgcgggcgacggcgctccttccacgactgccggccancgtttatgcagacagggaccaactactgctgcatca

SEQ ID NO: 5688 - DNA, 252 bp, Zea mays
  misc_feature: Ceres CLONE 323488-F
  misc_feature: Encodes the peptide sequence at SEQ ID NO. 5689
agtccactcacaagcgacaagatatatttkagacattttaasstttssataatggatccaacatatgttactttattcatcttcttagtacttgccttagcatggagatactactttggcagaaactctgcaggcagttcgttaaagtgcatccattctgctttaaagcaatgtgcaaggcaaattctgctatagagggaaaattctctgatggttcctatgtraaggattacagatgtgaagtcaggtgga

SEQ ID NO: 5689 - protein, 50 aa, Zea mays
  misc_feature: Ceres CLONE 323488-F
MEILLWQKLCRQFVKVHPFCFKAMCKANSAIEGKFSDGSYVKDYRCEVRW

SEQ ID NO: 5690 - DNA, 187 bp, Zea mays
  misc_feature: Ceres CLONE 323493-F
  misc_feature: Encodes the peptide sequence at SEQ ID NO. 5691
acctagctagtcatcactagtcacgttcgtccaccagagacaacaatggccatggagacgtgcttcagagcgtgggcgctgcacgccccgctggcagcaaggacaggctcctcgtcggcaacctggtgctgccgtcgaagctggcgctcgcgcgctgtccgtgggccgcgtcgccacgcccggccgc

SEQ ID NO: 5691 - protein, 47 aa, Zea mays
  misc_feature: Ceres CLONE 323493-F
MAMETCFRAWALHAPLAARTGSSSATWCCRRSWRSRAVRGPRRHARP

SEQ ID NO: 5692 - DNA, 343 bp, Zea mays
  misc_feature: Ceres CLONE 323507
  misc_feature: Encodes the peptide sequence at SEQ ID NO. 5693
gaaggggggatatctgaaaaaaacgcaaggtaccagcagcgcaaagagccgggtgttggcacagatcaggcggccgccatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgcccaagaagaagaagccggtctccaagaagaagctgaaccgtttcctgatagctttgctttgatgacatcctccccgttatcgataaaaaaaaaaaaaaaaaa

SEQ ID NO: 5693 - protein, 74 aa, Zea mays
  misc_feature: Ceres CLONE 323507
  misc_feature (10)..(72): Pfam Name: S1FA Pfam Description: DNA binding protein S1FA
MADQFADSANNVIIEEVNKGLNPGMVVLLVVASFLLLFFAGNYALYVYAQKTLPPKKKKPVSKKKLNRFLIALL

SEQ ID NO: 5694 - DNA, 249 bp, Zea mays
  misc_feature: Ceres CLONE 323518-F
  misc_feature (169)..(169): n is a, c, t, g, unknown, or other
aactcatgtcagaccagagctccaccctcgcctcgaagggcacagcctcgacggctggcggcggccgaagcgatgtcgcggcggccgtttggagtgtcatcttccggcgtaagacccggactaccacccactggccagacgacggaggaggaggcgcgckcyaggcganggcggagaaagccgagctcgaggaggagatcgccacgctgaaggccaagatcttcgccctggaggaagagttggccagga

SEQ ID NO: 5695 - DNA, 371 bp, Zea mays
  misc_feature: Ceres CLONE 323525-F
  misc_feature: Encodes the peptide sequence at SEQ ID NO. 5696
  misc_feature (258)..(258): n is a, c, t, g, unknown, or other
gcggcggctggttatcatttatcatcaccttcgcctcacaccttccttccggccgcccattccgatccgatccccggccggccacctaccaccggtcagccccatcaaactctgaggcagcgtcasgcatcakgcctccctcgtcgatctccccgccgccgccgctgctaataccataatggaggccggcgccgcsscttgctgccactgccatctaccctctgcaccgatgcaaaaccatacacctggtgaggcatncccaaggtgtccacaacgtgaaggcgacacggatcacagcgcctacatgaaacccgacttcttcgacgcgcgcatcactcccttgggctggaaccaggttgacctcctgcgag

SEQ ID NO: 5696 - protein, 64 aa, Zea mays
  misc_feature: Ceres CLONE 323525-F
  misc_feature (7)..(7): Xaa is any aa, unknown, or other
  misc_feature (27)..(27): Xaa is any aa, unknown, or other
MEAGAAXCCHCHLPSAPMQNHTPGEAXPRCPQREGDTDHSAYMKPDFFDARITPLGWNQVDLLR

SEQ ID NO: 5697 - DNA, 315 bp, Zea mays
  misc_feature: Ceres CLONE 323545-F
  misc_feature: Encodes the peptide sequence at SEQ ID NO. 5698
  misc_feature (128)..(128): n is a, c, t, g, unknown, or other
  misc_feature (131)..(131): n is a, c, t, g, unknown, or other
  misc_feature (302)..(302): n is a, c, t, g, unknown, or other
aaccaccccgcttcccccgaccgcgtctcggagcacccttctcaaccgcatcctgcctctgctcggtgtcgccgtctcgactgcaggagaggggascgccccgtcgccgatctgatcgggagccggancanagcgtcgaggtgagcccgtcagaaccgccatggcagcggccgccgcssattccgacaccgccgcagctcgtgggcgccatgtccacctgcgcccactgtcagcgagaaatcccatttttgaacatcgacttgcactctgtacattgcgcccgcracctccaarrgtgccancactgcggcgaaa

SEQ ID NO: 5698 - protein, 35 aa, Zea mays
  misc_feature: Ceres CLONE 323545-F
  misc_feature (26)..(26): Xaa is any aa, unknown, or other
  misc_feature (29)..(29): Xaa is any aa, unknown, or other
  misc_feature (31)..(31): Xaa is any aa, unknown, or other
MSTCAHCQREIPFLNIDLHSVHCARXLQXCXHCGE

SEQ ID NO: 5699 - DNA, 281 bp, Zea mays
  misc_feature: Ceres CLONE 323573-F
  misc_feature: Encodes the peptide sequence at SEQ ID NO. 5700
  misc_feature (240)..(240): n is a, c, t, g, unknown, or other
cagtctggggataataatccacactccacaagcagccatggcgccacccatcacgtccctgtcgtctctgatggcgtccagccaatcccgacgccgccgccgctcccgaagaccagcggaagagcgctctccgtcgcgccctgcgctccgcgtcgtcctcgtcgccgtccacttcctcgactcctcatccggtggcggcgtcggcgtcggcgggcaggagggggctcctggcgctgggcngggttcctggcctcggcgcgctgctgtccccggcggcgacg

SEQ ID NO: 5700 - protein, 81 aa, Zea mays
  misc_feature: Ceres CLONE 323573-F
  misc_feature (68)..(68): Xaa is any aa, unknown, or other
MAPPITSLSSLMASSQSRRRRRSRRPAEERSPSRPALRVVLVAVHFLDSSSGGGVGVGGQEGAPGAGXGSWPRRAAVPGGD

SEQ ID NO: 5701 - DNA, 222 bp, Zea mays
  misc_feature: Ceres CLONE 323584-F
  misc_feature: Translation starting site: 68
  misc_feature: Pfam Name: Ribosomal_S14 Pfam Description: Ribosomal protein S14p/S29e
  misc_feature (39)..(39): n is a, c, t, g, unknown, or other
  misc_feature (129)..(129): n is a, c, t, g, unknown, or other
  misc_feature (161)..(161): n is a, c, t, g, unknown, or other
  misc_feature (170)..(170): n is a, c, t, g, unknown, or other
  misc_feature (178)..(178): n is a, c, t, g, unknown, or other
  misc_feature (202)..(202): n is a, c, t, g, unknown, or other
agagtcataagccaggtcagactaggttaaggtttactntgaggcctgctcccctgccgccgccgccatgggacactccaacgtgtggaattcgcaccccaagaactacggccctggatctagggtttntaccgctgaaacttsgggagctccaaagcatngcaataatngaagcatngatcgggacctaaaasatagcctntactcttattcttatgataa

SEQ ID NO: 5702 - DNA, 486 bp, Zea mays
  misc_feature: Ceres CLONE 323592-F
  misc_feature: Encodes the peptide sequence at SEQ ID NO. 5703
  misc_feature (422)..(422): n is a, c, t, g, unknown, or other
  misc_feature (426)..(426): n is a, c, t, g, unknown, or other
  misc_feature (437)..(437): n is a, c, t, g, unknown, or other
  misc_feature (471)..(471): n is a, c, t, g, unknown, or other
acccaactccgtccctctctcccagcccagatagatctttcccccgtcctccctcgccttcgcctcgccggcaggagatttccaccaccaccgccggaccaccccgaccctccttccctctcgcgctatggcccagactgttgtgctcaaggttggcatgtcctgtgagggctgtgttggagctgtcaasscggtcctgggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggcgccaccgcctgacaggttcgatgatctsgaagtgcccagcaaaaaaaatctnaatntatttagcttngatctsttacaaataattgcraactgctagctcngtctctacatcttac

SEQ ID NO: 5703 - protein, 84 aa, Zea mays
  misc_feature: Ceres CLONE 323592-F
  misc_feature (5)..(66): Pfam Name: HMA Pfam Description: Heavy-metal-associated domain
  misc_feature: SWISSPROT Homolog: EC 3.6.3.4 Copper-exporting ATPase
  misc_feature (21)..(21): Xaa is any aa, unknown, or other
  misc_feature (22)..(22): Xaa is any aa, unknown, or other
MAQTVVLKVGMSCEGCVGAVXXVLGKMEGVESYDVDIMEQKVTVKGNVTPDAVLQTVSKTGKKTSFWEAEAVTSESATPAGATA

SEQ ID NO: 5704 - DNA, 437 bp, Zea mays
  misc_feature: Ceres CLONE 323636-F
  misc_feature: Encodes the peptide sequence at SEQ ID NO. 5705
  misc_feature (394)..(394): n is a, c, t, g, unknown, or other
  misc_feature (397)..(397): n is a, c, t, g, unknown, or other
aaactcaccaccacggaaccctaaccaagaatccgacccggckhtagacgattcggacggaaggaagacgagaaggccccgaggcgagcgggggatcaaagaagaagatgaaggtccgtgcggcggtgaagcgcctgtgccggttctgcaaggtggtgaagcgccggggaatcgtcttcgtccaatgcacggccaatgccaagcacaagcagcgccagggcttctccaccatcgccgaagcagccgccgtctcgtgcgttcacctgcctccgccgccgcccgctagcggttccgcctccgccgcagcgttcgcagagacttcgaaggtggcgaggcaagagatctctcatgaagttcaattcgcggctcggtttagctgccctgttcaagaatnganaaaaatmatatatcaggccttctaccatacgctgacattt

SEQ ID NO: 5705 - protein, 110 aa, Zea mays
  misc_feature: Ceres CLONE 323636-F
  misc_feature (1)..(38): Pfam Name: Ribosomal_L36 Pfam Description: Ribosomal protein L36
  misc_feature (96)..(96): Xaa is any aa, unknown, or other
  misc_feature (97)..(97): Xaa is any aa, unknown, or other
MKVRAAVKRLCRFCKVVKRRGIVFVQCTANAKHKQRQGFSTIAEAAAVSCVHLPPPPPASGSASAAAFAETSKVARQEISHEVQFAARFSCPVQEXXKIIYQAFYHTLTF

SEQ ID NO: 5706 - DNA, 354 bp, Zea mays
  misc_feature: Ceres CLONE 323641-F
  misc_feature: Encodes the peptide sequence at SEQ ID NO. 5707
  misc_feature (35)..(35): n is a, c, t, g, unknown, or other
aagggagtggctagaccgcagcaattgcgattgcnagtcctccaaaccatggcgctcgcctggcctctccaatggcgtctctctccttccactccgggaggatctcggcggcgtctatcggaggcgtcggccgcactcgcagggcggcccggtggcgtatccgctcgccgttcctccggagctccttcgtctcgtcctcctccacgtcgtccgcctccgcctccgcctcccccgcttcgctcgcggcggctgtctcggcgtctctggcatttacgtcctcctccgcgtttgcggattcatctttgggaatcgagttcagctacagtataatgacaacacggagatcccgtggta

SEQ ID NO: 5707 - protein, 94 aa, Zea mays
  misc_feature: Ceres CLONE 323641-F
MASLSFHSGRISAASIGGVGRTRRAARWRIRSPFLRSSFVSSSSTSSASASASPASLAAAVSASLAFTSSSAFADSSLGIEFSYSIMTTRRSRG

SEQ ID NO: 5708 - DNA, 362 bp, Zea mays
  misc_feature: Ceres CLONE 323646-F
  misc_feature: Encodes the peptide sequence at SEQ ID NO. 5709
  misc_feature (97)..(97): n is a, c, t, g, unknown, or other
  misc_feature (131)..(131): n is a, c, t, g, unknown, or other
  misc_feature (171)..(171): n is a, c, t, g, unknown, or other
  misc_feature (249)..(249): n is a, c, t, g, unknown, or other
  misc_feature (302)..(302): n is a, c, t, g, unknown, or other
  misc_feature (349)..(349): n is a, c, t, g, unknown, or other
ctgactcctccctagcagcagaaaaccggcggcaagtcttcggtggcggcgagggaaggccaaggctttsctsagagaatgcaagacccaagggatnatgatttcttgcgccaaagttgcataagaagaangttytctaccggccgcagccatcaggccatctgaagggtnaacctgaactgttgcggagagagtttccgcaatcatcaggcatggtccaaragccacccaaaagaagcttgaagggtnagcctcgcacgcccccttccgacaggggaccccggattccctgccggaatctngtcctaccgacgaataccgtgcgttaaggaggaagtacctgatgctngaggaagagaact

SEQ ID NO: 5709 - protein, 31 aa, Zea mays
  misc_feature: Ceres CLONE 323646-F
  misc_feature (23)..(23): Xaa is any aa, unknown, or other
  misc_feature (24)..(24): Xaa is any aa, unknown, or other
DSSLAAENRRQVFGGGEGRPRLXXENARPKG

SEQ ID NO: 5710 - DNA, 198 bp, Zea mays
  misc_feature: Ceres CLONE 323655-F
  misc_feature (117)..(117): n is a, c, t, g, unknown, or other
  misc_feature (118)..(118): n is a, c, t, g, unknown, or other
attttggacaccgatccatccatccatccagccccgtacgtgtctcgctggccgtccgtatatatagagagaggcatcggagattggccgccacgttgccatcgcgcgcggcgccgnngccaaggccaaccatgctggcgagggctcctccgccgcggccgtgctccagcggcgttttcatcgcccgcgcacatccaa

SEQ ID NO: 5711 - DNA, 199 bp, Zea mays
  misc_feature: Ceres CLONE 323675-F
  misc_feature: Encodes the peptide sequence at SEQ ID NO. 5712
acactgccgagcagcaaaccaaccagcccacccgccggttggtcacgctcctccccgatcccgaattcccgatctccggccgacgccatggcagccccctccgcggccgtcataggggtgctcgtcctcctcgtcgtgggggcctcgggcgcgcgcctcccaggccgcggcagcaccacccggggagctgcgctgccgc

SEQ ID NO: 5712 - protein, 66 aa, Zea mays
  misc_feature: Ceres CLONE 323675-F
TLPSSKPTSPPAGWSRSSPIPNSRSPADAMAAPSAAVIGVLVLLVVGASGARLPGRGSTTRGAALP

SEQ ID NO: 5713 - DNA, 402 bp, Zea mays
  misc_feature: Ceres CLONE 323685-F
  misc_feature: Encodes the peptide sequence at SEQ ID NO. 5714
tcttccttccgagaaagaaaaacagacacacgtcactgttcgccttgcccggtcgtttctgctccattcctcctcctgcaagccgcaaaggaatcaggcggagtggcgcgatgggagagcaggtcgtgacggagcagatccagcggaagttggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgcagtgtgcctgtccttgctgccaacaatgtttttgagagtgagatggccaagtttcagggaatgttgaaccggtcattgagggtctctssaaataagtttg

SEQ ID NO: 5714 - protein, 97 aa, Zea mays
  misc_feature: Ceres CLONE 323685-F
  misc_feature (10)..(97): Pfam Name: DUF842 Pfam Description: Eukaryotic protein of unknown function (DUF842)
  misc_feature (94)..(94): Xaa is any aa, unknown, or other
MGEQVVTEQIQRKLEEVNATVQQHLAGVQDHINFTMQQAYFKCAYGCFDRRHTQEAISNCVENCSVPVLAANNVFESEMAKFQGMLNRSLRVSXNKF

SEQ ID NO: 5715 - DNA, 379 bp, Zea mays
  misc_feature: Ceres CLONE 323691-F
  misc_feature: Encodes the peptide sequence at SEQ ID NO. 5716
  misc_feature (298)..(298): n is a, c, t, g, unknown, or other
  misc_feature (365)..(365): n is a, c, t, g, unknown, or other
gacagataggggacagggtgaccatttctagcgaggcaggaccgggaagatccggaagctgcgatgtcgaagcggctgctgtcgcggctgctcggcatgttccaatcgcggacgcaggtgggcgtcgacaaggtcggcaaccgctacttcacccgcgttgaggaggtcgacggcacaatgaaggagaggcgttcgggtggagttcaagggcgcagacaggactcgaccaccgttccagtcgagtggatttgctggctgaatggccaaaggaagaaagctccaacaccagaggaattcngctgagctggaggcaagacgtgaacgtgtcaagcaaaacattcaacttttcaraaagaaagargaanaggaaagaaaaact

SEQ ID NO: 5716 - protein, 78 aa, Zea mays
  misc_feature: Ceres CLONE 323691-F
MSKRLLSRLLGMFQSRTQVGVDKVGNRYFTRVEEVDGTMKERRSGGVQGRRQDSTTVPVEWICWLNGQRKKAPTPEEF

SEQ ID NO: 5717 - DNA, 415 bp, Zea mays
  misc_feature: Ceres CLONE 323705-F
  misc_feature: Encodes the peptide sequence at SEQ ID NO. 5718
tttaaggggcgaaassaaatcgagaaccgcagagtagttgagttgggtggaaaggtaatctctcattttcttaacctccacctgttctggcttgadactttctgtcatctcagtgtttatgtcatctgaaaaacagtccgttaagaagcaccgcacaccattaagtgttgcgamscagctctgaagaatcagaagaaacgagaacagaagaaaatggaagaggaaaaactacttgggatctttaggaagagggacaaggacaccaaacctcacaagacaaggccagaggaccgagtgcttagggccacagaagggcgctttaggaacggtatactgaacgtcaagcatcttctggcgccaccgaaaccatcaggcaaggacatgtcggaaccgaagatgatgaaggacaagcaca

SEQ ID NO: 5718 - protein, 67 aa, Zea mays
  misc_feature: Ceres CLONE 323705-F
MEEEKLLGIFRKRDKDTKPHKTRPEDRVLRATEGRFRNGILNVKHLLAPPKPSGKDMSEPKMMKDKH

SEQ ID NO: 5719 - DNA, 354 bp, Zea mays
  misc_feature: Ceres CLONE 323715-F
  misc_feature: Translation starting site: 152
  misc_feature (96)..(96): n is a, c, t, g, unknown, or other
  misc_feature (172)..(172): n is a, c, t, g, unknown, or other
  misc_feature (304)..(304): n is a, c, t, g, unknown, or other
  misc_feature (321)..(321): n is a, c, t, g, unknown, or other
  misc_feature (322)..(322): n is a, c, t, g, unknown, or other
  misc_feature (324)..(324): n is a, c, t, g, unknown, or other
  misc_feature (329)..(329): n is a, c, t, g, unknown, or other
attggtcggacccgcgtggttctcccgtgccctctctctagtggcgacgagtgggcgaacgcgccaccgccttacgccagtcgtcaggcgctctgntcaggttttcatcttcgggtgcccttcaccggcgaccagcacccaacaggctttgatgattsgckgtacaaggatnatatggcctcccgcccaargctgtctggtattcaggaagcaggttttggcgctgtacaggggattccttcggacagcacgccttaaggcccctgaagrrcgccgcagatcgagtctgttgtsstttgcaganttccgtgacaacgcaannantgttnaccgtagaactttgtacacatagag

SEQ ID NO: 5720 - DNA, 456 bp, Zea mays
  misc_feature: Ceres CLONE 323741-F
  misc_feature: Translation starting site: 24
  misc_feature (239)..(239): n is a, c, t, g, unknown, or other
  misc_feature (254)..(254): n is a, c, t, g, unknown, or other
  misc_feature (316)..(316): n is a, c, t, g, unknown, or other
  misc_feature (334)..(334): n is a, c, t, g, unknown, or other
  misc_feature (337)..(337): n is a, c, t, g, unknown, or other
  misc_feature (374)..(374): n is a, c, t, g, unknown, or other
  misc_feature (385)..(385): n is a, c, t, g, unknown, or other
atcgaccttgcgcagttgctccgatgggcaaggactcgaagccgaagacgccaaggggaagggcaagcaggcggccggctcctctggcggcgacgacggcggcggcaagggaggcaagggcaagggcaagggcaagggcggcaagtccgctgacgactccggcacttgcacctacgtcaaagctaggcacgtattcgtgtgagaagcaggggaagatcaatsaagcttataagaagttncaggatggatggctnaataatcgggacaaagttcctcctgctgagtttgctaaggtagcacaagagtattctgaatncccatcaggggaagaaangtngagatcttggttggttcccgcgtggcaagatsgctcnatcctttccangaggttgctttcaacacacctgagggaactgtkagcgcaccattcaagtccacgcacgggtatcactttat

SEQ ID NO: 5721 - DNA, 197 bp, Zea mays
  misc_feature: Ceres CLONE 323777-F
  misc_feature (125)..(125): n is a, c, t, g, unknown, or other
  misc_feature (194)..(194): n is a, c, t, g, unknown, or other
accatttggacaccgatccatccatccatccatccagccccgtacgtgtctcgctggccgtccgtatatatagagagaggcatcggagattggccgccacgttgccatcgcgcgcggcsccgcgngccaaggccaaccatgctggcgagggctcctcctccgcggccgtgctccagcgccgtcggcgcstttgncat

SEQ ID NO: 5722 - DNA, 119 bp, Zea mays
  misc_feature: Ceres CLONE 323800-F
  misc_feature: Encodes the peptide sequence at SEQ ID NO. 5723
acccctctctccctcttgtgggtagcgttgtgcgtcttttcctcagcagcaaccggagagcggctgctcgcctgctcctcctcctagggaaaggacagcggcggcgcggcggcgagaag

SEQ ID NO: 5723 - protein, 39 aa, Zea mays
  misc_feature: Ceres CLONE 323800-F
PSLPLVGSVVRLFLSSNRRAAARLLLLLGKGQRRRGGEK

SEQ ID NO: 5724 - DNA, 494 bp, Zea mays
  misc_feature: Ceres CLONE 323802-F
  misc_feature: Translation starting site: 152
  misc_feature: Pfam Name: Autophagy_N Pfam Description: Autophagocytosis associated protein, N-terminal domain
  misc_feature (336)..(336): n is a, c, t, g, unknown, or other
  misc_feature (426)..(426): n is a, c, t, g, unknown, or other
atctccggtagcgtcaccgtagcctcgcaagtaaactgacctgccttctccgctttcccctccgtctccgtcgggagtcgagacaaagggagccagagttagtcccggcgccgtgtcgcgagcggaaggagaaggactgaaggaggcgacgatgcaggtgaagcagaaggtctacgagttctacaaaggcacggtggagcgggtcacggccccgcgcaccgtctccgcgttcctcgagaagggcgtcctctccgtccccgagttcattctcgccggcgacaacctcgtcgccaagtgccccacctsgtcctgggaagcgggcgatccaagcaagangaagccggtatctccccgccaataagcagttcctcgtcacccgtaatgtgccctgtttaagacgtgccatctcggttcaggaagagtatnatgcagcaggagcagaggtggttctcgatcaggatcgcgaagsctcgcttccaacacatcgagtgcaa

SEQ ID NO: 5725 - DNA, 275 bp, Zea mays
  misc_feature: Ceres CLONE 323817-F
  misc_feature: Encodes the peptide sequence at SEQ ID NO. 5726
  misc_feature (154)..(154): n is a, c, t, g, unknown, or other
ctctcggcggggcccggcaacagaccgggcagcagcacggcagccatggcgtcgagtttcgaccctggatttggcgatgggccccggcgccctcctcccccgcagcggttcccgtacgcctccttcgctccaggaaggggaaggagcgcgassnaacgaggagcatgaatctggcgctctccgcttcctcctccaacggtgcagcagtgccatccctgacaacagattcggagaagaagggcccagtgataatggaaattccactggaccaaatc

SEQ ID NO: 5726 - protein, 91 aa, Zea mays
  misc_feature: Ceres CLONE 323817-F
  misc_feature (50)..(50): Xaa is any aa, unknown, or other
  misc_feature (51)..(51): Xaa is any aa, unknown, or other
LGGARQQTGQQHGSHGVEFRPWIWRWAPAPSSPAAVPVRLLRSRKGKERXXTRSMNLALSASSSNGAAVPSLTTDSEKKGPVIMEIPLDQI

SEQ ID NO: 5727 - DNA, 339 bp, Zea mays
  misc_feature: Ceres CLONE 323847-F
  misc_feature: Encodes the peptide sequence at SEQ ID NO. 5728
  misc_feature (207)..(207): n is a, c, t, g, unknown, or other
  misc_feature (213)..(213): n is a, c, t, g, unknown, or other
  misc_feature (250)..(250): n is a, c, t, g, unknown, or other
  misc_feature (255)..(255): n is a, c, t, g, unknown, or other
  misc_feature (263)..(263): n is a, c, t, g, unknown, or other
  misc_feature (284)..(284): n is a, c, t, g, unknown, or other
tcagttccttcgctcctctgtaacccggggcggccgacgaggsgaccaccgacggcgacgatgggcggcggcgagggcaagtccaagaaacgccgctcttctacctcctcagcggaggaagaagggggggaacggaagaggcgggacaagaaggagagcaagaggaggagccgagacgacagggaggatgacgatgacagacacaanaagaangggaaacacatcgacaggaacaaaggaaaagagaganattcnaaggatangcattccaaggagaagacgancaagagaaaagacaaggacgcggccttcaaagaaatatccaaggatgactacttt

SEQ ID NO: 5728 - protein, 93 aa, Zea mays
  misc_feature: Ceres CLONE 323847-F
  misc_feature (49)..(49): Xaa is any aa, unknown, or other
  misc_feature (51)..(51): Xaa is any aa, unknown, or other
  misc_feature (64)..(64): Xaa is any aa, unknown, or other
  misc_feature (68)..(68): Xaa is any aa, unknown, or other
  misc_feature (75)..(75): Xaa is any aa, unknown, or other
MGGGEGKSKKRRSSTSSAEEEGGERKRRDKKESKRRSRDDREDDDDRHXKXGKHIDRNKGKERXSKDXHSKEKTXKRKDKDAAFKEISKDDYF

SEQ ID NO: 5729 - DNA, 225 bp, Zea mays
  misc_feature: Ceres CLONE 323911-F
aattcccatagcatgattccaaatttctttgtgaacaaaatcccacccaatcgctgtcgttcgacaccgtcaacggcggccgcgcgtctcacgtcccggcgatcccttgccggcgsscacgggcttgcacargactcgagcccgtccgccgccttcgccgcgccgcctccgcsstcctccatcgcacgccgactccgctgcctccatcctcgcacgtccgcttcc

SEQ ID NO: 5730 - DNA, 232 bp, Zea mays
  misc_feature: Ceres CLONE 323935-F
  misc_feature: Encodes the peptide sequence at SEQ ID NO. 5731
  misc_feature (119)..(119): n is a, c, t, g, unknown, or other
attccacactgcactactgcagctaacaagcgcatcacaatggccagctttgcaaaagcgcagcatctgctssttgccgccaccgtggccgtcgttctcctgctcgtcgccgcggcggnacgccagccagcgcccggtgcacctgcggttgtacatgcacgacatcatcggcgggccgggggcagacggcatccacctcatccggaacgtccgggccgccgcacacgtcgct

SEQ ID NO: 5731 - protein, 77 aa, Zea mays
  misc_feature: Ceres CLONE 323935-F
  misc_feature (24)..(24): Xaa is any aa, unknown, or other
  misc_feature (40)..(40): Xaa is any aa, unknown, or other
FHTALLQLTSASQWPALQKRSICXLPPPWPSFSCSSPRRXASQRPVHLRLYMHDIIGGPGADGIHLIRNVRAAAHVA

SEQ ID NO: 5732 - DNA, 683 bp, Zea mays
  misc_feature: Ceres CLONE 323947
  misc_feature: Encodes the peptide sequence at SEQ ID NO. 5733
aatgccatgctggttggcgactctttggcgcagcggcagccaggtcgaagcggcacccacccgcaatgagcaaagcaggcggcggccccggctcggccccgggcccgacggccgcggccgcggcggccgcggtagcagaagcagaagtctgctgctgcaktaatggcggactgccktacgtctccagcctcgtcgacaatttctcctccctcatcaacatckcccgagtcaacgatccgccagtgcgcaactcgcaggaggccttccagatggagatgcgcgccgcccgcatggtacattcagcagactctctgttgaaattagtgtcggaacttaagaggacagccatcttttctgggcttgcttcattgaatgagaatgtggataggaggatcgaagtgctgggtcagcaagctgagggaactgagagaatgctggagaggattgggcaggaggcagcagcaagcctcaaggagctagaggcacactactactcatctgttgtgcggtcaccatcctatgattgagggttatcccaggttatctgttaggcggtttgctcttcagggttatctcagggttttttatttcaccttgaatattgcctactgacattaccattacctttttgttgggactaaagtttagtagattcgtcttattgttcaaaaaaaaaaaaaaaa

SEQ ID NO: 5733 - protein, 153 aa, Zea mays
  misc_feature: Ceres CLONE 323947
  misc_feature (17)..(145): Pfam Name: SURF5 Pfam Description: Surfeit locus protein 5
  misc_feature (32)..(32): Xaa is any aa, unknown, or other
  misc_feature (37)..(37): Xaa is any aa, unknown, or other
  misc_feature (53)..(53): Xaa is any aa, unknown, or other
MSKAGGGPGSAPGPTAAAAAAAVAEAEVCCCXNGGLXYVSSLVDNFSSLINIXRVNDPPVRNSQEAFQMEMRAARMVHSADSLLKLVSELKRTAIFSGLASLNENVDRRIEVLGQQAEGTERMLERIGQEAAASLKELEAHYYSSVVRSPSYD

SEQ ID NO: 5734 - DNA, 197 bp, Zea mays
  misc_feature: Ceres CLONE 323949-F
  misc_feature: Encodes the peptide sequence at SEQ ID NO. 5735
  misc_feature (31)..(31): n is a, c, t, g, unknown, or other
agtttgccactctgtgagcctgctgcccgtnttcttccgccgccgccgccgtcgtcttcgtccgtagcagagcagcagatcagagagcggggaggaagaaaaaccgatcgatggcgtccaactacgtggacacgacgggcgaggagggacggttccacggccctcacagccacagcaccagcacgaccccgacggcg

SEQ ID NO: 5735 - protein, 29 aa, Zea mays
  misc_feature: Ceres CLONE 323949-F
MASNYVDTTGEEGRFHGPHSHSTSTTPTA

SEQ ID NO: 5736 - DNA, 431 bp, Zea mays
  misc_feature: Ceres CLONE 323954-F
  misc_feature: Encodes the peptide sequence at SEQ ID NO. 5737
gaccaaaccctactcgtaccccgccgccgccgcagccgctagccgsgtcacaccagcaagcagaactagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggcgaggacatcgccaaggagaccgccaaggactggaagggcctccacgtcaccgtcaagctcaccgtgcagaaccggcagccaaggtctccgtcgtcccctccgccgcgggctcgtcatcaaggcgctcaaggaacccgagaggacagtaagaacgtcaagaacatcaagcacagcggcaacatcagcctcgacgacgtcatcgagatcgccaagaccatgcggaacagg

SEQ ID NO: 5737 - protein, 119 aa, Zea mays
  misc_feature: Ceres CLONE 323954-F
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLHVTVKLTVQNRQPRSPSSPPPRARHQGAQGTREDSKNVKNIKHSGNISLDDVIEIAKTMRNR

SEQ ID NO: 5738 - DNA, 392 bp, Zea mays
  misc_feature: Ceres CLONE 323960-F
  misc_feature: Encodes the peptide sequence at SEQ ID NO. 5739
gtcggggcggcactggacgcgggcggtgcgaagatgcctatatttatcgatcggtctgggtgcgtgggaagaaggcaccaccaccagctagctctctatctgctgctcctctcaaaagagtcgcagttcactttgttgtactagagcgctgagcagatctttccttgtttctccattccggtacgaaggggtggggtccaagtgaagggaagggaagggaagagaaggcctgctgcgagcgatgggcatcgtcgacgtcgtctccgagttctgctccttgccgaggactcgccggcatctcaagaagaggaagcagttccagacggtggagatgaaggtgcgcatcgactscgaagggtgcgagcgcaaggtgaagaaggcgatggagggca

SEQ ID NO: 5739 - protein, 50 aa, Zea mays
  misc_feature: Ceres CLONE 323960-F
  misc_feature (37)..(37): Xaa is any aa, unknown, or other
MGIVDVVSEFCSLPRTRRHLKKRKQFQTVEMKVRIDXEGCERKVKKAMEG

SEQ ID NO: 5740 - DNA, 344 bp, Zea mays
  misc_feature: Ceres CLONE 324005-F
  misc_feature: Encodes the peptide sequence at SEQ ID NO. 5741
  misc_feature (240)..(240): n is a, c, t, g, unknown, or other
ataagaaacggttgctcgctgccaccaccatgtcctatgatcagatgctctcgccgcttttcggtgccggcgggcgatcggcgtggagagcggcccagcacggcggcggcgacsssgtggcgaggcagatactcaagtgcacgaggtggcagctcgaggagaccaccgacttcgtcacctgcccctaccactactactgcgacasstcctacccgggcgactaccccgccgccgtcggcncctcgtcgccgccttcgccgcctactgctttctctccactctctcgttcaccgtcctcgacctcgtgcggggcaacggtagcagcgcctcggtcgtcggcggtg

SEQ ID NO: 5741 - protein, 105 aa, Zea mays
  misc_feature: Ceres CLONE 324005-F
  misc_feature (29)..(29): Xaa is any aa, unknown, or other
  misc_feature (59)..(59): Xaa is any aa, unknown, or other
  misc_feature (71)..(71): Xaa is any aa, unknown, or other
MSYDQMLSPLFGAGGRSAWRAAQHGGGDXVARQILKCTRWQLEETTDFVTCPYHYYCDXSYPGDYPAAVGXSSPPSPPTAFSPLSRSPSSTSCGATVAAPRSSAV

SEQ ID NO: 5742 - DNA, 388 bp, Zea mays
  misc_feature: Ceres CLONE 324013-F
attattggagatgctctaactagatttaagttggattacagttattggatatggatatccatccattgtcaggtctagttaaaccattttacacactccgctctactcccggaagagacgatggcggaggcgacgcrcgatggtgttcgtctacggcaccctaaagcgcgggttccctaaccactcgctcctcgtggcctccgccacccccttcgtggsagccgcatccacggccgggccagcctccctcatcatcggcccctactcggtacccttcctcctccccactcccgcctccgcctcctccgggtcgtgtcgtctcgggcgagctctacgccccatcccccgcggcgctcgccgagctcgacgccctcgagggacccacatc

SEQ ID NO: 5743 - DNA, 219 bp, Zea mays
  misc_feature: Ceres CLONE 324015-F
  misc_feature: SWISSPROT Homolog: EC 3.2.1.14 Chitinase
  misc_feature (14)..(14): n is a, c, t, g, unknown, or other
  misc_feature (98)..(98): n is a, c, t, g, unknown, or other
aaaagcaagccatntggaggagggctttacgatggtcctgttcatggctggcgccgcgctactcgccggggctgccggcccggcgcgcacagggcgtntggagcatcatcacccggcccatgttccagagcatgctgagccacssgcggcgacasssggtgccagggcgccttctacacctacgacgccttcatcgaggccgccagcragttccccggc

SEQ ID NO: 5744 - DNA, 367 bp, Zea mays
  misc_feature: Ceres CLONE 324023-F
  misc_feature: Translation starting site: 101
  misc_feature (32)..(32): n is a, c, t, g, unknown, or other
assksstcactctcgtctcctgttcgccagancacctcgctccagaagctttcctcccctagatctccctcccgtgcccggtcgcgctgccgacccggccatggccaccaaggggaagctcggggagctagtgtgggagcaccgggtgcaggcggccgcagcggtggctttcgtggccgcggcgccgtctcgatctccgccgtcgggcccaggctcggcgccgtggttcattcttctggccgctgctcgtctccacgggcttcttcctggtggcggtcgcggtgctgctccggatctcgccgccgcccgcggcacgacgacgagtccggcaaggagctcatcgacttcgtcsccgggtgccgcccgg

SEQ ID NO: 5745 - DNA, 136 bp, Zea mays
  misc_feature: Ceres CLONE 324030-F
  misc_feature (30)..(30): n is a, c, t, g, unknown, or other
  misc_feature (62)..(62): n is a, c, t, g, unknown, or other
akctccctcactctactctggacgcgactngaacttaaaccctagagccgcagccccggtcnctccaccgaccccaaatctcaaatcagcgggamggaactcgcacgcgaaggctgaactcatggctcgcgtctac

SEQ ID NO: 5746 - DNA, 191 bp, Zea mays
  misc_feature: Ceres CLONE 324061-F
aaaaactcccccaccggccaccgcccaccgcgaactgccggagaatctctggcgatggcgccgccagcagctgcgggttgccgccgtccaccaccgcagcccgcacctkctcctccgccgcggcgcggggggttctcctcccatctccttcgggtcccgccgcccttcctttctcctcgcggggtgcggca

SEQ ID NO: 5747 - DNA, 357 bp, Zea mays
  misc_feature: Ceres CLONE 324077-F
  misc_feature (112)..(112): n is a, c, t, g, unknown, or other
agatccgcacagtgacgcccgccagccagacccgatcccctccctcgctagggttttcgtccccgcgccgccgcgtcccggatcccaccgaaacaaccattgttggtggtcnymgcggcggtgtcgttcctgaccaacatcgccaaggtggctgcggggctcggagccgcggcctcgctcgcctccgcgtcgctctacaccgtcgacggcggcgagcgcgcgtcatcttcgaccgtttccgcggggtgctcccggagaccgtcggcgagggcaccatttcctcgtgccctggctgcagaagcccttcatctkcgacatccgcacgcgcccgcacaacttgctcctccaactcgggga

SEQ ID NO: 5748 - DNA, 384 bp, Zea mays
  misc_feature: Ceres CLONE 324096-F
  misc_feature: Pfam Name: Sybindin Pfam Description: Sybindin-like family
aatcgcgtcgcccgtctgcaaactgctgcctttgccgatccgcctccacatctccgcctggaagacgagaaacgaggaagacgatcccacctcgcctggaaaacgcatcccaagacttcaaccttcctttccggccggagatccgcttcgcatctccgcgacagatccgggcaaacgggccgatgcagttcttcggcggctcgtcgctgacgtcggtcgcgccggassvccccagccccggcggcgccccctggcacggtcacgggcgccassgcgcaggtcctctacgtcttcaaccgcaacggcgtctgcttgctctaccgcgattggcaccgccccctccgcacgctcgascccacccaggatcacaagctcatcttcggg

SEQ ID NO: 5749 - DNA, 358 bp, Zea mays
  misc_feature: Ceres CLONE 324112-F
  misc_feature: Encodes the peptide sequence at SEQ ID NO. 5750
  misc_feature (208)..(208): n is a, c, t, g, unknown, or other
  misc_feature (244)..(244): n is a, c, t, g, unknown, or other
  misc_feature (282)..(282): n is a, c, t, g, unknown, or other
  misc_feature (295)..(295): n is a, c, t, g, unknown, or other
  misc_feature (335)..(335): n is a, c, t, g, unknown, or other
gaggctcccggactcctcagttccttcgctcctctgtaacccggggcggccgacgaggcggaaccaccgacggcgacgatgggcggcggcgagggcaagtccaagaaacgccgctcttctacctcctcagcggaggaagaagggggggwacggaatakgcgggacaagaaggagagcwagaggaggagccgagacgacagggaggatnacgatgacagacacaagaagaaggggaaacacatcnacaggaacaaaggaaaakagagagattcgaaggataangcattccaagganaagacgagcaagagaaaagacaaggacgctgccttcaaanaaatatccaaggatcactacttt

SEQ ID NO: 5750 - protein, 93 aa, Zea mays
  misc_feature: Ceres CLONE 324112-F
  misc_feature (24)..(24): Xaa is any aa, unknown, or other
  misc_feature (27)..(27): Xaa is any aa, unknown, or other
  misc_feature (34)..(34): Xaa is any aa, unknown, or other
  misc_feature (44)..(44): Xaa is any aa, unknown, or other
  misc_feature (56)..(56): Xaa is any aa, unknown, or other
  misc_feature (62)..(62): Xaa is any aa, unknown, or other
  misc_feature (68)..(68): Xaa is any aa, unknown, or other
  misc_feature (73)..(73): Xaa is any aa, unknown, or other
  misc_feature (86)..(86): Xaa is any aa, unknown, or other
MGGGEGKSKKRRSSTSSAEEEGGXRNXRDKKESXRRSRDDREDXDDRHKKKGKHIXRNKGKXRDSKDXAFQGXDEQEKRQGRCLQXNIQGSLL

SEQ ID NO: 5751 - DNA, 229 bp, Zea mays
  misc_feature: Ceres CLONE 324143-F
agcacgagcgcgaacacgaacacgaacaccataacgcggcggccatggtgggcggcggcggcgacccaaggccggagacgagcccttctccgacggaacgccacggagtcggacaccgacgatgtctcctccgcagggattagtgctcgccgccccggsccaccactaacccgatcctgactcgcctcgcggtgtcgcggaaacccgagcccgctggccgcggccaccg

SEQ ID NO: 5752 - DNA, 370 bp, Zea mays
  misc_feature: Ceres CLONE 324146-F
  misc_feature: Encodes the peptide sequence at SEQ ID NO. 5753
gttggttgcttctttctactcgcgctcgcaccaaccagaggagcaaccgagcagtagcgactcctctgcgtgaggcctgccgtcatcccccgtggccgtggcgtgcgcaaaadaacaaatcatcctcgattcgaccagaggggaaggagacgcgccgggagaagggggaagagacgcggcgaccatgtctccgatctgggtgttcgggtacggctcgctgatctggaacccaggtttcgcctacgacgaccgcgtbsctctttttgtcagggactaccgccgcgtcttctaccaagggagcacggaccacaggggcacgccgcagttccccgggaggaccgtcacgctcgagcaccagcccggagcgact

SEQ ID NO: 5753 - protein, 62 aa, Zea mays
  misc_feature: Ceres CLONE 324146-F
  misc_feature (4)..(62): Pfam Name: ChaC Pfam Description: ChaC-like protein
  misc_feature (25)..(25): Xaa is any aa, unknown, or other
MSPIWVFGYGSLIWNPGFAYDDRVXLFVRDYRRVFYQGSTDHRGTPQFPGRTVTLEHQPGAT

SEQ ID NO: 5754 - DNA, 260 bp, Zea mays
  misc_feature: Ceres CLONE 324148-F
  misc_feature: Encodes the peptide sequence at SEQ ID NO. 5755
  misc_feature (49)..(49): n is a, c, t, g, unknown, or other
  misc_feature (219)..(219): n is a, c, t, g, unknown, or other
agttcgggatcgtcggacacaggcacgacacgagctcagccggcgssgncagagcgggaggagggagaacgcttcggtcccccccaacccaacctcctccccttcccgacaaggcgacgcgavsagattgccgctgtacgactacatgctgctgctgaagacgacggtgaccagggaggtcctagcggaactggtcacgcgggtggcgcgccgcgattnccagcgcaacggggtcgtcaccgacgtcaattcattcggca

SEQ ID NO: 5755 - protein, 38 aa, Zea mays
  misc_feature: Ceres CLONE 324148-F
  misc_feature (25)..(25): Xaa is any aa, unknown, or other
MLLLKTTVTREVLAELVTRVARRDXQRNGVVTDVNSFG

SEQ ID NO: 5756 - DNA, 466 bp, Zea mays
  misc_feature: Ceres CLONE 324158-F
  misc_feature: Encodes the peptide sequence at SEQ ID NO. 5757
  misc_feature (95)..(95): n is a, c, t, g, unknown, or other
  misc_feature (402)..(402): n is a, c, t, g, unknown, or other
  misc_feature (424)..(424): n is a, c, t, g, unknown, or other
agggtgaagcaccgccgctgaccgctgtccccggctccccgccgccgcagbsaaagacgagaggaagaggttcccgggcggcgcacgactatgtncggatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtsgtcgacgcccgcatccagcgcctcaagcgtgccatggacctctccatgaagcaccagtacctcccggagacctccaggcacagcaggttccattcagaggatatttsagtgacatgttggcgttgtnaaaaaggaaagcgccgagcgtncagtcactgggagcccttccactataccagaggacacttccc

SEQ ID NO: 5757 - protein, 122 aa, Zea mays
  misc_feature: Ceres CLONE 324158-F
  misc_feature (8)..(107): Pfam Name: UCR_14kD Pfam Description: Ubiquinol-cytochrome C reductase complex 14kD subunit
  misc_feature (95)..(95): Xaa is any aa, unknown, or other
  misc_feature (102)..(102): Xaa is any aa, unknown, or other
  misc_feature (109)..(109): Xaa is any aa, unknown, or other
MMNALANWLANPRRNPLARLHMHAVSSRLRKYGLRYDDLYDPYFDLDIKEALGRLPREVVDARIQRLKRAMDLSMKHQYLPETSRHSRFHSEDIXVTCWRCXKGKRRAXSHWEPFHYTRGHF

SEQ ID NO: 5758 - DNA, 340 bp, Zea mays
  misc_feature: Ceres CLONE 324169-F
  misc_feature: Translation starting site: 130
  misc_feature (256)..(256): n is a, c, t, g, unknown, or other
aadaagccgtggcctccctgactcaattctattccttcgcttccgtcagtcgggtccgcagcctccccctctcgcagatccccacctgctcctccgccggccaccgcgttgctcccctcggcagccaggatgacagaagtaccatttctgccgcgtgagaggctcttcaagcagcaacattacttccagaacttgaccaagcacacctacctgaraggcgctacgacgtgatcacctccgtcgccatcccccttgnactcgctgcctccagcatgttcatgattgggcgtggagtttacaacatgtctcatggggttssggaagaaagagtgatcttcca

SEQ ID NO: 5759 - DNA, 146 bp, Zea mays
  misc_feature: Ceres CLONE 324174-F
  misc_feature: Encodes the peptide sequence at SEQ ID NO. 5760
ctaacactcccatccagccgccaccaggtgcagagtctttcgtcatctcttctccggcgaagaacccccagtcgccagatcacttgttaaactttgttgaggggtgatcggcggtttctttcgcaaacctcagctccgaggcaggg

SEQ ID NO: 5760 - protein, 34 aa, Zea mays
  misc_feature: Ceres CLONE 324174-F
NTPIQPPPGAESFVISSPAKNPQSPDHLLNFVEG

SEQ ID NO: 5761 - DNA, 378 bp, Zea mays
  misc_feature: Ceres CLONE 324236-F
  misc_feature (264)..(264): n is a, c, t, g, unknown, or other
  misc_feature (274)..(274): n is a, c, t, g, unknown, or other
  misc_feature (318)..(318): n is a, c, t, g, unknown, or other
  misc_feature (355)..(355): n is a, c, t, g, unknown, or other
accaccagtagtcctactggtccttgacgtccgttcactcaggttgtgttctctgagttctttcgccgggtggggaggcggagtgcgcggtcgaggaaggcccccttagcggtcggatcgatcggcgccgtgcttgactgcctgtacatgaggatcggctgcggcggcggcggcggagggagacaacctggggaaggaggcgggggaggcgctggggctgctgggctgcgtcaatgaggtggtggcggcggtggcggccacgtnggggcccatnaccgacggcgcgcgcgtcgagacggcgcccaggctcgcccaatngsscgtcgacccgctcccctgctacacctaccgcaantssactccccttcckcatcggcc

SEQ ID NO: 5762 - DNA, 248 bp, Zea mays
  misc_feature: Ceres CLONE 324251-F
  misc_feature (122)..(122): n is a, c, t, g, unknown, or other
  misc_feature (184)..(184): n is a, c, t, g, unknown, or other
acaaatssgaaacaaagaaagaaaaaatcgagaggacgccagggccgattctctgcgtgacttggggcgtcgtcgcgagttttctccggccgagggcggcgcgaccggacaaccagcgtganctgaccggcgacatgactcgcggcaaccagcgtgaccgcgaccgtgagcgcgcggcggsganagcccaacgccaagaactcccaggacgggctcaccccggagcagcgccgcgagagggacaagaa

SEQ ID NO: 5763 - DNA, 230 bp, Zea mays
  misc_feature: Ceres CLONE 324290-F
gtaccaccgtgacagttctattaacttgacgagacaaaaggggggaaagttctgctcctacgatcctacctccagtgatgtcagcaccaccgctggccggcgcggcgccatcatcaatgaggtcctcaccgatgacgagctacgcgcagtgctcaggcggctggggcccgaggcggassgggacgckttccgggctcgtttgccgccgctggctccggatccagagctcc

SEQ ID NO: 5764 - DNA, 180 bp, Zea mays
  misc_feature: Ceres CLONE 324326-F
  misc_feature (72)..(72): n is a, c, t, g, unknown, or other
ccagcgcggcgcaacssaaacccagacggccagacccagcggtcgcttactcgcatcgcagcgcactcgcsncacagtcggcatcacagaccagatccctgcggtgcggcggccatggccagaacttccagctgcagggccggcacgaagtcccgcgtccggtctcccgcgtctggcgcc

SEQ ID NO: 5765 - DNA, 336 bp, Zea mays
  misc_feature: Ceres CLONE 324330-F
  misc_feature: Encodes the peptide sequence at SEQ ID NO. 5766
  misc_feature (303)..(303): n is a, c, t, g, unknown, or other
  misc_feature (307)..(307): n is a, c, t, g, unknown, or other
ctttggcaggctgcgagcagtctgacagcgacacacacaggcagacgccgttccgcgggggaaaggtgccgacgcttgaatcctctccaactccggcaccgcattcgcacgctcgcgccgccccgaatcggagaggacagaggagtcatggacgcggcggcggctgcggctgcgagccccacgagcaagaggatcgcgctggtgacgggagggaacaagggcatcgggctcgagacgtgccggcagctggcgtccaggggcgtcagggtcgtcctgacggctaggaacgaggcgaggggtttngaancggtcgagcgcgtcaggtgcgcccgcggc

SEQ ID NO: 5766 - protein, 63 aa, Zea mays
  misc_feature: Ceres CLONE 324330-F
  misc_feature (52)..(52): Xaa is any aa, unknown, or other
  misc_feature (54)..(54): Xaa is any aa, unknown, or other
MDAAAAAAASPTSKRIALVTGGNKGIGLETCRQLASRGVRVVLTARNEARGXEXVERVRCARG

SEQ ID NO: 5767 - DNA, 329 bp, Zea mays
  misc_feature: Ceres CLONE 324344-F
  misc_feature: Translation starting site: 61
  misc_feature (102)..(102): n is a, c, t, g, unknown, or other
  misc_feature (103)..(103): n is a, c, t, g, unknown, or other
attttgcgacaattcatctgcatacaggggcaacatatctagcagctactccgcccccaaatgctcgccggcatatcccgtttcctcactcgccgccgcccnnmctttccgcttgccgctaccgccgctgcagcagccatgtcgtcgtcgtcgtccacggcagcgaacatctccgagcgtccgatctctccggacaccacccgcgtgcctgggtggggacgggcgtcatgggccagtcaatggcggccacctcctcgccgccggctacgctctcaccgtcttcaaccggacggcatccaagacccagggccttgtstcccgcggcgcca

SEQ ID NO: 5768 - DNA, 340 bp, Zea mays
  misc_feature: Ceres CLONE 324376-F
  misc_feature (223)..(223): n is a, c, t, g, unknown, or other
aacgaagcctctggtgcctcggccaccgcagcagcctggccctgccccggcccccgggcgtggtgtcaggtctcaggtgtggtggcgctttctcctctccggcacgtgggccgcgtcatcccagctctcccgcgcggcgcggcggccgtttcctctcctgcgctcctcctgccgcacacagccagaaaattgcagctgaagtttgtttgaggataagcgacantttggcgagtccttcgtgttgaaggagattgtagctgaagtgaaaaaacagcagggaacratggcactatcacgaagtatgagagcatgtttgcacagtggaagacttgcacttctt

SEQ ID NO: 5769 - DNA, 286 bp, Zea mays
  misc_feature: Ceres CLONE 324393-F
  misc_feature: Encodes the peptide sequence at SEQ ID NO. 5770
  misc_feature (199)..(199): n is a, c, t, g, unknown, or other
  misc_feature (223)..(223): n is a, c, t, g, unknown, or other
  misc_feature (265)..(265): n is a, c, t, g, unknown, or other
gggtttsgagttggagaatcgccttcgtcgctcgacccagaaagattcgatggagagccacaacccatcgcactctcagatcgccgaagtgacgatggacatcgcagcgtcasttcctggagcggcabggagcaagttctgcaagggcgcasstgcggacttctccgacgccagcaactcctcgaaggacgccaggganaggtcggcgtcgatgaggaasctnatattcgcggtggtcctctgcgtcgtattcatggcggtggangtggtggggggcatcaaggcg

SEQ ID NO: 5770 - protein, 79 aa, Zea mays
  misc_feature: Ceres CLONE 324393-F
  misc_feature (22)..(22): Xaa is any aa, unknown, or other
  misc_feature (27)..(27): Xaa is any aa, unknown, or other
  misc_feature (35)..(35): Xaa is any aa, unknown, or other
  misc_feature (50)..(50): Xaa is any aa, unknown, or other
  misc_feature (57)..(57): Xaa is any aa, unknown, or other
  misc_feature (72)..(72): Xaa is any aa, unknown, or other
MESHNPSHSQIAEVTMDIAASXPGAAXSKFCKGAXADFSDASNSSKDARXRSASMRXLIFAVVLCVVFMAVXVVGGIKA

SEQ ID NO: 5771 - DNA, 829 bp, Zea mays
  misc_feature: Ceres CLONE 324396-R
  misc_feature: SWISSPROT Homolog: EC 2.8.1.8 Lipoyl synthase
ccgattgggtaccgggcccgccctttttgcgggcgcgtcagtccactgatggcgttaatcagcgaagtttttccggcaccggagacgccaaagatagcagtggtggcgttgcagtcagaatatccagagcacgatccatacgaccgcggaaatccggcaccagagtttcaattttgatttgcgggctatttattattgatgaactgcatctaaccgataaactgactggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggtatcggcatgctttattttcaggacttgatgcctgaaaaaataggctctgcgacaacgttatatgcaaatacttcacgcgtcggctggattatcgccggctctgttgacggaattatggttgaaatctggagctaccatgcgttgttctggctggcgatagggatcgtcgggtattgcgatgatttgcctgctggttattaaagatatttagctcaccagtctgggctaagaaaaatcggcgtggcgcaaacagagccatcctcggcatttttgctatcatgcctgcttacataaacgacaaaacaccatgcggagggaaaaatgggttcccccgaaagggaatgctgaacgtcctgattgcccccctgttttgggggaaaatccaagggtcc

SEQ ID NO: 5772 - DNA, 325 bp, Zea mays
  misc_feature: Ceres CLONE 324406-F
  misc_feature: Translation starting site: 74
agagcagccaagcgccacacacacgccgacgcgaaccaaccaaccagctggtagtaggttcgccgcgctgacgatgatgcctcgccgcgcccttctcttcgccgcggtgctcctcgcggcctccgccgcgcggtctccgggttccacctgggaggggacgagagcggtctcgtgaggggtgtgctcgccgcgctccgcaggssacccgaagggccgaggacgccgctcgcttcgccgtcgcccactacaacaagaaccagggcgccgctttggagtttactagggtgctcaaatccaagcggcaggtggtcaccgggaccctgca

SEQ ID NO: 5773 - DNA, 335 bp, Zea mays
  misc_feature: Ceres CLONE 324415-F
  misc_feature (31)..(31): n is a, c, t, g, unknown, or other
  misc_feature (192)..(192): n is a, c, t, g, unknown, or other
agcgagtaccgagtaggagcaaccgcttgcntcagacgcacactgacggagagtgatcactgatttctggtcatggcaaccgtaactgaggaagttgctccggtcgtcaccgtctccgaggagccggcgccggaakcggcaaggaggtggtggagaaggccggagaggggaagaagcccgacgaggagggtnacgagaggaagaaggccgaccccgccgccgataaggagaagaaggcgaggaagccgcggasagggaagcccaagtccgccgggctgcaccacccgccctatttcgagatatcaaggaggcgatcctgtcgcaggacggcggga

SEQ ID NO: 5774 - DNA, 245 bp, Zea mays
  misc_feature: Ceres CLONE 324445-F
  misc_feature: Encodes the peptide sequence at SEQ ID NO. 5775
  misc_feature (148)..(148): n is a, c, t, g, unknown, or other
agccacacacacagtacgtacaagcstcatcagctcgctagcatagcagcaaccagcaatggactccaccaagttatccgcgctgctggcsstcgccatgctcgcgctctcctcgtcgccgctcgctcttgcgtgggagaaggcgganagtgcaackcgtgcgagtccggctcgccgccgtcgaccggsstccccctgcccccgatcagcataccgtcagtccccctgcccccaatcagcatacc

SEQ ID NO: 5775 - protein, 81 aa, Zea mays
  misc_feature: Ceres CLONE 324445-F
  misc_feature (9)..(9): Xaa is any aa, unknown, or other
  misc_feature (31)..(31): Xaa is any aa, unknown, or other
  misc_feature (50)..(50): Xaa is any aa, unknown, or other
  misc_feature (53)..(53): Xaa is any aa, unknown, or other
  misc_feature (64)..(64): Xaa is any aa, unknown, or other
SHTHSTYKXHQLASIAATSNGLHQVIRAAGXRHARALLVAARSCVGEGGXCNXCESGSPPSTGXPLPPISIPSVPLPPISI

SEQ ID NO: 5776 - DNA, 795 bp, Zea mays
  misc_feature: Ceres CLONE 324446-R
  misc_feature: Encodes the peptide sequence at SEQ ID NO. 5777
  misc_feature (715)..(715): n is a, c, t, g, unknown, or other
  misc_feature (716)..(716): n is a, c, t, g, unknown, or other
  misc_feature (757)..(757): n is a, c, t, g, unknown, or other
  misc_feature (766)..(766): n is a, c, t, g, unknown, or other
  misc_feature (793)..(793): n is a, c, t, g, unknown, or other
ccgggccccccctcgagtagctacgtagaccccccccacgccactcattccaagaggcagccgcggtctcctctccaccccggccgccggccgcccccacagtgccgtaccccgaccagccatgcgcatcttcgtgctgtccgggcagagtaacatggccggccgcggcggcgtacaccacaagcactgggacggcgtggtgcccccagaatgcgcgccggatccgtccatcctccgcctttcctcggcgcagcagtgggaggaagcccgcgagccgctccacgccgacatcgacacaaccaagacctgtggcatcgggcccgggatggcattcgcccgcgctgtgctctcgagcctgcaggaggacacccctggcgcggcggcccagatcgggctcgtgccgtgcgccgttggcgggacggccatccgggagtggtccctcgggaaacatctgtacgagcagatggtatcccgggcgcgcgtcgcgaccttgtacggcgagatcgaggccatcctatggtaccagggagagagcgacgccgaatccgatgccgacacgagtgcctacttggagaacgtcgagaggctcatctgtaatgtcagggcagatcttgggatgccgcagttaccctttattcaggttgcacttgcatctgggaataaaaggaacattgaaaaagtcagaaatgctcaatttagtggtaatttgccaatnngtgtaactgtgatccgatgggtatggcactgaaatgagacnagtgcatcntaccaccgagtcacaagtaaaactggnca

SEQ ID NO: 5777 - protein, 208 aa, Zea mays
  misc_feature: Ceres CLONE 324446-R
  misc_feature (65)..(165): Pfam Name: DUF303 Pfam Description: Domain of unknown function (DUF303)
  misc_feature (198)..(198): Xaa is any aa, unknown, or other
  misc_feature (199)..(199): Xaa is any aa, unknown, or other
MRIFVLSGQSNMAGRGGVHHKHWDGVVPPECAPDPSILRLSSAQQWEEAREPLHADIDTTKTCGIGPGMAFARAVLSSLQEDTPGAAAQIGLVPCAVGGTAIREWSLGKHLYEQMVSRARVATLYGEIEAILWYQGESDAESDADTSAYLENVERLICNVRADLGMPQLPFIQVALASGNKRNIEKVRNAQFSGNLPXXVTVIRWVWH

SEQ ID NO: 5778 - DNA, 282 bp, Zea mays
  misc_feature: Ceres CLONE 324469-F
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
attctattcctccacaccgatcactcgctgctcccctctctcgccggagctccgggccggatggcggcggcggcagsagctcctcccgcctccgtgatcgcgtgatggacgcacacaccgccgcgctccgccgatggacgacgccggaassscaccactcacacgctcccgtggcggtgaccgctccgcctccgccaccgccgcgcccgcccctcnnnaaccctcagccactgctgccgtcgacaggtcctcccccgaccccgacgcgctctatgaagaggg

SEQ ID NO: 5779 - DNA, 325 bp, Zea mays
  misc_feature: Ceres CLONE 324499-F
  misc_feature: Translation starting site: 102
  misc_feature (18)..(18): n is a, c, t, g, unknown, or other
awacacacatcacaaganagccaagggctagccgatcaacaacaccacactagcctctcctatcctagctagctagcttccaccggccgggagaaaaaaaaatggtggcgagcaaggccgccccgttcgacgaggtgtcctcggtggaggcgggggcctacgggggccgcgacgacgacgggcggccgcgcggacgggcacggtgtggacggccagcgcccacattatcacggccgtcatcggctccggggtgctctcgctggcgtgggccatcgcgcactggggctgggccgcgggccgccgtcatgctgctcttcgccgtcgt

SEQ ID NO: 5780 - DNA, 131 bp, Zea mays
  misc_feature: Ceres CLONE 324526-F
acaacggttcacacttcacagcccacatcaacaaatggccaggaaagaagtgacgctcctgctcttcctcgtgctgcttgtcgcaccgtcgagsacagctgcacgacgagcctacggggccgctgtcgggc

SEQ ID NO: 5781 - DNA, 272 bp, Zea mays
  misc_feature: Ceres CLONE 324535-F
  misc_feature: Encodes the peptide sequence at SEQ ID NO. 5782
  misc_feature (131)..(131): n is a, c, t, g, unknown, or other
  misc_feature (134)..(134): n is a, c, t, g, unknown, or other
  misc_feature (138)..(138): n is a, c, t, g, unknown, or other
  misc_feature (143)..(143): n is a, c, t, g, unknown, or other
  misc_feature (212)..(212): n is a, c, t, g, unknown, or other
gcattttctcgagcgacggagcgatccgttcgggccgtccaccacagcgagagagagcggcagaggcgcagagssaaccgagcgagagagagaggacggcgacggcggagatgatggggtggggagaggangtngtgnctctntccctgcgaggctacggctatggcaacgaggaggacgaccggccggagaagccgcggcgttacggggtnacggagatgcggsscccttctactccttccgccccgcaaaccaggcgctccaggaaatat

SEQ ID NO: 5782 - protein, 54 aa, Zea mays
  misc_feature: Ceres CLONE 324535-F
  misc_feature (7)..(7): Xaa is any aa, unknown, or other
  misc_feature (10)..(10): Xaa is any aa, unknown, or other
  misc_feature (39)..(39): Xaa is any aa, unknown, or other
MMGWGEXVVXLSLRGYGYGNEEDDRPEKPRRYGVTEMRXPSTPSAPQTRRSRKY

SEQ ID NO: 5783 - DNA, 280 bp, Zea mays
  misc_feature: Ceres CLONE 324539-F
  misc_feature: Encodes the peptide sequence at SEQ ID NO. 5784
  misc_feature (116)..(116): n is a, c, t, g, unknown, or other
  misc_feature (146)..(146): n is a, c, t, g, unknown, or other
  misc_feature (276)..(276): n is a, c, t, g, unknown, or other
gtttcaagttgcagcctcgcccctctcgctctcgcggctctcggcggatcggcgttcattaaaagctaaaagcctaaraccctagttcgaacctctactagccggcgacasgssgnttyggagcgcgggatacccggagatgccancgccgtctgcggttgcgtcggccgtagagaggctacaggcagcggcgcaggacgcsscaaagttcctcgtcgcgctcggccggcgccttctccgagcaggcgcragggccctcgtgtccaggaccgccgnacgg

SEQ ID NO: 5784 - protein, 47 aa, Zea mays
  misc_feature: Ceres CLONE 324539-F
  misc_feature (3)..(3): Xaa is any aa, unknown, or other
  misc_feature (22)..(22): Xaa is any aa, unknown, or other
  misc_feature (46)..(46): Xaa is any aa, unknown, or other
MPXPSAVASAVERLQAAAQDAXKFLVALGRRLLRAGARALVSRTAXR

SEQ ID NO: 5785 - DNA, 378 bp, Zea mays
  misc_feature: Ceres CLONE 324542-F
  misc_feature: Encodes the peptide sequence at SEQ ID NO. 5786
  misc_feature (245)..(245): n is a, c, t, g, unknown, or other
  misc_feature (345)..(345): n is a, c, t, g, unknown, or other
agataaggccatgtgcatcgaccttcgccactcaccagcgctctccagttccacttcacttcatccctgatcggcgatcgcgcsagcgagcagcsstataacgcacaatgaacttggcgtccgtcgttccctgcgggcaggcattcaccgtgttaatgactcccgccgctggctcccaccgtcgggtccacacgcatgcggcggcctccaagagcggattggcctgccgcgtcggcgcassgggngcgcccggtggctgccggtctcctgtgcagccgggggctytgcagttggtgacgcttttgttactgaggacactataaatgtgaagtttcctcggggaantaacagttccaggctatacacacccattggttg

SEQ ID NO: 5786 - protein, 71 aa, Zea mays
  misc_feature: Ceres CLONE 324542-F
  misc_feature (45)..(45): Xaa is any aa, unknown, or other
MNLASVVPCGQAFTVLMTPAAGSHRRVHTHAAASKSGLACRVGAXGAPGGCRSPVQPGALQLVTLLLLRTL

SEQ ID NO: 5787 - DNA, 134 bp, Zea mays
  misc_feature: Ceres CLONE 324584-F
  misc_feature (65)..(65): n is a, c, t, g, unknown, or other
tcgcaccagaaacccgcgaatcaatcccgaatcccgatcgamcggcggcgcgggaggcgatgcgnacaaggcggtggacgacgtcatggaggccgcggtgggggcccacttcagcggcctccgcctcgagggct

SEQ ID NO: 5788 - DNA, 183 bp, Zea mays
  misc_feature: Ceres CLONE 324620-F
  misc_feature (83)..(83): n is a, c, t, g, unknown, or other
attaaatctcattcaatccactaggattgagagcaaatatagggtggggcaagcaaggcaggcggassgggcaagggcaagcnagggatgagaatgagggccgtggtgatcacgtgcgccggcggtccggagtgctggamgcgcgggaggtggaggaccatcccgcgctaggcgaaggagagg

SEQ ID NO: 5789 - DNA, 255 bp, Zea mays
  misc_feature: Ceres CLONE 324661-F
  misc_feature: Encodes the peptide sequence at SEQ ID NO. 5790
  misc_feature (2)..(2): n is a, c, t, g, unknown, or other
anttcaaacagtgcagcgtcggcggtggcggggacgacgacgcgatgaacgccttcttcacgtccctggcgcgcgggctggacgacctgggccgtgcgggcgggctgtcgtcgctgtcggctctgctgcggrgcggccgcgctgctcagggggctgcactcgcrctcacgctcatggtcggccagctccacctgccgccgggcgccgctggctcgacgagtacatggacgagacggcccgcctctgggacgcttg

SEQ ID NO: 5790 - protein, 70 aa, Zea mays
  misc_feature: Ceres CLONE 324661-F
  misc_feature (30)..(30): Xaa is any aa, unknown, or other
MNAFFTSLARGLDDLGRAGGLSSLSALLRXGRAAQGAALALTLMVGQLHLPPGAAGSTSTWTRRPASGTL

SEQ ID NO: 5791 - DNA, 175 bp, Zea mays
  misc_feature: Ceres CLONE 324689-F
  misc_feature (151)..(151): n is a, c, t, g, unknown, or other
aatccgctttcggcgccgtcgcactcgccaccatctccaccgcctcctctcgacaagcatcccctcccatacccatggcaactgaccgtctcctccaccttctccgagcgccgacagtctccggctgccgcgccaccacccgcgcggcttnttggggtcgtccacggacgcagcg

SEQ ID NO: 5792 - DNA, 432 bp, Zea mays
  misc_feature: Ceres CLONE 324701-F
  misc_feature: Translation starting site: 221
  misc_feature (390)..(390): n is a, c, t, g, unknown, or other
  misc_feature (416)..(416): n is a, c, t, g, unknown, or other
  misc_feature (419)..(419): n is a, c, t, g, unknown, or other
ctagccttctggaactctcccttccggttccttcctctccgcctccacggctccacctccagtcctccaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcaaatccctttgacgaccctttcttcacaaacccctttggtagcatgatgcagactantttstsagcccctttssagcggcatnatncaacctagcttca

SEQ ID NO: 5793 - DNA, 359 bp, Zea mays
  misc_feature: Ceres CLONE 324705-F
  misc_feature (113)..(113): n is a, c, t, g, unknown, or other
  misc_feature (216)..(216): n is a, c, t, g, unknown, or other
  misc_feature (327)..(327): n is a, c, t, g, unknown, or other
atgccattcgagcagcatcgtcacccagagccaagctgcaassagctagtagcggccggcagcatcgcgttagtagagtgtgctcagagcagcgcgsgcatgggacccttggnccccaccgtgagcttcagtatcatggtcatggccaagctcagcsscgccgcccagcagcagccggagatgamagggagaggaaggagggcggcagtrggtrcngcttccggatgcmgctgcactacccgcgctacaagaaggcggactacgaggccatgccgagtggcgcgtcgactgcctgctccgcgagtacggcctccccgccgacggcancctcgacagcaagcgccgcttcgccatgggcc

SEQ ID NO: 5794 - DNA, 381 bp, Zea mays
  misc_feature: Ceres CLONE 324712-F
  misc_feature: Encodes the peptide sequence at SEQ ID NO. 5795
  misc_feature (75)..(75): n is a, c, t, g, unknown, or other
  misc_feature (76)..(76): n is a, c, t, g, unknown, or other
acacttcactcccaccgatttgatttctccctcatcctccggccgcctcgccgcggccaccgcttcctccatgtnngcgcccgtgggccggcttctactgctggtctccgctgtcgcggtaggcsskggcssctccccgtggcggccgagatcaagaaggagtccttcagggaggacccgcgctcgtccatcatgttcgagaaattcggcttctccaggtccggcgaggtccggatcaccgtgtcgggcgcctcagtatcctcccccgtcgcgcgggccgacctcaagcagctcgggttcttcctcctctccgacgvstccctcctccacgccatcgacgaggcgcgggaggaggggccgacgccggagaagctcgtcgcg

SEQ ID NO: 5795 - protein, 127 aa, Zea mays
  misc_feature: Ceres CLONE 324712-F
  misc_feature (26)..(26): Xaa is any aa, unknown, or other
  misc_feature (42)..(42): Xaa is any aa, unknown, or other
  misc_feature (43)..(43): Xaa is any aa, unknown, or other
  misc_feature (44)..(44): Xaa is any aa, unknown, or other
  misc_feature (106)..(106): Xaa is any aa, unknown, or other
TLHSHRFDFSLILRPPRRGHRFLHVXARGPASTAGLRCRGRXXXLPVAAEIKKESFREDPRSSIMFEKFGFSRSGEVRITVSGASVSSPVARADLKQLGFFLLSDXSLLHAIDEAREEGPTPEKLVA

SEQ ID NO: 5796 - DNA, 174 bp, Zea mays
  misc_feature: Ceres CLONE 324714-F
  misc_feature: Encodes the peptide sequence at SEQ ID NO. 5797
aattcacaggctcaccacaccaaccaacaagcaaaaattccccaatcctctcgtctccgcggcgaagatgtcggggcgcggcaagggcggcaagggcctgggcaagggcggcgcgamstcatccggaaggtctgcgcgacaacatccaggggatcacgaagccggcgatccgga

SEQ ID NO: 5797 - protein, 35 aa, Zea mays
  misc_feature: Ceres CLONE 324714-F
  misc_feature (17)..(17): Xaa is any aa, unknown, or other
MSGRGKGGKGLGKGGAXSSGRSARQHPGDHEAGDP

SEQ ID NO: 5798 - DNA, 208 bp, Zea mays
  misc_feature: Ceres CLONE 324728-F
  misc_feature (183)..(183): n is a, c, t, g, unknown, or other
acaaaagctgttctgacagccctacataggatatgttcgcctttccaaaggaaaaacagagatagaatcctacctatctagcatggcgaccggcgacgagtcggaagmscggtgcgggcgtctgaggagttgcgggactggtccgacatgacgccatgtgtcttgccgaagcgttctcgcggnctggcgctggaggacctgtggcgcg

SEQ ID NO: 5799 - DNA, 436 bp, Zea mays
  misc_feature: Ceres CLONE 324729-F
  misc_feature: Encodes the peptide sequence at SEQ ID NO. 5800
  misc_feature (178)..(178): n is a, c, t, g, unknown, or other
  misc_feature (310)..(310): n is a, c, t, g, unknown, or other
  misc_feature (311)..(311): n is a, c, t, g, unknown, or other
aagcaattggcatccaagccatggcgtcgttcaagtgcatgtgcgtcttcttagtctcgcttatgctcgccctcatcgtcaataacgcccaggaagagcggacgctcccgccgttcccctgcatcccaggccagccacgacccccgtggcbscccaccctgcccgccagcgccaskangtgctacacgtcggtgtcggggctgatgccgtgcgcggacttcctcacccacatcgggctgccaccggaccacccacgaccgccttckgcgacggtctcaggtcgctcgtssaccaacgcgcccatctgcanntsccacgtcgtcaatggcgacatcaacragckcctaccggcgcccatgakacccgtgcgcatggtggcgctcccccgcktgtgcgtcgtccccttcccacgagccacgattcgccattgcatcag

SEQ ID NO: 5800 - protein, 138 aa, Zea mays
  misc_feature: Ceres CLONE 324729-F
  misc_feature (44)..(44): Xaa is any aa, unknown, or other
  misc_feature (52)..(52): Xaa is any aa, unknown, or other
  misc_feature (53)..(53): Xaa is any aa, unknown, or other
  misc_feature (90)..(90): Xaa is any aa, unknown, or other
  misc_feature (97)..(97): Xaa is any aa, unknown, or other
  misc_feature (98)..(98): Xaa is any aa, unknown, or other
  misc_feature (107)..(107): Xaa is any aa, unknown, or other
  misc_feature (108)..(108): Xaa is any aa, unknown, or other
  misc_feature (114)..(114): Xaa is any aa, unknown, or other
  misc_feature (124)..(124): Xaa is any aa, unknown, or other
MASFKCMCVFLVSLMLALIVNNAQEERTLPPFPCIPGQPRPPWXPTLPASAXXCYTSVSGLMPCADFLTHIGLPPDHPRPPSATVSGRSXTNAPICXXHVVNGDINXXLPAPMXPVRMVALPRXCVVPFPRATIRHCI

SEQ ID NO: 5801 - DNA, 425 bp, Zea mays
  misc_feature: Ceres CLONE 324734-F
  misc_feature: Translation starting site: 257
  misc_feature: Pfam Name: ER Pfam Description: Enhancer of rudimentary
  misc_feature (264)..(264): n is a, c, t, g, unknown, or other
  misc_feature (268)..(268): n is a, c, t, g, unknown, or other
  misc_feature (275)..(275): n is a, c, t, g, unknown, or other
  misc_feature (286)..(286): n is a, c, t, g, unknown, or other
  misc_feature (290)..(290): n is a, c, t, g, unknown, or other
  misc_feature (300)..(300): n is a, c, t, g, unknown, or other
  misc_feature (388)..(388): n is a, c, t, g, unknown, or other
gtttgtccaggagaaggcccccgacgggattattctttctccccgcgtgctctctatctctcccctctttctctccctctgcccgacgactaggccgccgccgccacggsccgccgccgccgccgtgcccaggtctttgtcggtccttgtccggcaacgagcaccctacagatggctgggaggcacaccattattctgatgcagccatctcaaaatagggcttctagaacatttatggattacrattcgattaatcatgcattngatngaatctntgggctttatnaaangaaaattcanggatatcaacccaatgatcccaaacrtaacttatgacatcagcgacctctatramttcattgatggcctagccgacattagtgcgctngtttatgatcactcgattcaggcattcctgccatatg

SEQ ID NO: 5802 - DNA, 261 bp, Zea mays
  misc_feature: Ceres CLONE 324745-F
  misc_feature: Encodes the peptide sequence at SEQ ID NO. 5803
aactctcctgctggtccggcgcaggctccgctccgttcccccgctgtagttcgagtgttcgacccggcggccggcgggacssgctcgtggtttccagcgatgtcggcgcaggcgggtccagggacgtactccccggcggcggcsscagagacaggcggcgggagaggaaggaggagctgcggcgccacctcgccgaagacgccgactsgccgcgggcgaacggcgcttccttccacgactgccggccagcgtttatgcaga

SEQ ID NO: 5803 - protein, 86 aa, Zea mays
  misc_feature: Ceres CLONE 324745-F
  misc_feature (27)..(27): Xaa is any aa, unknown, or other
  misc_feature (48)..(48): Xaa is any aa, unknown, or other
  misc_feature (69)..(69): Xaa is any aa, unknown, or other
LSCWSGAGSAPFPRCSSSVRPGGRRDXLVVSSDVGAGGSRDVLPGGGXRDRRRERKEELRRHLAEDADXPRANGASFHDCRPAFMQ

SEQ ID NO: 5804 - DNA, 322 bp, Zea mays
  misc_feature: Ceres CLONE 324754-F
tttttttgaggaagcggtaagcgcgggagggaggacgggagagagagataggcgtgccttcgtcgtccgtgccggtgcgtggcgtggtggccgtgcgaccgtccgtccaccccctctcctcttcccggcgccggcgacassgggagggactcctgggaggaatggccgtggtgagggctccgctcggcgcggtggcggtggccgctctcgtcgtcgccatcttcatgccggccgccgcagcggcaggcaccggcgcccgcgccaccagcggacggcacatcaatcgacctggggatcgcgtacatccttattctggtggccc

SEQ ID NO: 5805 - DNA, 203 bp, Zea mays
  misc_feature: Ceres CLONE 324779-F
accgattttkctaacccagaacccaacgcgacctcctcgtctccgtctccgtctccgatagtccgactccacgaagcgamsscgctcaacatcctcttccgctgcgcctgcsgcgcggggaaagacgaaatacggcaagaagctactcgagaaaggccacgcacgatgatggcgtgtcggcggctgggcgagggacgccgtcg

SEQ ID NO: 5806 - DNA, 254 bp, Zea mays
  misc_feature: Ceres CLONE 324791-F
  misc_feature: Encodes the peptide sequence at SEQ ID NO. 5807
  misc_feature (72)..(72): n is a, c, t, g, unknown, or other
  misc_feature (109)..(109): n is a, c, t, g, unknown, or other
aaggccagtctgagtgtgcgttcgattcgcttgtgctgcagctagggtttagaggttttctgggcgcggasngaaggcggcggcggctatggctgcggcggaggagganatcgcggtsaaggagccgctggatctgatacgcctcagcctcgacgagcgcatctacgtcaagctccgatccgaccgcgagctgcgcgcaagctccatgcgtatgatcaacatttaaacatgatacttggaatgttgaagaggtc

SEQ ID NO: 5807 - protein, 45 aa, Zea mays
  misc_feature: Ceres CLONE 324791-F
  misc_feature (7)..(7): Xaa is any aa, unknown, or other
MAAAEEXIAVKEPLDLIRLSLDERIYVKLRSDRELRASSMRMINI

SEQ ID NO: 5808 - DNA, 392 bp, Zea mays
  misc_feature: Ceres CLONE 324823-F
  misc_feature: Encodes the peptide sequence at SEQ ID NO. 5809
  misc_feature (374)..(374): n is a, c, t, g, unknown, or other
accattgtattatggggtgcggtaggtttccgattccttctgcgcttttcacggtgcccacccagcgtgcaacctaggcgagaaccgcctccccctccgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttragaagaaggaggaagaggaagttgacgaagaggtagaaagagaagagtctgaggaagaatctgaagaggattctgatgaaaagactaaacataaaggcactgagggtattattcagattnaraatccaaacttggtga

SEQ ID NO: 5809 - protein, 79 aa, Zea mays
  misc_feature: Ceres CLONE 324823-F
  misc_feature (34)..(34): Xaa is any aa, unknown, or other
  misc_feature (74)..(74): Xaa is any aa, unknown, or other
MGRGKFKGKPTGRRNFSTPEEIAAGTSGRPRTFXKKEEEEVDEEVEREESEEESEEDSDEKTKHKGTEGIIQIXNPNLV

SEQ ID NO: 5810 - DNA, 166 bp, Zea mays
  misc_feature: Ceres CLONE 324827-F
  misc_feature (123)..(123): n is a, c, t, g, unknown, or other
  misc_feature (124)..(124): n is a, c, t, g, unknown, or other
accatttggacaccgatccatccatccatccatccagccccgtacgtgtctcgctggccgtccgtatatatagagagaggcatcggagattggccgccacgttgccatcgcgcgcggcgmcgnngccaaggccaaccatgctggcgagggctcctcctccgcggcc

SEQ ID NO: 5811 - DNA, 289 bp, Zea mays
  misc_feature: Ceres CLONE 324861-F
  misc_feature: Encodes the peptide sequence at SEQ ID NO. 5812
  misc_feature (106)..(106): n is a, c, t, g, unknown, or other
  misc_feature (107)..(107): n is a, c, t, g, unknown, or other
  misc_feature (211)..(211): n is a, c, t, g, unknown, or other
accagtgctgtgctgtgcagccaaccacaaccgaaaggagagccgaagagggaagggggagaagcgaccgcgccgccaaaccctagccccgcgcacgsaccgcggnnattccactccgccgctccgccccccgtccccgcttcgcgacatggccgattccccgcgcaggaggtactcaaggtccccttcatacagcagggggcaccaaaanggaggtcaagatcacaatctccarctcggtctcagtctaggtcacctgtcccagatcctagatctcaggcgaggtcaa

SEQ ID NO: 5812 - protein, 96 aa, Zea mays
  misc_feature: Ceres CLONE 324861-F
  misc_feature (33)..(33): Xaa is any aa, unknown, or other
  misc_feature (36)..(36): Xaa is any aa, unknown, or other
  misc_feature (71)..(71): Xaa is any aa, unknown, or other
  misc_feature (79)..(79): Xaa is any aa, unknown, or other
TSAVLCSQPQPKGEPKREGGEATAPPNPSPAHXPRXFHSAAPPPVPASRHGRFPAQEVLKVPFIQQGAPKXRSRSQSPXRSQSRSPVPDPRSQARS

SEQ ID NO: 5813 - DNA, 140 bp, Zea mays
  misc_feature: Ceres CLONE 324867-F
  misc_feature (135)..(135): n is a, c, t, g, unknown, or other
  misc_feature (137)..(137): n is a, c, t, g, unknown, or other
attcttctcgcctcgtgtcgctgacttcccccagctttgkkttgccttcgagcaggagacaggctgtgtagcgtagtctagtgctaccaggatcggatcagcggctgctgcgcttcagttgccgccggcggcatnanggt

SEQ ID NO: 5814 - DNA, 147 bp, Zea mays
  misc_feature: Ceres CLONE 324868-F
  misc_feature (115)..(115): n is a, c, t, g, unknown, or other
cagtctcctctagccgtctcgcgcgcttcaccttccccaccccgccgccgccatcgcacgcccgcddmcgcatccgctatgggtgcgtacaagtacgtctcggagctatggcggnaggaagcagtccgatgtgatgcggttcgtgca

SEQ ID NO: 5815 - DNA, 249 bp, Zea mays
  misc_feature: Ceres CLONE 324883-F
  misc_feature: Encodes the peptide sequence at SEQ ID NO. 5816
  misc_feature (98)..(98): n is a, c, t, g, unknown, or other
  misc_feature (153)..(153): n is a, c, t, g, unknown, or other
agctccgaccctagggtttccatccggctcttccggaagcttccgaaaatggccaccgacgagctcgcccacgccgtcgcccccgccccggccggggnagaccactccccggccttctcgttcagcatctggccgccgacgcagcgcacgcgngacssttcggttgcggcgcctcgtggagacgctcgcgggagacaccatcctctgcaarcgctacggtgcggtgccggccgccgacgccgagcccgc

SEQ ID NO: 5816 - protein, 67 aa, Zea mays
  misc_feature: Ceres CLONE 324883-F
  misc_feature (17)..(17): Xaa is any aa, unknown, or other
  misc_feature (37)..(37): Xaa is any aa, unknown, or other
  misc_feature (55)..(55): Xaa is any aa, unknown, or other
MATDELAHAVAPAPAGXDHSPAFSFSIWPPTQRTRDXSVAAPRGDARGRHHPLQXLRCGAGRRRRAR

SEQ ID NO: 5817 - DNA, 391 bp, Zea mays
  misc_feature: Ceres CLONE 324893-F
  misc_feature: Encodes the peptide sequence at SEQ ID NO. 5818
aaaagcggctaggcgacggcggcttgcctttccccgccccaagggtacacggtcgccgccacctgccctaggccgcagagggagcgttcgccgccccgccctccgtctcccgtcgcctcgcccccgcgctccgtctgccgcccctctccggagaaatgtctgaccatctctttgaggacaccttcgtcgtcactagactcgaccctgatggcaaaraggtttgatagagtttctcgtgttgaagctcgcagcgagcagttagatatgtatatgcrgcttgatgttgccacagatgtttatcctatgcatgctggcgagaratttaacatggttatcgcgcctactctgaatttcggatggcaccccagatactggctactatrctcaggct

SEQ ID NO: 5818 - protein, 61 aa, Zea mays
  misc_feature: Ceres CLONE 324893-F
  misc_feature (23)..(23): Xaa is any aa, unknown, or other
  misc_feature (38)..(38): Xaa is any aa, unknown, or other
  misc_feature (59)..(59): Xaa is any aa, unknown, or other
MAKRFDRVSRVEARSEQLDMYMXLDVATDVYPMHAGEXFNMVIAPTLNFGWHPRYWLLXSG

SEQ ID NO: 5819 - DNA, 190 bp, Zea mays
  misc_feature: Ceres CLONE 324908-F
  misc_feature: Encodes the peptide sequence at SEQ ID NO. 5820
  misc_feature (96)..(96): n is a, c, t, g, unknown, or other
agtactagtcagtagctagctagcgatggttgacctgcgcgtccaggtcgtcgccaccgtcctgggcgtggcctggcggccgctgccgggcmgtcncagcggcaagcagttcgagttccaggaggccaccgtggacgccatccaccagggcttcaggaacggcagcctcacgtcgacggcgctcgcccgg

SEQ ID NO: 5820 - protein, 55 aa, Zea mays
  misc_feature: Ceres CLONE 324908-F
  misc_feature (23)..(23): Xaa is any aa, unknown, or other
  misc_feature (24)..(24): Xaa is any aa, unknown, or other
MVDLRVQVVATVLGVAWRPLPGXXSGKQFEFQEATVDAIHQGFRNGSLTSTALAR

SEQ ID NO: 5821 - DNA, 377 bp, Zea mays
  misc_feature: Ceres CLONE 324913-F
  misc_feature: Encodes the peptide sequence at SEQ ID NO. 5822
  misc_feature (199)..(199): n is a, c, t, g, unknown, or other
  misc_feature (204)..(204): n is a, c, t, g, unknown, or other
  misc_feature (205)..(205): n is a, c, t, g, unknown, or other
attcaatgacccaccagacgctcatcgcttgcacccacgctgtcgttgccgccgctgccttttcccctgcctcccactccctccacgcctccttgcctctccttttcacccgttcctcgtctccctcctgcggtcctgccccccctcccctgcagccgctccctccatggcgtccttcgtcgtgcaccaccacggttcnccgcnnvacagggagggcaasgtcaagatgtccgccctggccctgaggagtagcctcaggccgtgcgaggcgccgaggaggtcggggccgggcaggcgtgatgcagaggcgcggacatgggcatcgcgcctttgccgacgagttctccgtggaggacttgctggacctcgaggacctc

SEQ ID NO: 5822 - protein, 70 aa, Zea mays
  misc_feature: Ceres CLONE 324913-F
  misc_feature (13)..(13): Xaa is any aa, unknown, or other
  misc_feature (14)..(14): Xaa is any aa, unknown, or other
  misc_feature (18)..(18): Xaa is any aa, unknown, or other
MASFVVHHHGSPXXREGXVKMSALALRSSLRPCEAPRRSGPGRRDAEARTWASRLCRRVLRGGLAGPRGP

SEQ ID NO: 5823 - DNA, 199 bp, Zea mays
  misc_feature: Ceres CLONE 324917-F
  misc_feature: Encodes the peptide sequence at SEQ ID NO. 5824
  misc_feature (139)..(139): n is a, c, t, g, unknown, or other
aagagactagacgctctgaaggtcccgtggccgtggatgcgaatcgatggccggggttgaggaagaaggcgaggtggcggccctgcgggaggccctgaggcagcaggtgcaggccgtggaggagctgcgggcgtactcngaggaggagcggcaggcggcrgcgtcaggagccgatgagssactggctatgatcctgcgt

SEQ ID NO: 5824 - protein, 51 aa, Zea mays
  misc_feature: Ceres CLONE 324917-F
  misc_feature (45)..(45): Xaa is any aa, unknown, or other
MAGVEEEGEVAALREALRQQVQAVEELRAYSEEERQAAASGADEXLAMILR

SEQ ID NO: 5825 - DNA, 1088 bp, Zea mays
  misc_feature: Ceres CLONE 324932
  misc_feature: Encodes the peptide sequence at SEQ ID NO. 5826
attcacatacaaagagatagagaaaaaagagaaaagcttgcgagcgatggtgactatgtctggcacccgcaccgccctggcgcacgagggcttggattatgatcccaggctggtggcgccgcgccgcagcaggctaagcgtcgtcgccgttgcggtgcggaccaggcccagcctcgcagtcccgggcctcccgcccccgacgccggagcccgtgctgccgtcgccgcccgtggccgcaggcgtcgcggcggtgctgctcgaggcgggcgtgccgcccgcggacctccggcgcgcggcggggatgtgcccggagctgctgtccgtgcccgcggaggccgtcgcggccgcgctccggttcctgacggaggaggcgggcgtcccggaggcggagctccagcgcgtgctccggcggcgcccgcgcctgctcgtgtgccccgtggcggcgcggctgcggcccacgctctacttcctgcgcgcgctcggcgtgcccgacctgcaccgccgcgccgacctgctgtccttctccgtggaggacaagctgctgccgcggatcgagttcctcgagtcgctaggcctgcccgcgcgcgccgctcgctccatggcgcgccgcttccccgcgctcttcggctacggcgtggacgggaacatgcggcccaaggcggagtacctcctgggcgtgggcgccatgggccgccgcgccgacgagctgtacgagttccccgagtacttctcctacgcgctggccgcgcgcatcgtgccgcgccacgaggcgtgcgccgcgagcggggtcgcgatgccgctgcccgccatgctccgccccggggaggccaagtttcgcgccacgctcgatagctgcgtcgggtccacgctgccccggaggcggtcggcgctgtggcacgccacgtgggtggacgacgacgcgacggcggcgaaggagacgatggtgtgacgtgcgcattatattggtaggctggtagcgtatatgcgtatgtccatatggcattggctgcttgtaagtatgagagccatgatgaatctggttgcgtgcttcttccatcaggtgaacggaggcaaaaaaaaaaaaaaaa

SEQ ID NO: 5826 - protein, 300 aa, Zea mays
  misc_feature: Ceres CLONE 324932
  misc_feature (7)..(265): Pfam Name: mTERF Pfam Description: mTERF
MVTMSGTRTALAHEGLDYDPRLVAPRRSRLSVVAVAVRTRPSLAVPGLPPPTPEPVLPSPPVAAGVAAVLLEAGVPPADLRRAAGMCPELLSVPAEAVAAALRFLTEEAGVPEAELQRVLRRRPRLLVCPVAARLRPTLYFLRALGVPDLHRRADLLSFSVEDKLLPRIEFLESLGLPARAARSMARRFPALFGYGVDGNMRPKAEYLLGVGAMGRRADELYEFPEYFSYALAARIVPRHEACAASGVAMPLPAMLRPGEAKFRATLDSCVGSTLPRRRSALWHATWVDDDATAAKETMV

SEQ ID NO: 5827 - DNA, 176 bp, Zea mays
  misc_feature: Ceres CLONE 324945-F
  misc_feature (131)..(131): n is a, c, t, g, unknown, or other
  misc_feature (132)..(132): n is a, c, t, g, unknown, or other
aaacacatcagactcagagcctgcgctgtcggattcgccgccagctaggcgagatggctgcgcgttgcctctttccgcggaggacatgctgcgcgtcaacggcagccgcgcttcgccgccgcgatggcgcnncctcccccttcgcgtccctcgcagacgccctcctcgccgctcgg

SEQ ID NO: 5828 - DNA, 226 bp, Zea mays
  misc_feature: Ceres CLONE 324977-F
  misc_feature (96)..(96): n is a, c, t, g, unknown, or other
  misc_feature (97)..(97): n is a, c, t, g, unknown, or other
  misc_feature (196)..(196): n is a, c, t, g, unknown, or other
atcttacaccagccgcactcccgtgtcctcctctccgagacgagacggacgggacggcaggcaccaccgcaccggcgccaccccacccgccggctnngagcgggggcccggccacccgaatcacacagatcggaacgccggagaggagcaacgsggcgcggagaggcccgccagcgaaggcgcagtgcaagctctnggttcccggatccgataccaccggcctctc

SEQ ID NO: 5829 - DNA, 384 bp, Zea mays
  misc_feature: Ceres CLONE 324985-F
  misc_feature (212)..(212): n is a, c, t, g, unknown, or other
attttataatttggacatgagtagtccgtagtcgctaccactatagtgggcacaggcgatcgcatattcgcacccacccatcacacgacaardtccctcaccctcgtgagtcctgacgtcctcgcccgtgctcgcagttggtagggttctagccatggcgtggagcgcgccgccgtctccaggttcgcagccgcctcssccacccgcggbsnccatctccgtcagcttggagccgccgcttctcgctcgtccctgtccttctccagtgggcgccgacgcccgtggccgcgtccctctcgacctctgccaccgctttaraggaggctgttcagacagagaaggcaccaccagcactaggcccttattctcaggccatcaaagcaa

SEQ ID NO: 5830 - DNA, 271 bp, Zea mays
  misc_feature: Ceres CLONE 325004-F
acatgaggatttctttcccttctttctttcccacaaatattcccaaagaatcttctgtgttgcttctctcctcggattcctcttcccctcctcgcctcccactccaattattcctctccttactgacttgcttcgcttctctgttatctctgtcctctcctcgtgtttgttcttcctaccagcggasgscagctacgcttgttgcctcgtgcctagacgaacggcataggcaccggacggtggcgtcatgtgcgtggaggagccggagacg

SEQ ID NO: 5831 - DNA, 350 bp, Zea mays
  misc_feature: Ceres CLONE 325022-F
  misc_feature: Encodes the peptide sequence at SEQ ID NO. 5832
  misc_feature (97)..(97): n is a, c, t, g, unknown, or other
  misc_feature (188)..(188): n is a, c, t, g, unknown, or other
  misc_feature (218)..(218): n is a, c, t, g, unknown, or other
  misc_feature (265)..(265): n is a, c, t, g, unknown, or other
  misc_feature (346)..(346): n is a, c, t, g, unknown, or other
gctctctcgctccactctctctctcgccgagtgagggaaggagggagagagaggaggcagggaagtkgggagagcggcgaggacatggcggcgaaangagcagagcagccgcctccgsscggcctacgaggagcagcgcaagaagcgggtcctcgagarcctcaagcatctggaggattttggtatancggagatgtctaagagcctgctccaggcgncgcgcctgcagaaactgaacaaggccggcgttcgcgcgggccccaangagaggaagaagttcgacgccaccgaggtgcggcgttcttcgagggcgaagacacggtttcctacaaggacgatttcggtnaact

SEQ ID NO: 5832 - protein, 52 aa, Zea mays
  misc_feature: Ceres CLONE 325022-F
  misc_feature (9)..(9): Xaa is any aa, unknown, or other
  misc_feature (24)..(24): Xaa is any aa, unknown, or other
MSKSLLQAXRLQKLNKAGVRAGPXERKKFDATEVRRSSRAKTRFPTRTISVN

SEQ ID NO: 5833 - DNA, 272 bp, Zea mays
  misc_feature: Ceres CLONE 325031-F
  misc_feature: Encodes the peptide sequence at SEQ ID NO. 5834
  misc_feature (26)..(26): n is a, c, t, g, unknown, or other
  misc_feature (189)..(189): n is a, c, t, g, unknown, or other
cttctcggcggccgtggcggcgcggnagactatgcgcggcctccaccgctgcccgcaccagctcctcctggtctctccaccgccgcggtccgcccccgcgttccgccagtcggccaccgcctccatcgcggggcctcaggagctccctcgccgtcttctccgcccccggggctcgggtagcggcggcgncgcgcgaacagaagtggggccacgtggagggtgatgaagacggtggagaggagggcctcggggaggcgctccacaggacgcgg

SEQ ID NO: 5834 - protein, 90 aa, Zea mays
  misc_feature: Ceres CLONE 325031-F
  misc_feature (63)..(63): Xaa is any aa, unknown, or other
SRRPWRRGRLCAASTAARTSSSWSLHRRGPPPRSASRPPPPSRGLRSSLAVFSAPGARVAAAXREQKWGHVEGDEDGGEEGLGEALHRTR

SEQ ID NO: 5835 - DNA, 299 bp, Zea mays
  misc_feature: Ceres CLONE 325033-F
  misc_feature: Encodes the peptide sequence at SEQ ID NO. 5836
  misc_feature (2)..(2): n is a, c, t, g, unknown, or other
  misc_feature (4)..(4): n is a, c, t, g, unknown, or other
  misc_feature (84)..(84): n is a, c, t, g, unknown, or other
  misc_feature (200)..(200): n is a, c, t, g, unknown, or other
  misc_feature (256)..(256): n is a, c, t, g, unknown, or other
antnttccactccagtcggtcgaggagtagggttctagcgcctatctccctgcgccgccgccgtggacaaccggagcgtagtgngaggggatgatggagggaggtagccgcgcggatgggcggaatccgaaccagctccggccgttcacctgcaccgggaaccvsgctccaccgcgcccacggctccgcgcggtggccanggcgacaccgtcgtgctggccgctgtgtacgggcccaagccgggaaccggaaggcngagaaccccgagaaggcctccatcgaggtcgtgtggaagccca

SEQ ID NO: 5836 - protein, 61 aa, Zea mays
  misc_feature: Ceres CLONE 325033-F
  misc_feature (17)..(17): Xaa is any aa, unknown, or other
  misc_feature (29)..(29): Xaa is any aa, unknown, or other
MGGIRTSSGRSPAPGTXLHRAHGSARWPXRHRRAGRCVRAQAGNRKAENPEKASIEVVWKP

SEQ ID NO: 5837 - DNA, 248 bp, Zea mays
  misc_feature: Ceres CLONE 325072-F
agcgctgctggtgccgaggccgcccggcggagaagatatatgccgcccagcctcacttacatatgcacattctgttctcgtttctssttcctctctctcaactcaactactcaaagcggtagattaaccggctctagcgtmssgtgttgctacatctctcttggccatgggggcatgcgcgacgaagccgggtgacctcaaggtcaagggcgaggcgcctctggtcgcggaggacgccgcggcgccac

SEQ ID NO: 5838 - DNA, 226 bp, Zea mays
  misc_feature: Ceres CLONE 325092-F
atagtcatataacctgccgcctggcccctacattcaacggtcatctccgctccgctcctccgctccacgccgccaccgctcctccgctcctcgcggctcaaacggtcaaatcgcagatccacaggaaaccccaagcggcggccgtccctgctgcggctctgctccctctgctctccgattcgagcggattccatggccagagacgacgacggcgcgcccgcscggg

SEQ ID NO: 5839 - DNA, 1742 bp, Zea mays
  misc_feature: Ceres CLONE 325094
  misc_feature: Encodes the peptide sequence at SEQ ID NO. 5840
cacctgtccacccattcccctcgcctcgccgccgcggacttcccttcccgcacccgcatcaaattcctcttgttccgcggaatttcccttgctaatcctggtatctcctgtcgctaagccactctactccgcctaacccccgctctgagctcaccggactggcggctccatccggttctcttggcgtgcgcgtgcgcgtgagcgtggtcgtgaggagggctctttcgaagcgtgtgaatccggtgggcgacgtgaaccagggatggatttcccggggccggcaggaagcgggaggcggccgcagcagcaggagccggagcacctgccgccgatgacgccgctcccgctggcgaggcaggggtcggtgtactctctcacgttcgacgagttccagagctcgctcggcggggccgccaaggacttcggctccatgaacatggacgagctcctccgcagcatctggtccgcggaggaggtacacagcgtcgcggccgccagcgcgtcggcggcggaccacgcccacgcccacgccgccgcgcgggggcccgtgtccatccagcaccagggctcgctcaccctcccccgcacgctcagccagaagaccgtcgacgaggtctggcgcgacctcacgtgcgtcggcggagtaccctcctccggctccgccgcgcccgccgcgccgcccccgccggcccagcggcacccgacgctcggggagatcacgctggaggagttcctcgtccgcgcgggcgtggtgcgggaggacatgacggcgccgccgcccgtaccgccggcgccggtgtgcccggctcctgctccgcgcccgccagtgctgtttccccatggcaatgtgttggctcccttggtgcctccactgcaattcgggaatgggttcgtgtcgggggctgtcggtcagcagcgaggtggtcccgtgccccccgcggtatcgcccaggcctgtgacggccagcgcgttcgggaagatggagggagacgacttgtcatccttgtcgccatcaccggtcccgtacattttcggtggtgggttgaggggaaggaagccaccggctatggagaaggtggttgagaggaggcagcgccggatgatcaagaaccgggagtcggccgcgaggtcgcgccaaaggaaacaggcatatatgatggagctggaagctgaagtggcaaaacttaaagagctgaatgatgaattgcagaaaaagcaggttgaaatgttggagaagcaaaagaatgaggtcctggagaggatgagacggcaagttgggccaacggcaaagagaatttgtctgcggaggacattgacaggtccatggtgagctgtagacccgtacggctgtaccttagcagtatatatgtggtaggtgaaggtgaacacacaatggccagagttgccgtggttgacacagccattaatccggagcttcagtctcgtaggcggatagattgcctgtgatttccacttcatagtttttgcccatttgcaacaacaaaaaaagaaaagaaaaggaaaggaaagaaagaaagttcgggcgaatagaggagtttgtatgtagaaagaaagtttagattgtttgacttataatgcgagatgaagacttattttgggacggagagagtatattgcttctttaggctttctggtttggtgatatagggtataactgtatcatcagtccttgtgctttggaaaacggaaaaccaatttgtgatgcaaaaaaaaaaaaaaaa

SEQ ID NO: 5840 - protein, 355 aa, Zea mays
  misc_feature: Ceres CLONE 325094
  misc_feature (271)..(326): Pfam Name: bZIP_2 Pfam Description: Basic region leucine zipper
MDFPGPAGSGRRPQQQEPEHLPPMTPLPLARQGSVYSLTFDEFQSSLGGAAKDFGSMNMDELLRSIWSAEEVHSVAAASASAADHAHAHAAARGPVSIQHQGSLTLPRTLSQKTVDEVWRDLTCVGGVPSSGSAAPAAPPPPAQRHPTLGEITLEEFLVRAGVVREDMTAPPPVPPAPVCPAPAPRPPVLFPHGNVLAPLVPPLQFGNGFVSGAVGQQRGGPVPPAVSPRPVTASAFGKMEGDDLSSLSPSPVPYIFGGGLRGRKPPAMEKVVERRQRRMIKNRESAARSRQRKQAYMMELEAEVAKLKELNDELQKKQVEMLEKQKNEVLERMRRQVGPTAKRICLRRTLTGPW

SEQ ID NO: 5841 - DNA, 633 bp, Zea mays
  misc_feature: Ceres CLONE 325098-R
  misc_feature (390)..(390): n is a, c, t, g, unknown, or other
cgaggtcgacggtatcgatattttttttttttttttttcctgtcaaacaatgcatttcagtttatttggtggaactctccagggagcacatcttaaacacaacgaatacagaatctggaagaagtgcatggccagctttataacatcgctcgacccaagattattggggaggaaaagtaaacagaggtgtccaatacaaaatgattaaggcgtcaaagagaaaacagaaacaaaaacagaggtttattgggctggatttggggatgtcagctccggtggggcccctcgagtgatgccgatggaggaatcatactcctcatcctggtgagcaaacttcttgcgtaacacctttttaaactcaatcttttcaagaggcttggcattctcggnagcatgcaccttggacagattggaatagttggaagctgattccgtgataaatgcgatctcgtcatctgtgagcttcctcagaaatttggcagggttccctccccatacctctccacaagggatcctagtattctgtcttacaagggatcctgcagctaccatcccatgcttttcaacaaccacaccctctaatagggttgcccccatgccaacaaaagcctcatcctcaaccgtgcatccttg

SEQ ID NO: 5842 - DNA, 332 bp, Zea mays
  misc_feature: Ceres CLONE 325117-F
  misc_feature (129)..(129): n is a, c, t, g, unknown, or other
aaaacagcgtgttcttcgtgccaagcgamcacgcgaccgactgtgttacgatcccaaatcttcactcccgacgaaatctagaatccaatgagcaatctcgactgacgcctgcttcaccagattatggcnacgcggcgggcctccttctcgcctcgccgccggtgatatcaggtgtcgcggcgatggcggcgtgcgcsaattggcagtattctacgtcgctgtcctctatgccccgacggtcatcctccggttcccacccccaacctcactccgcaccttcctccaccgtcgcttcgcctgtgccgccgtcgcatccgccgcctccgtccttg

SEQ ID NO: 5843 - DNA, 292 bp, Zea mays
  misc_feature: Ceres CLONE 325118-F
  misc_feature: Encodes the peptide sequence at SEQ ID NO. 5844
  misc_feature (98)..(98): n is a, c, t, g, unknown, or other
aaatcgcggcaccaagcacccgaccgctttccgcatggcttcccacatcgacttccgctgcttggatgagggcctcggcggcgagcgcggcaagcganabskcgcgaggatgccgaggcggcggccgcggattccatggacctcgatgccgacgcgcaccggccgtctaagctccgcgccatgccttccctctccgacccctcgaagccggcctccttcggccagcccacctacgacggcgtcatcgcagggcgtttctcgggacggcggtggaatgaggcccgcacccggc

SEQ ID NO: 5844 - protein, 52 aa, Zea mays
  misc_feature: Ceres CLONE 325118-F
MDLDADAHRPSKLRAMPSLSDPSKPASFGQPTYDGVIAGRFSGRRWNEARTR

SEQ ID NO: 5845 - DNA, 218 bp, Zea mays
  misc_feature: Ceres CLONE 325123-F
gtttgcttcgcctggtcaccttccgtggtgcttgtggctgtgtacgcggtcgtctccatccgaccgacccatcgatcatccaaaaactaaaccaaatcttccccatcgatcccaacttccagtcgatctcctcgctcggctgtttcctcccaaagccgcgccttacaacgagattcctcccctcctctctccaataaccctagcctcctccgccgccg

SEQ ID NO: 5846 - DNA, 593 bp, Zea mays
  misc_feature: Ceres CLONE 325132-R
cgattgggtaccgggccccccctcgaggtcgacggtatcgataagcttttttttttttttttttgataccaaagaacaaagaataatatccattcgagacttgctgatgcaaacttgcacctggtccagtaccaccagcctctctcacagagaagcttccgatttcaactcgtccgaatccaacgcaatgacgccacaaatacgattcattctggttctacacatcacaattcacaagccaccacactagcgaccatggaggaacagtttccatgcgaaccagagaacatccagatgacgatggcctcgagctcgtcacacgcatttcttggaccagtgcacgcgtgtttgtgtgcgtgcttgatgcgcatcttgctgctctgttcttgcactgaggacagcatcagttagctcacctagctccctgttagagcttgagttagttcactaggctgctggacctcctcgccggcgacaccccgtcaggagccgaagggcccccccgtactgcccatgccgccgccgttgggcgcttcacttattgtctagccgaccgtctgcgctacctgactcccccgcatggtagtcgtgtt

SEQ ID NO: 5847 - DNA, 281 bp, Zea mays
  misc_feature: Ceres CLONE 325157-F
  misc_feature: Encodes the peptide sequence at SEQ ID NO. 5848
  misc_feature (91)..(91): n is a, c, t, g, unknown, or other
aagtgccagcttaaagtctatctaaaggcggaccaccactgtccacctgggcggcgatggcgaccgcgcgaggagaggcgcctgccgccgncgctgcccctggcgactctcatcggccgggagctccgcgcggggggctccgagcgcccggccctgcgctacggccacgcssgctttgcaagcgtgcgaggactacttcctcgtcaagcccgactgcctccgcgtccccgggggaccccgcatccgcgttctccgtctttgccgtgttcgacgggccacaa

SEQ ID NO: 5848 - protein, 93 aa, Zea mays
  misc_feature: Ceres CLONE 325157-F
  misc_feature (31)..(31): Xaa is any aa, unknown, or other
  misc_feature (58)..(58): Xaa is any aa, unknown, or other
KCQLKVYLKADHHCPPGRRWRPREERRLPPXLPLATLIGRELRAGGSERPALRYGHAXFASVRGLLPRQARLPPRPRGTPHPRSPSLPCSTGH

SEQ ID NO: 5849 - DNA, 281 bp, Zea mays; identical to SEQ ID NO: 5847
  misc_feature: Ceres CLONE 325157-F2
  misc_feature (91)..(91): n is a, c, t, g, unknown, or other

SEQ ID NO: 5850 - DNA, 141 bp, Zea mays
  misc_feature: Ceres CLONE 325191-F
  misc_feature (63)..(63): n is a, c, t, g, unknown, or other
  misc_feature (139)..(139): n is a, c, t, g, unknown, or other
gaggctcccgggactcctcagttccttcgctcctctgtaacccggggcggccgacgaggsggnaccaccgacggcgacgatgggcggcggcgagggcaagtccaagaaacgccgctcttctacctcctcagcggagaanaa

SEQ ID NO: 5851 - DNA, 356 bp, Zea mays
  misc_feature: Ceres CLONE 325192-F
  misc_feature: Encodes the peptide sequence at SEQ ID NO. 5852
  misc_feature (348)..(348): n is a, c, t, g, unknown, or other
acttgcacctcgccgccgtcttcttcttcttcttcttaccagtctcctccggtgcgggcgagggagacgacgacggcgatggcctggctgaggcggacggagacgctggtgctgctgctcgtggtgcttctggcctccgcttcaacccccgcggcggcggcggcggcgggagaggaggaggaaagagtgatcaggctgaagcgctgtgatggtggttattcttatraccatactctggctcatattcttgtcgaatacgcgtctgsgggtgtacacatctgacttgacatcacttttsstssatggacctgtccaaggtgcaaaggccacacaaagggatttgaggtnatagagat

SEQ ID NO: 5852 - protein, 67 aa, Zea mays
  misc_feature: Ceres CLONE 325192-F
  misc_feature (50)..(50): Xaa is any aa, unknown, or other
  misc_feature (63)..(63): Xaa is any aa, unknown, or other
MAWLRRTETLVLLLVVLLASASTPAAAAAAGEEEERVIRLKRCDGGYSYXHTLAHILVEYASXGVHI

SEQ ID NO: 5853 - DNA, 365 bp, Zea mays
  misc_feature: Ceres CLONE 325199-F
  misc_feature: Encodes the peptide sequence at SEQ ID NO. 5854
  misc_feature (51)..(51): n is a, c, t, g, unknown, or other
  misc_feature (95)..(95): n is a, c, t, g, unknown, or other
  misc_feature (96)..(96): n is a, c, t, g, unknown, or other
  misc_feature (334)..(334): n is a, c, t, g, unknown, or other
araaagagtgttgaaggacgctcggttccttcaggtgcggcggcgaccttntctagattttacccgtggaacgtggcgaccacttccgacgggcnnctcgccgccgctcgcccgccctgctcttcaccccttctcccgggaccgggacaagcgatctcccgtccccgtagtccgcagagagagattttkttctcggttgcaatgaagagttatccgtgggcgggggcccgcctcttgccgtcgtgcagctcctcctcttcctcgcccacctcgtcgaccgcggcggtgctgccggtggaggcacaagggcagctcggtgtacccggcggctgtngtctacccgcrtcasstcccgcgagakctss

SEQ ID NO: 5854 - protein, 53 aa, Zea mays
  misc_feature: Ceres CLONE 325199-F
  misc_feature (45)..(45): Xaa is any aa, unknown, or other
  misc_feature (50)..(50): Xaa is any aa, unknown, or other
MKSYPWAGARLLPSCSSSSSSPTSSTAAVLPVEAQGQLGVPGGCXLPASXPAR

SEQ ID NO: 5855 - DNA, 253 bp, Zea mays
  misc_feature: Ceres CLONE 325212-F
  misc_feature: Encodes the peptide sequence at SEQ ID NO. 5856
  misc_feature (121)..(121): n is a, c, t, g, unknown, or other
  misc_feature (125)..(125): n is a, c, t, g, unknown, or other
gcggtgctactgacggttgctctagatccgttcatcctggtggttttgtgaggtcgaaagcggcgagcgaattagaagatgctggacaagctgtgggacgacgtggtggccgggcctcgcntagnacggcctcgagaagctccgcaagccaccaccgcccgcccgctcgtcatcaacaaagacgcggacggcggcagctacaagcgggcgcagtcgatgccgtcgaccccgacgacgccggtkacgccgtcgt

SEQ ID NO: 5856 - protein, 58 aa, Zea mays
  misc_feature: Ceres CLONE 325212-F
  misc_feature (15)..(15): Xaa is any aa, unknown, or other
  misc_feature (16)..(16): Xaa is any aa, unknown, or other
MLDKLWDDVVAGPRXXRPREAPQATTARPLVINKDADGGSYKRAQSMPSTPTTPVTPS

SEQ ID NO: 5857 - DNA, 225 bp, Zea mays
  misc_feature: Ceres CLONE 325215-F
  misc_feature (140)..(140): n is a, c, t, g, unknown, or other
gcgtgacttcaggtgtcgtcgccgagttgtctccggccgagggcggcggcgcgaaccggttaaccagcgtcmbsgagtgtgacaggcgacatgactcgcggcaaccagcgtgaccgcgatcgtgagcgcgcggcggcganagcccaacggcaaggggccccaggacgggctcaccccggagcagcgccgtgagagggacaagaaagcgctggaggagaaggcggc

SEQ ID NO: 5858 - DNA, 288 bp, Zea mays
  misc_feature: Ceres CLONE 325221-F
  misc_feature (141)..(141): n is a, c, t, g, unknown, or other
  misc_feature (172)..(172): n is a, c, t, g, unknown, or other
  misc_feature (200)..(200): n is a, c, t, g, unknown, or other
gatttgttctgttgttcggtccccaatcttcgcctccgctccgcccgccccgacccagatcaggagctgagagatggacgccaacaggsccaaggtgggattcagcagttgctggctgcggavsragtgctcagcaaattntgaatgcggctagagctgctaagtcagcaangcttaggcaagcgaaagaggaggcaganaggggaaatagccgaataccgtgcccagatggaggctgagttccagaggaaggtccagagagcagtggtgactctggtgcgaacgtca

SEQ ID NO: 5859 - DNA, 326 bp, Zea mays
  misc_feature: Ceres CLONE 325245-F
  misc_feature: Encodes the peptide sequence at SEQ ID NO. 5860
  misc_feature (290)..(290): n is a, c, t, g, unknown, or other
aaccgagatgcaatgcaatgcaaacatcctccctcttctcctgctcctcacagacatcttatcctagctcccggtcgaaggccgtagtaggattcccttctattcctcgcccgcttcctcctccggcagccggacctagctagctagctttcttgccgttcgccgcccatatggctaggaagtgctctagctgtgggaacaacggccacaactccaggacctgcggcgggcacagcaggaccgcggcggccttcgagaacaacggcggcggcgtgaggctgttcggggtncagctgcacgttggggtcctcgtcgcccgtagccgt

SEQ ID NO: 5860 - protein, 52 aa, Zea mays
  misc_feature: Ceres CLONE 325245-F
  misc_feature: The sequence is a functional homolog of SEQ ID NO 317 in the 11/479,226 US patent application
  misc_feature: The sequence is a functional homolog of SEQ ID NO 1023 in the 11/479,226 US patent application
  misc_feature: The sequence is a functional homolog of SEQ ID NO 440 in the 10/412,699 US patent application
MARKCSSCGNNGHNSRTCGGHSRTAAAFENNGGGVRLFGVQLHVGVLVARSR

SEQ ID NO: 5861 - DNA, 285 bp, Zea mays
  misc_feature: Ceres CLONE 325294-F
  misc_feature: Encodes the peptide sequence at SEQ ID NO. 5862
  misc_feature (76)..(76): n is a, c, t, g, unknown, or other
gtgaacgtcaaacagtgtctcttttccagttccagacctgaagaaactccgaccggccggtgggcggtggcggcangcaggatctgtgccgcgatggcgacgtcgaacacggcgcggatcggaggacggcggcggcgacctgcggassaccatcaagaagtggaatatcatctaccctgtctacctcaactccaaaagacggtcgccgaggccgccgcatcgccgctgccaaggcctgcccggaccccacctgscatcgagatcgctgactgctgttcgcacctc

SEQ ID NO: 5862 - protein, 64 aa, Zea mays
  misc_feature: Ceres CLONE 325294-F
  misc_feature (18)..(18): Xaa is any aa, unknown, or other
  misc_feature (19)..(19): Xaa is any aa, unknown, or other
  misc_feature (54)..(54): Xaa is any aa, unknown, or other
MATSNTARIGGRRRRPAXXHQEVEYHLPCLPQLQKTVAEAAASPLPRPARTPPXIEIADCCSHL

SEQ ID NO: 5863 - DNA, 219 bp, Zea mays
  misc_feature: Ceres CLONE 325313-F
  misc_feature: Encodes the peptide sequence at SEQ ID NO. 5864
  misc_feature (114)..(114): n is a, c, t, g, unknown, or other
  misc_feature (148)..(148): n is a, c, t, g, unknown, or other
  misc_feature (149)..(149): n is a, c, t, g, unknown, or other
ggcggcttcccagttcactccaggcccagggcgcccggtcgcatgaactcccgctcctcctccggcggcgtgcggtccgagagctcgctgtcgttgggggagcgcctctgcggntcttcttccccgtcatcgccatcgccgaggccgnntctcttcgccttcaccgactgcctcgcggacctctgcaccgactccggctcctcgcactcgcgccgcttc

SEQ ID NO: 5864 - protein, 59 aa, Zea mays
  misc_feature: Ceres CLONE 325313-F
  misc_feature (36)..(36): Xaa is any aa, unknown, or other
MNSRSSSGGVRSESSLSLGERLCGSSSPSSPSPRPXLFAFTDCLADLCTDSGSSHSRRF

SEQ ID NO: 5865 - DNA, 405 bp, Zea mays
  misc_feature: Ceres CLONE 325326-F
  misc_feature: Encodes the peptide sequence at SEQ ID NO. 5866
  misc_feature (26)..(26): n is a, c, t, g, unknown, or other
  misc_feature (239)..(239): n is a, c, t, g, unknown, or other
  misc_feature (245)..(245): n is a, c, t, g, unknown, or other
  misc_feature (259)..(259): n is a, c, t, g, unknown, or other
  misc_feature (264)..(264): n is a, c, t, g, unknown, or other
  misc_feature (349)..(349): n is a, c, t, g, unknown, or other
  misc_feature (369)..(369): n is a, c, t, g, unknown, or other
  misc_feature (378)..(378): n is a, c, t, g, unknown, or other
atcttcaccaccatatcgacatcgankccagcgagccaaggacagaacagccggcgcccggccctaaaactgccgtgcrcgggagagaagcgagggaaagatggaccggtaccagagattggagaagcagagggaggaggcacccatcaaggaaaacgagatccgcattaccacgcagggaaggatgcgcaactacatcacctacgccaccggcttgcttcaggacaaacgttctgatnaggttntattcaaggccatnggganggctatcaataagactstcatggttctggaattgatcaagaggaggattttggcctccatcagaataccaccactggatctactnatattactcatatcgggganccattcgangaaggcctacttccgcttgagacaaca

SEQ ID NO: 5866 - protein, 101 aa, Zea mays
  misc_feature: Ceres CLONE 325326-F
  misc_feature (17)..(89): Pfam Name: Alba Pfam Description: Alba
  misc_feature (47)..(47): Xaa is any aa, unknown, or other
  misc_feature (49)..(49): Xaa is any aa, unknown, or other
  misc_feature (53)..(53): Xaa is any aa, unknown, or other
  misc_feature (55)..(55): Xaa is any aa, unknown, or other
  misc_feature (61)..(61): Xaa is any aa, unknown, or other
  misc_feature (90)..(90): Xaa is any aa, unknown, or other
  misc_feature (93)..(93): Xaa is any aa, unknown, or other
MDRYQRLEKQREEAPIKENEIRITTQGRMRNYITYATGLLQDKRSDXVXFKAXGXAINKTXMVLELIKRRILASIRIPPLDLLILLISGXHSXKAYFRLRQ

SEQ ID NO: 5867 - DNA, 160 bp, Zea mays
  misc_feature: Ceres CLONE 325331-F
  misc_feature (82)..(82): n is a, c, t, g, unknown, or other
arrarracctcckgmrgtsskttttcacctcctccctctctcacggcggcttttytggcgacggcggcggcggcgacgacanccagccacctggggaagagcaggtagcaggaaatggcggcgttcctgaggtcaaaatgttcaccagttgggacgtact

SEQ ID NO: 5868 - DNA, 117 bp, Zea mays
  misc_feature: Ceres CLONE 325366-F
gasacgaacaacgcccgcgcagagccgggggtagctagctagctcctccgatggccagccgcggtgggcattcgtggtgttcgttgtcctgtgcagctcgctsstcgggctcgcgcc

SEQ ID NO: 5869 - DNA, 275 bp, Zea mays
  misc_feature: Ceres CLONE 325377-F
  misc_feature: Encodes the peptide sequence at SEQ ID NO. 5870
  misc_feature (227)..(227): n is a, c, t, g, unknown, or other
  misc_feature (252)..(252): n is a, c, t, g, unknown, or other
gacatctactggaagtacgagacgcggcccacctgcgacgacgagcacgcctgcaccccctccgagcacctccgccaccacaagtccgtcatgaagtcgcagcgcaacgctcctcatcgccgccgssctcctcctctactggatcctcttctccgtcacccagctcgtcgtcaggctcgaccagatgcagcagcgcgtcgacaagctcaagaagcgcgacgactatnggggctcgcgttcggccttccccgngtccacccggtggtctcgttctt

SEQ ID NO: 5870 - protein, 91 aa, Zea mays
  misc_feature: Ceres CLONE 325377-F
  misc_feature (43)..(43): Xaa is any aa, unknown, or other
  misc_feature (76)..(76): Xaa is any aa, unknown, or other
DIYWKYETRPTCDDEHACTPSEHLRHHKSVMKSQRNAPHRRRXPPLLDPLLRHPARRQARPDAAARRQAQEARRLXGLAFGLPRVHPVVSF

SEQ ID NO: 5871 - DNA, 96 bp, Zea mays
  misc_feature: Ceres CLONE 325390-F
  misc_feature: Encodes the peptide sequence at SEQ ID NO. 5872
  misc_feature (49)..(49): n is a, c, t, g, unknown, or other
  misc_feature (74)..(74): n is a, c, t, g, unknown, or other
aataataaaaaatactcccgtgttcttcgaccggcggcggtggtgcgangaggcggtaagggagacgagatganggggacgaagcggccgctcggc

SEQ ID NO: 5872 - protein, 32 aa, Zea mays
  misc_feature: Ceres CLONE 325390-F
  misc_feature (17)..(17): Xaa is any aa, unknown, or other
  misc_feature (25)..(25): Xaa is any aa, unknown, or other
NNKKYSRVLRPAAVVRXGGKGDEMXGTKRPLG

SEQ ID NO: 5873 - DNA, 156 bp, Zea mays
  misc_feature: Ceres CLONE 325400-F
  misc_feature (94)..(94): n is a, c, t, g, unknown, or other
  misc_feature (143)..(143): n is a, c, t, g, unknown, or other
  misc_feature (149)..(149): n is a, c, t, g, unknown, or other
atcagcatgtgtgcgtctcttccacgagaggcaacctaccgtatagtactgccgacatggtgctctccggcggcctagtcgtccgtggctcgcngcggcggtggcggtggcccgctggccatcaccgccgccccggtcggssnccgatncctacaa

SEQ ID NO: 5874 - DNA, 492 bp, Zea mays
  misc_feature: Ceres CLONE 325408-F
  misc_feature: Encodes the peptide sequence at SEQ ID NO. 5875
  misc_feature (306)..(306): n is a, c, t, g, unknown, or other
agtgccagtgctaggcttataaacactaggagtcgtcccttccttgctctgctttcctctctgctagctagctcttgtssttgtcactgagtgagcagcggggagctgtctagctagcctagtacaggtggagtggagtgtgtggtggagtgcaaaccaaatcaaacgaagaaaattgggagcgaggaggaagaaaagaagaagaagaagacgacgacgacacccaccaccagcagcaagcagcaatcagcagaacgaaatgtcgatcaagtactgcgaccagcacaaggactgcgagcggcassncttgtaccgtcgcttctgcgccgccctggtgggcttcatcgtgctcgtcctcctcatcgtgctcatcgtctggctcgtcctccgccccaccaagcctcgcttcttcctcaacgacgtgagcatcgtgtgcatcaacgtcagctccgcctcctacctcaccgtcaccatgcaggccacgctggcgtc

SEQ ID NO: 5875 - protein, 77 aa, Zea mays
  misc_feature: Ceres CLONE 325408-F
  misc_feature (15)..(15): Xaa is any aa, unknown, or other
  misc_feature (16)..(16): Xaa is any aa, unknown, or other
MSIKYCDQHKDCERXXLYRRFCAALVGFIVLVLLIVLIVWLVLRPTKPRFFLNDVSIVCINVSSASYLTVTMQATLA

SEQ ID NO: 5876 - DNA, 305 bp, Zea mays
  misc_feature: Ceres CLONE 325446-F
  misc_feature: Encodes the peptide sequence at SEQ ID NO. 5877
aaaaatacaaagtagcgccgccgtgctcgtgctccagcgacctcgatggccatgcatcccgttgccggcgccgggcgccccykkcgtcgtcgtccacggcaacgttgagtacgacgacttccactgggacgacgcggccgaggcggacttcaggccttcgaggcgcctacgcctcggcttccgcctccgcaaagssccgccgcttacccgactggacctctccatccccttccccctcctaccgcctccatcassagccaaaacccagtgtccagtggatccacgccatcgtgaccctcacgccc

SEQ ID NO: 5877 - protein, 101 aa, Zea mays
  misc_feature: Ceres CLONE 325446-F
  misc_feature (28)..(28): Xaa is any aa, unknown, or other
  misc_feature (65)..(65): Xaa is any aa, unknown, or other
  misc_feature (85)..(85): Xaa is any aa, unknown, or other
KIQSSAAVLVLQRPRWPCIPLPAPGAPXVVVHGNVEYDDFHWDDAAEADFRPSRRLRLGFRLRKXPPLTRLDLSIPFPLLPPPSXAKTQCPVDPRHRDPHA

SEQ ID NO: 5878 - DNA, 132 bp, Zea mays
  misc_feature: Ceres CLONE 325453-F
  misc_feature (48)..(48): n is a, c, t, g, unknown, or other
  misc_feature (105)..(105): n is a, c, t, g, unknown, or other
atccacagctcgcatccgatttccaatttcaaatccttcgatcgcgcnvcgcccgccctctcgcrgctctctccgatggcccgcacgaagcagacggcgaggaantcaactggcggcaaggcgccgcggaas

SEQ ID NO: 5879 - DNA, 318 bp, Zea mays
  misc_feature: Ceres CLONE 325469-F
  misc_feature (272)..(272): n is a, c, t, g, unknown, or other
  misc_feature (284)..(284): n is a, c, t, g, unknown, or other
atatcccatcctgatctctcctcccttcttcagtgcagcagcaggccagcagcacgccacccgccccactcctgcctccgatccgctgcttactcgccacccggagatggccaccgccgccgccttctccgtctcctcgccggcggctccgsktcgccgcgssatccaaggtgtttggaggaggagttaaccaggcgagaactagaactggctgccgcgtcggatcacgcggaagaactttggccgtgtcatgatggcccttgcagtggatntttctcgttttnaaggagtgccaatggctcctccagacccaattct

SEQ ID NO: 5880 - DNA, 336 bp, Zea mays
  misc_feature: Ceres CLONE 325508-F
  misc_feature: Encodes the peptide sequence at SEQ ID NO. 5881
  misc_feature (278)..(278): n is a, c, t, g, unknown, or other
accagtaagagaccgtcaacggggcgccgttaggtatcagaaggaagaccaatcaaagggaggcaaacgccatagcggccaatcacttggcggcggcggcggcgatggggcggctgaccgaggagcaggcggcgcgcgaggcgggctcggcggggaccaacgccacgtccctcaagctcacacaccgcgctctctccgacgtgtcgtgcctgagcagcttcaagaacctggagcacctcgacctcggcttcaactgcctcgtcaccctcgagggtttntcctcctgtgccaatttaagtggctttcggttaagaaaacaagcttgtgagcttaara

SEQ ID NO: 5881 - protein, 77 aa, Zea mays
  misc_feature: Ceres CLONE 325508-F
  misc_feature (58)..(58): Xaa is any aa, unknown, or other
MGRLTEEQAAREAGSAGTNATSLKLTHRALSDVSCLSSFKNLEHLDLGFNCLVTLEGXSSCANLSGFRLRKQACELK

SEQ ID NO: 5882 - DNA, 335 bp, Zea mays
  misc_feature: Ceres CLONE 325509-F
  misc_feature: Encodes the peptide sequence at SEQ ID NO. 5883
  misc_feature (132)..(132): n is a, c, t, g, unknown, or other
  misc_feature (171)..(171): n is a, c, t, g, unknown, or other
gcgccgacgtcaacggagacgtgtcamssgcggcggtgataagacccataccttctagatttttttccgctgcctcaatggatctctgggagagggcccgggccttcgccggcgagssgcgaacggtcgcangaactctccgcggaggcgccaagcgctcgtcggcgctgntctcggagacggcgaagaagtccaaggagatcttctccgaaaccgcctccaagtcgcgggdtatcgccgctgagsscaccaagcaggccgacctcctcgccggccagatcaagcacctcgcctccgacctccctgtgccttcgatcccgcccatccccgggatc

SEQ ID NO: 5883 - protein, 86 aa, Zea mays
  misc_feature: Ceres CLONE 325509-F
  misc_feature (14)..(14): Xaa is any aa, unknown, or other
  misc_feature (19)..(19): Xaa is any aa, unknown, or other
  misc_feature (32)..(32): Xaa is any aa, unknown, or other
  misc_feature (52)..(52): Xaa is any aa, unknown, or other
  misc_feature (57)..(57): Xaa is any aa, unknown, or other
MDLWERARAFAGEXRTVAXTLRGGAKRSSALXSETAKKSKEIFSETASKSRXIAAEXTKQADLLAGQIKHLASDLPVPSIPPIPGI

SEQ ID NO: 5884 - DNA, 219 bp, Zea mays
  misc_feature: Ceres CLONE 325532-F
  misc_feature (19)..(19): n is a, c, t, g, unknown, or other
  misc_feature (130)..(130): n is a, c, t, g, unknown, or other
acaccgcacacccttgckntctccaggcgtacttgcgtttassgtctcttccctgctgccatctctgtccggaggcaagccatggcggcgggcggggacggcgtcgctcgccaggcggasgtccgccggnatcgagggcaacatctgcttcaagaaggcgcgcctcggcgcgccatcgactgctacaccgaggcaattgcgctctgccccgacgtcgcc

SEQ ID NO: 5885 - DNA, 146 bp, Zea mays
  misc_feature: Ceres CLONE 325549-F
atcgcgagatctagcgagcgagcgcgcacactgctggcggcaccaggctacgacgatcgagagagccgccgtgccagcacattgtccattgtccgcgcggcggggatcgggcggacgcgcacataatatggcgcacgtgccgccca

SEQ ID NO: 5886 - DNA, 411 bp, Zea mays
  misc_feature: Ceres CLONE 325583-F
  misc_feature: Translation starting site: 35
  misc_feature (110)..(110): n is a, c, t, g, unknown, or other
  misc_feature (192)..(192): n is a, c, t, g, unknown, or other
  misc_feature (246)..(246): n is a, c, t, g, unknown, or other
  misc_feature (393)..(393): n is a, c, t, g, unknown, or other
aagggattcctaccgagggaggccgcacgcagccatggatttcctgcaggggcaaagcgtcgagaccacagtggccgtcgccgtcgctgtcgccgccgtcgccgcmgccnctttcctcctccttcgatccaggaagcccaagggctscttggatcctgagaacttcaggaatttcaaacttcttaaaakaancaaataattcataattttccaggttcaatttcgctcttccaactccaacttctntattgggccttccaatssggtcaacatatcagctgcagaggacaagacgctacaggtgaagaagtaatcaagccttatacccctactgacattggattctgatctkggatattttgagcttgtcataaagatgtatccccaaggganaatgtcccatcatttccg

SEQ ID NO: 5887 - DNA, 98 bp, Zea mays
  misc_feature: Ceres CLONE 325612-F
  misc_feature (48)..(48): n is a, c, t, g, unknown, or other
gttcctaggtaccccgctgcttccgtgctcacctcgcctgcagggccnagccgctggaagaacacgaagacgacgggagtgcggggtggcgtcgcgct

SEQ ID NO: 5888 - DNA, 393 bp, Zea mays
  misc_feature: Ceres CLONE 325622-F
  misc_feature: Translation starting site: 209
  misc_feature (39)..(39): n is a, c, t, g, unknown, or other
  misc_feature (40)..(40): n is a, c, t, g, unknown, or other
  misc_feature (323)..(323): n is a, c, t, g, unknown, or other
  misc_feature (326)..(326): n is a, c, t, g, unknown, or other
  misc_feature (350)..(350): n is a, c, t, g, unknown, or other
  misc_feature (380)..(380): n is a, c, t, g, unknown, or other
ataggttctccacgacgcggccacctccgccgccgccannccccctgctagggtcaacacccgctctctgcgactgcgtgaamaccagcggcggccaccgtgcaggacgagccccctccccaaacagagaggggcggggatcagtgcgtgcgcccctggtggagggcgtggaagagctgggcaggcggcaagcaggggtttcgggaggatggtttcgctctcgacttggttcctctrtgccgcacaaragttcgagtactgcgtttccctctcgttsaagaaatatratgatgtgggccagatcagcagcacacagttaactnatntgttacacaaarattkrtkccaangcragckcacctacgtgtgtcggaccaaangggaagrrgccat

SEQ ID NO: 5889 - DNA, 302 bp, Zea mays
  misc_feature: Ceres CLONE 325633-F
  misc_feature: Encodes the peptide sequence at SEQ ID NO. 5890
  misc_feature (56)..(56): n is a, c, t, g, unknown, or other
  misc_feature (266)..(266): n is a, c, t, g, unknown, or other
  misc_feature (272)..(272): n is a, c, t, g, unknown, or other
  misc_feature (298)..(298): n is a, c, t, g, unknown, or other
ctgccagtagccagttcgacacgaaacccacagcaaaaccggaacagaaagccttngaagcctaggcggaaascagaactgggaaggggagaagattctgatggggactaagaaacagggaggaggcggaggaaaccagaaggtcctcctctggaggctgccggtggtcacctctaaggagctcggcaagataggccccgccctcggaatcggcatcggctgcggcgccggcgcaggcatcggattcttcggtggtgcagggttangctatngatttcctggactcacattagctttngagt

SEQ ID NO: 5890 - protein, 67 aa, Zea mays
  misc_feature: Ceres CLONE 325633-F
  misc_feature (56)..(56): Xaa is any aa, unknown, or other
  misc_feature (58)..(58): Xaa is any aa, unknown, or other
  misc_feature (66)..(66): Xaa is any aa, unknown, or other
MGTKKQGGGGGNQKVLLWRLPVVTSKELGKIGPALGIGIGCGAGAGIGFFGGAGLXYXFPGLTLAXE

SEQ ID NO: 5891 - DNA, 374 bp, Zea mays
  misc_feature: Ceres CLONE 325654-F
  misc_feature: Translation starting site: 179
  misc_feature: SWISSPROT Homolog: EC 2.3.1.170 6'-deoxychalcone synthase
gcaaacccaaacacatgatcaaccaaacctcatcggccgggcaaacagcagctagcatacctgcgcgacggttttccccctcgccttggctatcgcggcgagcacctcggagtccagcacggcgctgccctgcccgtcccagttctgccctcccagcggcgagtaggccgsgacgtggatgcccctgtcggcgcagtacgccctgagcgtccgctgctgccacgccgggttcagctccacctggttcaccgcgggcgggaccgtggcgacggscatgaccccgtcgaggtgcctggtggtgaagttsctcacgccgatcgccttggscaggcccagccgsstggcactcctccatggcgcgccacacgcccgct

SEQ ID NO: 5892 - DNA, 839 bp, Zea mays
  misc_feature: Ceres CLONE 325698-R
  misc_feature: SWISSPROT Homolog: EC 3.1.2.15 Ubiquitin thiolesterase
tattagtcgttaggaggggcgaacgatatgtacttcacatcctaagtatgcatatccgggggagtagtgcgtaacataattgaagcaacttctccagtgaccactttacgaactgaaaaataaattaccacgctcggtcatgggcacaaaaactagtgttgcattcacaatacagaaatgtagaaccaattcaacctaactctttgattctgccatgcgggctttgtacaataaaatataagccatgtgccaatcacctccaccagaaagtttcgaaatgacttcatccttgcgaatgattggattgacatcatcaaactcaatccattttccatcatcttgcttaacccacccaacatactgaacagaatctgcacttcttcccttgtgtgacaagacagcaaccatatcatacacgccagtgaattgtttctttagaagacaagactcagctttgtcaatgaccatactatacgattccccaacgctactagatgactcctcattttcatctgagatgctagctatgccatgtactttcaatccaagctttgcatgttctgcatctctcagcatcagccgaggagatttgagtttctttttcagctcatcagagcacaattcctaaacatccaggtgcagagtgaaatccacttatcagtaaatcctcgccttttgagttgattcccttttccaaaagaaccgaatgaactgcacagtaaagaacctaggcagctcatctagtacttgatacactaaataaactgcaactcaacccaatgggagtgtagcctatctccagtcctgaactcaagccaagcttactctccacatgaaaa

SEQ ID NO: 5893 - DNA, 232 bp, Zea mays
  misc_feature: Ceres CLONE 325709-F
  misc_feature (69)..(69): n is a, c, t, g, unknown, or other
aggggttgtgaagggaaggagtgccgatggccggtggcacccggcgccgctgcgccggtggtggttgcnatgaaaggccacccagggtctggcaagtccacgtcggcgcgcgccatcgcgaccgcgcttttgctgtccgctcctggacaaggacgatgtgagggactgcatgttgcccctagaggcttggctggctgctgggctgctcaacgacctctcctacgccgtgctg

SEQ ID NO: 5894 - DNA, 392 bp, Zea mays
  misc_feature: Ceres CLONE 325721-F
  misc_feature: Encodes the peptide sequence at SEQ ID NO. 5895
  misc_feature (126)..(126): n is a, c, t, g, unknown, or other
  misc_feature (215)..(215): n is a, c, t, g, unknown, or other
  misc_feature (340)..(340): n is a, c, t, g, unknown, or other
  misc_feature (386)..(386): n is a, c, t, g, unknown, or other
atctctcgtgcctttttcctttcctggttgckacgagccgacgactgggcggacgcgctgccgccctacgccaggtcttcgtcggccccttcgacgagcacacacaagattcagtcgggaatcssntgaatgcatagtgtaatttctgcgcaaaaagatggcatcagacgagttcatcagccttgacgcaccttgtgaggctgatgcgaaagatnaagggggagacgttcaggttaaagctcctgatgtgagtgggatggagcctctggtatcggatctccaaccagaaggggaaagctggtgctgtgggtagtaatcccaagacatctgctgggaactngatcttsaagaggggcaagtggaagatatggacctcgcggatgatnacgtat

SEQ ID NO: 5895 - protein, 51 aa, Zea mays
  misc_feature: Ceres CLONE 325721-F
  misc_feature (20)..(20): Xaa is any aa, unknown, or other
MASDEFISLDAPCEADAKDXGGDVQVKAPDVSGMEPLVSDLQPEGESWCCG

SEQ ID NO: 5896 - DNA, 405 bp, Zea mays
  misc_feature: Ceres CLONE 325733-F
  misc_feature (331)..(331): n is a, c, t, g, unknown, or other
  misc_feature (392)..(392): n is a, c, t, g, unknown, or other
attgatcttcctggtgtggattcagggttatcgctaaagctcttctcttgaaggtttcacaagacttttccaaccgaacaaacctgtgacaaagggacaagctgccctagcattttcagctggtgattctggcgaagtggttctggaggagcttacccgtatcgaggcagagaaaatagctgaagcagctgtaaatgcacatgctgcattggttgctcaggtcgagaaagatcttaatgcaagttttgaragggagcttaaggaggaaagagaaagggtagagacccttgaaaaagtagctgaagaagctagggtggagctagataggttnagggcagaaagagaggaagagaagaacattctggtcaggggcagagctgctgttgagtctnaratggaagtkct

SEQ ID NO: 5897 - DNA, 404 bp, Zea mays
  misc_feature: Ceres CLONE 325760-F
  misc_feature: Encodes the peptide sequence at SEQ ID NO. 5898
  misc_feature (84)..(84): n is a, c, t, g, unknown, or other
  misc_feature (98)..(98): n is a, c, t, g, unknown, or other
  misc_feature (175)..(175): n is a, c, t, g, unknown, or other
  misc_feature (368)..(368): n is a, c, t, g, unknown, or other
  misc_feature (374)..(374): n is a, c, t, g, unknown, or other
  misc_feature (395)..(395): n is a, c, t, g, unknown, or other
aaaaccccgccagccagcggtgccgccgctgttgacatggacgacggcgacactcccagacgcaaatccgtcccagattggctngaacasccgatctnggtctgcgcctccgccgtctccacgccacagctcccttccccccacggcaccgtccccccctcagccgccaccatkntcctctgccctctccccagccacggcggatccgactcccatccctcctcccaacgccccacgcgacgccgatgtttcagacgacgaaggcaagggcgcgggcgccgttcgtgcgcccacctcgtcgctgagttcaaagtcgcgckggataggaaggtggtggatctggcagagctccggagctcgcatgccanggcgtncccgacgcgctggtattcggncatcgtctg

SEQ ID NO: 5898 - protein, 134 aa, Zea mays
  misc_feature: Ceres CLONE 325760-F
  misc_feature (28)..(28): Xaa is any aa, unknown, or other
  misc_feature (30)..(30): Xaa is any aa, unknown, or other
  misc_feature (33)..(33): Xaa is any aa, unknown, or other
  misc_feature (58)..(58): Xaa is any aa, unknown, or other
  misc_feature (107)..(107): Xaa is any aa, unknown, or other
  misc_feature (123)..(123): Xaa is any aa, unknown, or other
  misc_feature (125)..(125): Xaa is any aa, unknown, or other
  misc_feature (132)..(132): Xaa is any aa, unknown, or other
KPRQPAVPPLLTWTTATLPDANPSQIGXNXRSXSAPPPSPRHSSLPPTAPSPPQPPPXSSALSPATADPTPIPPPNAPRDADVSDDEGKGAGAVRAPTSSLSSKSRXIGRWWIWQSSGARMPXRXRRAGIRXSS

SEQ ID NO: 5899 - DNA, 291 bp, Zea mays
  misc_feature: Ceres CLONE 325765-F
  misc_feature: Encodes the peptide sequence at SEQ ID NO. 5900
atctcccatcgcaagaaaaaggaaatcaaaacaaagtaaagtggggggaaaagcatggcgatasstcttctcccatccgttcgtcttcttccacaaagtctctccagaaggccaccaccaacctcgtcgccattatccgttcgccgcccacggscaagagcccttcccctccctcgcgtccactgccgcgccggccggaccccggaccccctcaccgctgctagggaggctgctgccttttgggctgggaagctcgccggcgctgtgccatggaaggccgcggtctccggc

SEQ ID NO: 5900 - protein, 79 aa, Zea mays
  misc_feature: Ceres CLONE 325765-F
  misc_feature (4)..(4): Xaa is any aa, unknown, or other
  misc_feature (34)..(34): Xaa is any aa, unknown, or other
MAIXLLPSVRLLPQSLSRRPPPTSSPLSVRRPRXRALPLPRVHCRAGRTPDPLTAAREAAAFWAGKLAGAVPWKAAVSG

SEQ ID NO: 5901 - DNA, 391 bp, Zea mays
  misc_feature: Ceres CLONE 325771-F
  misc_feature: Encodes the peptide sequence at SEQ ID NO. 5902
  misc_feature (142)..(142): n is a, c, t, g, unknown, or other
  misc_feature (143)..(143): n is a, c, t, g, unknown, or other
  misc_feature (148)..(148): n is a, c, t, g, unknown, or other
  misc_feature (325)..(325): n is a, c, t, g, unknown, or other
acccactgcctcccactccctccacgcctcctcgcctctccttttcacccgttcctcgtctccctcctgcggtcctgcccccctcccctgcagccgctccctccatggcgtccttcgtcgtgcaccaccacggttcgccgcnngacanggagggcaaggtcaagatgtgcgccctggccctgaggagtagcctcagccgtgcgaggccgccgaggaggtcggggccgggcaggcgtggtgcagaggcgcggacatgggcatcgcgcctytgccgacgagttctccgtggaggacttgctggacctcgaggacctctgcgagttcnacaaggactscgccgagctgggcgacacggtgccggcgssggagtctsstgcaggaagaggacaag

SEQ ID NO: 5902 - protein, 95 aa, Zea mays
  misc_feature: Ceres CLONE 325771-F
  misc_feature (13)..(13): Xaa is any aa, unknown, or other
  misc_feature (15)..(15): Xaa is any aa, unknown, or other
  misc_feature (74)..(74): Xaa is any aa, unknown, or other
  misc_feature (87)..(87): Xaa is any aa, unknown, or other
  misc_feature (90)..(90): Xaa is any aa, unknown, or other
MASFVVHHHGSPXDXEGKVKMCALALRSSLSRARPPRRSGPGRRGAEARTWASRLCRRVLRGGLAGPRGPLRVXQGLRRAGRHGAGXGVXCRKRT

SEQ ID NO: 5903 - DNA, 279 bp, Zea mays
  misc_feature: Ceres CLONE 325782-F
  misc_feature: Encodes the peptide sequence at SEQ ID NO. 5904
accgctcactcactcgccattcggcagaggcgtgactgrctgaractgagcactagggctttgacagtgcagcagaggagggcgaaccatgggcgaggaggagaaggcgaaggaggcggcgccccggccgacaaagtaaaggaggcggaggagargaagggcgaggggggaggaggggaggagaagaagvsmcgaggccccgtctcttccaccgccgccgccggaggagttggtcatgcgggtcttcatgcactgcgagggttctgcgcgcaaggtcaa

SEQ ID NO: 5904 - protein, 93 aa, Zea mays
  misc_feature: Ceres CLONE 325782-F
  misc_feature (13)..(13): Xaa is any aa, unknown, or other
  misc_feature (15)..(15): Xaa is any aa, unknown, or other
  misc_feature (52)..(52): Xaa is any aa, unknown, or other
  misc_feature (64)..(64): Xaa is any aa, unknown, or other
TAHSLAIRQRRDXLXLSTRALTVQQRRANHGRGGEGEGGGAPADKVKEAEEXKGEGGGGEEKKXRGPVSSTAAAGGVGHAGLHALRGFCAQGQ

SEQ ID NO: 5905 - DNA, 207 bp, Zea mays
  misc_feature: Ceres CLONE 325808-F
  misc_feature (159)..(159): n is a, c, t, g, unknown, or other
gttcctattctgctgttactttgtsstccgcagccccacattctcctcctcgccacggtcgcggtcgtggtctcgctccggcaaacccaatggsscgccgccgtccccaacggccacaccgccgccgccggassacgacgacgcaccacccgccgcttnttcgtcgttggtgttcctgggcacggggtgctcgagcgcggtcccgaa

SEQ ID NO: 5906 - DNA, 432 bp, Zea mays
  misc_feature: Ceres CLONE 325841-F
  misc_feature: Encodes the peptide sequence at SEQ ID NO. 5907
  misc_feature (278)..(278): n is a, c, t, g, unknown, or other
  misc_feature (279)..(279): n is a, c, t, g, unknown, or other
cctcgttccctcgagaactgtaccatcacgcgccgcccgcccgcccttgattgagcagggactgggagagagggtgaaagggggcaagaaaacgcttcttgttgccgctgtgcttctgcggatccgcggtggctgcgcacgccggcggggaagaggagtcgctggcggcgcgcctccagtctttcttcacctccgtgctctccgggctcttcggccaggccgaggccgaggacgaggacgaagagatgcccacgcgcaaccacaacgctgccgcgcbnncgctccgcagcatcaccatcacaaccgaggtggtgctcccgctcttggaaagagcaaggccgtgcccggcgatgctgatgccatgaaccggcgagcccccctcggcgatattggcaacctcgtcagcgtccgcccagccgaaggaaacctcag

SEQ ID NO: 5907 - protein, 143 aa, Zea mays
  misc_feature: Ceres CLONE 325841-F
  misc_feature (93)..(93): Xaa is any aa, unknown, or other
LVPSRTVPSRAARPPLIEQGLGERVKGGKKTLLVAAVLLRIRGGCARRRGRGVAGGAPPVFLHLRALRALRPGRGRGRGRRDAHAQPQRCRAXAPQHHHHNRGGAPALGKSKAVPGDADAMNRRAPLGDIGNLVSVRPAEGNL

SEQ ID NO: 5908 - DNA, 293 bp, Zea mays
  misc_feature: Ceres CLONE 325844-F
  misc_feature: SWISSPROT Homolog: EC 2.7.11.1 Non-specific serine/threonine protein kinase
  misc_feature (191)..(191): n is a, c, t, g, unknown, or other
caccttcagcgagggacttgattcctagaatgctggttgttgatccgatgaaaaggattacaatacgtgaaatccgtgaacatgtgtggttcaaaattcaacttccgcgctatttagctgtaccgcctccggacactgcacaacaagttaagaagctggacgaggaaacccttaatgatgttattaagatngttttgacaagaatcagctaattgaatctctgcacaacagattgcagaatgaggtatctgcttcactctcagtttcctttggtcgttttatggaatcatgat

SEQ ID NO: 5909 - DNA, 213 bp, Zea mays
  misc_feature: Ceres CLONE 325852-F
  misc_feature (130)..(130): n is a, c, t, g, unknown, or other
  misc_feature (131)..(131): n is a, c, t, g, unknown, or other
ctttcaagttgaacgggttgccggcctaccgctgacagacgattcaaccgtccgccaaatccaaacgcaccgatccattccagaccatggcgacgaccaaggaccccgcgaccaccggcggcgagccgcnntcggattccctaccacccggcggcggattcccaggggcactactactacgcgccgccgccgaacccctacgcggcggggatg

SEQ ID NO: 5910 - DNA, 1215 bp, Zea mays
  misc_feature: Ceres CLONE 325873
  misc_feature: Encodes the peptide sequence at SEQ ID NO. 5911
aagatgggcccagtgtcagactcgtcttctcctgtgggaaccgtcttgctatcgtgctaggcattggggtgcgaccgaatccaacaggagaggaaaggggcgcttgctttatattccttctcggctgcaatctgcgtccatccatccagccgtctcggggcagccaagaggtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggcagtccgtccagcacgaagaatataaggttcactcccacaacagaaatgggctttgtgcggtggcatttatggatgatcactatcctgtacgaagtgcattttctcttctgaatcaggttcttgatgagtaccagaaggcttttggggaatcctggaaatctgctactgcagatggaactcaacagtgggctttcctgacagacgccttggcaagatttcaggaccctgcggaagctgacaaactaatgaaaattcagagggacttggatgaaacaaaaattattcttcataaaactattgatagtgtcctggccagaggagagagattggatagcttggttgagaaaagttctgatctaagtgctgcttctcagatgttctacaagcaggcaaagaagacaaaccaatgttgcacaatactttaaactttggtgcttcaatcatgtttgcaagaaacaaaaacggtcgatattgtgctaatttactgtaagttaagtcgcccatgaagcgtggacacgcggttgcaaggctcgagctcagtgctgttggtctcagtttgcaaggctatagttttctccaagacctgccgattggactgttttcttgtgagaattcctgctctccaaacagcacatggagtatcattctttagtggttatgaaactgcgtagtgcctgctaacaccatttattgtactatataaggcttgcctcaaactgcagaaattaccaaatattgttaaattctcaaagcttactggcagtggtggaccagtggcgaagacagcataaaaaaaaaaaaaaaa

SEQ ID NO: 5911 - protein, 210 aa, Zea mays
  misc_feature: Ceres CLONE 325873
  misc_feature (114)..(200): Pfam Name: Synaptobrevin Pfam Description: Synaptobrevin
MKITALLVLKPSTSGAGSSSSGGQSGPEAVVLANATDVSHFGYFQRSAAREFIVFVARTVAQRTQPGQRQSVQHEEYKVHSHNRNGLCAVAFMDDHYPVRSAFSLLNQVLDEYQKAFGESWKSATADGTQQWAFLTDALARFQDPAEADKLMKIQRDLDETKIILHKTIDSVLARGERLDSLVEKSSDLSAASQMFYKQAKKTNQCCTIL

SEQ ID NO: 5912 - DNA, 275 bp, Zea mays
  misc_feature: Ceres CLONE 325961-F
  misc_feature: Encodes the peptide sequence at SEQ ID NO. 5913
  misc_feature (36)..(36): n is a, c, t, g, unknown, or other
gaaataaaggactatctcagcgatttccgaaccctncccacccccacacccacccgatccaaccgagtcccggcggcgatggcggcggcggcgacgaacgcssatcgtggaggtggtcgacttcgactcgatgacgacgacctcatggacgaggacgccgggccggatccagcaccgccccccgcctcccgcctccgctccatcatcgcgggcgacgacgcgccgctaggaccaagggccgcggcttccgsaggaccctaactcctccgcgaccc

SEQ ID NO: 5913 - protein, 60 aa, Zea mays
  misc_feature: Ceres CLONE 325961-F
  misc_feature (9)..(9): Xaa is any aa, unknown, or other
  misc_feature (58)..(58): Xaa is any aa, unknown, or other
MAAAATNAXRGGGRLRLDDDDLMDEDAGPDPAPPPASRLRSIIAGDDAPLGPRAAASXGP

SEQ ID NO: 5914 - DNA, 293 bp, Zea mays
  misc_feature: Ceres CLONE 325965-F
  misc_feature (112)..(112): n is a, c, t, g, unknown, or other
  misc_feature (114)..(114): n is a, c, t, g, unknown, or other
gctattcgccccccaaactccggacgagccttccgcgcgacgctgcacggctccgcagccacccgtaaaaccctagacggctagccggcgcacggaagcgggcagcggrssnanggtgagcctctcctgcatcggattgtccccgcccccgctagcgccatgaagctgacggtgaagaccctcaagggaacgcacttcgagatccgggtgcagccaacgacacgattatggctgtgaagaagaatatagaagagatacaagggaaagacagctatccatggggccaacaactg

SEQ ID NO: 5915 - DNA, 1550 bp, Zea mays
  misc_feature: Ceres CLONE 325984
  misc_feature: Encodes the peptide sequence at SEQ ID NO. 5916
gaacgccccagccttccacctcgaactccgcggtgcccagcgccctcggtaaccgccctccgccctgccacagagacaggtcgacgagacagacaaaggccggccgccatgggagaggacaagaaggcgggcaacaaggacgccgccggcggcgacaagaagaaggacgccggcgccggggccgcgccgcagcccatcgtgctgaaggtcgacttgcactgcgccggctgcgccaacaaggtccgcaaggccatcaagcacgccccaggtgtggagtcggtgacgccggacatggcggcgggtaaggtggtcgtgaccggtccggcggacgcggtggagctcaaggagcgcatcgaggccagggcgaagaagcccgtgcagatcgtctccgccggcgccggcccacccaagaaggagaaggataagaaagcggacggcggcgagaagaaggcggacaaagagaagggcggcggcggcggagagaagaaggccgacaaggagaagggcggcggagagaagaaggccgacaaggagaagggcggcggagagaagaaggccgacaaggagaagggcggcggcgagaagaaggccgacaaggagaagggtgccgacaagcccaaggaggagaagaagaagcccaaggaggagactgtgacgctgaagatccggctgcactgtgacggctgcatcgagcgcatcaagcgccgcatctccaagatcaaaggcgtgaaggacgtggcgttcgacgccgccaaggacctggtgaaggtgaccggcaccatggacggcgccgctctgccggcgtacctcagggagaagctcagccgggacgtggaagtggtggcgcccggcaagaaggacggcggcggcggcggtggtgacaagaaggacaagggcgcaggagacgggggagagaagaagaaggacggtggcggcggcggcggcggcggcggcgccgaggaaaagaaggacaaggccggggccgcggccgcctccgcgtcggtggcgccgacgcccctggccgacgccggcatgtaccaggtgccgccgcactacgggtacgcgccgtaccaccagccggctccaggcggctactacggtgccgccccaccgcccatccaccacgccggcttctaccccaacggcggcgtccattacccgcccgcgccagcctacgcgtacggccccacccacctccacgcgccccagatgttcagcgacgagaaccccaacgcctgctccgtcatgtgaactcgctcgcttcgccggtttgccgccgccgccgccgccgcgcctaggctcccccttcctccgtgtgagaccaagaaccatgggcttggcctgggattagcggtgtctttagttaaaattatcagtgagtagtagctagcttaagcagtgctccgatccgagatcagttccagcagacctgtgtaaatgagagtcccgccgctccgccccgccccatcccggtgtaacgaatcgtcatgtgtaaaatgtatccggacccgataaagttttgcccttctgccaaaaaaaaaaaaaaaaaa

SEQ ID NO: 5916 - protein, 380 aa, Zea mays
  misc_feature: Ceres CLONE 325984
  misc_feature (30)..(92): Pfam Name: HMA Pfam Description: Heavy-metal-associated domain
  misc_feature (182)..(246): Pfam Name: HMA Pfam Description: Heavy-metal-associated domain
MGEDKKAGNKDAAGGDKKKDAGAGAAPQPIVLKVDLHCAGCANKVRKAIKHAPGVESVTPDMAAGKVVVTGPADAVELKERIEARAKKPVQIVSAGAGPPKKEKDKKADGGEKKADKEKGGGGGEKKADKEKGGGEKKADKEKGGGEKKADKEKGGGEKKADKEKGADKPKEEKKKPKEETVTLKIRLHCDGCIERIKRRISKIKGVKDVAFDAAKDLVKVTGTMDGAALPAYLREKLSRDVEVVAPGKKDGGGGGGDKKDKGAGDGGEKKKDGGGGGGGGGAEEKKDKAGAAAASASVAPTPLADAGMYQVPPHYGYAPYHQPAPGGYYGAAPPPIHHAGFYPNGGVHYPPAPAYAYGPTHLHAPQMFSDENPNACSVM

SEQ ID NO: 5917 - DNA, 335 bp, Zea mays
  misc_feature: Ceres CLONE 325991-F
  misc_feature (122)..(122): n is a, c, t, g, unknown, or other
  misc_feature (146)..(146): n is a, c, t, g, unknown, or other
agatcgatcgtccttcctgtcgtttcgttttctcgccggcaggcactgggtacgccgccgccgcctcaacgccaccacgctgccgccgcgccagttcgtcaccgcgagacacaagacacssngcctcgcttccctcgggccggttngcgtggccggcgtcgctgttctgttcctatttcttggcaactccgcccgtttcacctccggagaccgacagcgacggcgccagtagatagatgcactactgacgccactggccacctcgagttcgagtgccaagggacgccacgagaccaaccgtgagacaggacaacggtcgcctttgcccgcggatc

SEQ ID NO: 5918 - DNA, 329 bp, Zea mays
  misc_feature: Ceres CLONE 326017-F
  misc_feature: Encodes the peptide sequence at SEQ ID NO. 5919
  misc_feature (128)..(128): n is a, c, t, g, unknown, or other
  misc_feature (136)..(136): n is a, c, t, g, unknown, or other
  misc_feature (309)..(309): n is a, c, t, g, unknown, or other
gaaacctccatatacccaaacccaccgaccgccgcctaggttccacctctcccgctcaaactccggccactgaggtcgmacccgagcccgcgccgcagcgcacgatggtgaacgacgccgcggsgatngcgtcgtnagggcggcgcgccagccctccgtggcgcccacgatggcgtcgcttcgccgcccacgccgccttcctcgccgatgggtactcgctctgssccgtcggcctgcsscgctcgccgacccctcgcccttaggtgatgaggaggtggggattgatggttggaacatcatggagaattnttacgcctttttgtatagca

SEQ ID NO: 5919 - protein, 53 aa, Zea mays
  misc_feature: Ceres CLONE 326017-F
  misc_feature (19)..(19): Xaa is any aa, unknown, or other
  misc_feature (24)..(24): Xaa is any aa, unknown, or other
  misc_feature (47)..(47): Xaa is any aa, unknown, or other
MASLRRPRRLPRRWVLALXRRPAXLADPSPLGDEEVGIDGWNIMENXYAFLYS

SEQ ID NO: 5920 - DNA, 237 bp, Zea mays
  misc_feature: Ceres CLONE 326021-F
  misc_feature (92)..(92): n is a, c, t, g, unknown, or other
atcacatacaagtgtcacctctccggtccctcgcgaaccctagagccgcaccagcacactcccgcagcagtagccgccgccgccgccgccgnkcccagccgtagaaacaggaggaagatgccggcggggcacgggcttcggtcgcggacccgcgmttgttttcgcgcggccgttccgcaagaagggttacatcccgctcaccacgtacctgcgcacctacaagatcggcgactacgt

SEQ ID NO: 5921 - DNA, 293 bp, Zea mays
  misc_feature: Ceres CLONE 326065-F
  misc_feature: Encodes the peptide sequence at SEQ ID NO. 5922
  misc_feature (81)..(81): n is a, c, t, g, unknown, or other
  misc_feature (93)..(93): n is a, c, t, g, unknown, or other
  misc_feature (273)..(273): n is a, c, t, g, unknown, or other
cacgcccgacgcccccaccactctctcgacccaaagccagatcggcacgacgagcagaggcccccccccggagcggcgcgnassaatggcggncgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttntcaaggcccagatttcggga

SEQ ID NO: 5922 - protein, 97 aa, Zea mays
  misc_feature: Ceres CLONE 326065-F
  misc_feature (27)..(27): Xaa is any aa, unknown, or other
  misc_feature (28)..(28): Xaa is any aa, unknown, or other
  misc_feature (31)..(31): Xaa is any aa, unknown, or other
  misc_feature (91)..(91): Xaa is any aa, unknown, or other
RPTPPPLSRPKARSARRAEAPPRSGAXXWRXGYRAEDDYDYLFKVVLIGDSGVGKSNLLSRFTRNEFSLESKSTIGVEFATRSLQVDGKVXKAQISG

SEQ ID NO: 5923 - DNA, 301 bp, Zea mays
  misc_feature: Ceres CLONE 326104-F
  misc_feature: Encodes the peptide sequence at SEQ ID NO. 5924
  misc_feature (6)..(6): n is a, c, t, g, unknown, or other
  misc_feature (189)..(189): n is a, c, t, g, unknown, or other
gagtanggttctagcgcctatctggtttctccctgcgccgccgccgccgccgtgssacaaccggagcgtagtgcgaggggatgatggagggaggtagccgcgcggatgggcggaatccgaaccagctccggccgttcacctgcaccgggaacccgctccaccgcgcccacggctccgcgcggtggccanggcgacaccgtsstgctggccgctgtgtacgggcccaagtcgggaacccggaaggcgagaaccccgagaaggcctccatcgargtcgtgtggaagcccaagaccggccagat

SEQ ID NO: 5924 - protein, 72 aa, Zea mays
  misc_feature: Ceres CLONE 326104-F
  misc_feature (36)..(36): Xaa is any aa, unknown, or other
  misc_feature (40)..(40): Xaa is any aa, unknown, or other
MEGGSRADGRNPNQLRPFTCTGNPLHRAHGSARWPXRHRXAGRCVRAQVGNPEGENPEKASIEVVWKPKTGQ

SEQ ID NO: 5925 - DNA, 326 bp, Zea mays
  misc_feature: Ceres CLONE 326122-F
  misc_feature: Encodes the peptide sequence at SEQ ID NO. 5926
  misc_feature (315)..(315): n is a, c, t, g, unknown, or other
  misc_feature (316)..(316): n is a, c, t, g, unknown, or other
ggatcggagtatcggacggctcactacccagaaaagggctcgtggagcttctcttaatctcttgtaaaaaaaaaaccttgacaagaacgaattcgcctccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgssscgcggactccttccgcgaaaaccgcgccctcgccgatgcgtcggccgccgccgcggtnnctcggagggg

SEQ ID NO: 5926 - protein, 60 aa, Zea mays
  misc_feature: Ceres CLONE 326122-F
  misc_feature (6)..(60): Pfam Name: Complex1_LYR Pfam Description: Complex 1 protein (LYR family)
  misc_feature (38)..(38): Xaa is any aa, unknown, or other
  misc_feature (58)..(58): Xaa is any aa, unknown, or other
MAAAAPTRAEVLSLFRSLLRTAKKFSDYNIREYTRRRXADSFRENRALADASAAAAVXRR

SEQ ID NO: 5927 - DNA, 469 bp, Zea mays
  misc_feature: Ceres CLONE 326164-F
  misc_feature: Encodes the peptide sequence at SEQ ID NO. 5928
  misc_feature (436)..(436): n is a, c, t, g, unknown, or other
cttttgccctctccgcgcaccttccaccacgctctggattctggagctgtttcccctttctcgagagtttagaaagctggtgcagagatggccggggagagctgcgtccccaagtccctgttcggcggcgcatcttcaccaccttccccgaccgcttccaggacgtgagcaacatccgggaggtccccgaccatcaggaggttctcgttgatccatcccgcgacgagagcctcattttcgagctacttgacctcaagggcgaggtggacgacgccggcggcgctctggttcctgcaagacatcgccaacgagcaagacgccggggacaacttggtggtagagcattctgggacacttgaactggctgctttgcatctcggagaagctcctgcagtggctgcaactgcagttggccagctggcgtctcaaaagggangcagggcagagaagcacaaaacattgttcgaat

SEQ ID NO: 5928 - protein, 118 aa, Zea mays
  misc_feature: Ceres CLONE 326164-F
FALSAHLPPRSGFWSCFPFLESLESWCRDGRGELRPQVPVRRRIFTTFPDRFQDVSNIREVPDHQEVLVDPSRDESLIFELLDLKGEVDDAGGALVPARHRQRARRRGQLGGRAFWDT

SEQ ID NO: 5929 - DNA, 86 bp, Zea mays
  misc_feature: Ceres CLONE 326170-F
cgaataagcaatggcgcgcacaatggcagccatcgcgatcttgctcgccgccttcttcgtcctcgctccggatctggccaccgcag

SEQ ID NO: 5930 - DNA, 448 bp, Zea mays
  misc_feature: Ceres CLONE 326181-F
aattcatctatcccccgctctctccatctctctaccctttctctctctcggatagctagctcttcttcttcctccttcctccgtttggatcagacgagagggtatgtagtggtgcaccacgagttggtgaagctgccagcatgatctggttctgatggtggtggtatatgtaagatggatgtaatctatactacggcccctgttaatttctctctctctccccggtccctgactgtcatatatggatcgacgaatccaagatgagggggaatggagagagagagagagggtaattatgagcaccaggaccaggtcatgctgtagtttcatctgctggtggccgcacatcgaaaaccctagctagctctagtagctagctcatcctcgtgcaattcatatccatgctgcactcgccagaccaccagtcaagctagcttatttccgccgt

SEQ ID NO: 5931 - DNA, 331 bp, Zea mays
  misc_feature: Ceres CLONE 326245-F
  misc_feature: Encodes the peptide sequence at SEQ ID NO. 5932
  misc_feature (225)..(225): n is a, c, t, g, unknown, or other
araaaggtccctcgttcagtcgttcctcaacctacctccgctgctccgcgctcgaccgcctttgcctgccttcccattcccccgtctcctcttcccttccgccatggcccagcccgctttcctctcctctctccgctcccgcctctgctccgcgccgccgcccccgccgaaccatcgcctccagcctaggcgcggctaccacgtcgagctcggggctcgcgaaanagcgcttttggaggaggatgttgctttgaagaggttcaaatcatacaaaarcagtgtgaaacaggtctccaagatcgggaatgctctcactttagctgttgtactt

SEQ ID NO: 5932 - protein, 76 aa, Zea mays
  misc_feature: Ceres CLONE 326245-F
  misc_feature (41)..(41): Xaa is any aa, unknown, or other
  misc_feature (58)..(58): Xaa is any aa, unknown, or other
MAQPAFLSSLRSRLCSAPPPPPNHRLQPRRGYHVELGAREXALLEEDVALKRFKSYKXSVKQVSKIGNALTLAVVL

SEQ ID NO: 5933 - DNA, 383 bp, Zea mays
  misc_feature: Ceres CLONE 326251-F
  misc_feature: Translation starting site: 52
  misc_feature (358)..(358): n is a, c, t, g, unknown, or other
gccttgaaccctagctcccgcaactgccgccgccaccccacgcctgcagccatgccgcccaagctcgacccgtcgcaggtggtggaggtgttcgtccgtgtgaccggcggcgaggtaggcgcggcgtcttcgctggcccccaagatcggtccgctcggtctttctcccaagaagatcggagaggacatcgccaaggagacggccaaggactsgaagggcctccgcgtcaccgtcaagctcactgtccagaaccgacagccaaggtctccgtcgttccctctgccgcggccctcgtcatcaaggcgctcaaggagcccgagaggtaccgcaagaaggtcaagaacatcaagcacagcgncaacatcagtctcgacgatgtcatc

SEQ ID NO: 5934 - DNA, 387 bp, Zea mays
  misc_feature: Ceres CLONE 326258-F
  misc_feature: Encodes the peptide sequence at SEQ ID NO. 5935
  misc_feature (121)..(121): n is a, c, t, g, unknown, or other
  misc_feature (256)..(256): n is a, c, t, g, unknown, or other
  misc_feature (330)..(330): n is a, c, t, g, unknown, or other
  misc_feature (356)..(356): n is a, c, t, g, unknown, or other
aacaagtcctgagcgaacctcgccactcgcccactccgctcccaaagaagaagaagacgacgacgacagcaaggtgccgccgtcacgagatccgtccgaggtgaccatgtctacgcctacnaggaagcgtcccaggaaaaccaacggctccacgtcgtcgtcgtcgtccgckatgcgtcggacgacaacctgtcggacctcgcgccgccgccggatctctccgggaagcccaagacgcgggcggcgagggggcatncggtggcaaggccagggaccgcgtggggcgccgagataacgatgacgcactcggcggacttcctccccgccatngagacggcagccttcctcaaggcctncgggatctgcaaccgccgcctcggccccggc

SEQ ID NO: 5935 - protein, 30 aa, Zea mays
  misc_feature: Ceres CLONE 326258-F
  misc_feature (11)..(11): Xaa is any aa, unknown, or other
  misc_feature (20)..(20): Xaa is any aa, unknown, or other
MTHSADFLPAXETAAFLKAXGICNRRLGPG

SEQ ID NO: 5936 - DNA, 171 bp, Zea mays
  misc_feature: Ceres CLONE 326266-F
acactcgaacacttccaaagttctagcccctctcgtgagtcctgtccaaataatggccacgcgcmrgtgtcctcctgcttctgacggcgctcgtcgcagccacgcctgtgccgtcagcggcgaccaggaagctcatcgttcctcgtccagccacagccgaacctcctcacg

SEQ ID NO: 5937 - DNA, 295 bp, Zea mays
  misc_feature: Ceres CLONE 326289-F
  misc_feature: Encodes the peptide sequence at SEQ ID NO. 5938
  misc_feature (123)..(123): n is a, c, t, g, unknown, or other
  misc_feature (130)..(130): n is a, c, t, g, unknown, or other
  misc_feature (136)..(136): n is a, c, t, g, unknown, or other
  misc_feature (155)..(155): n is a, c, t, g, unknown, or other
gaaaaagaagaaaaggcatgccgatgatgagtgagacattcttcggaagagaatgtgcgggtacaaatgctgggactcagctgttctgtaaaatgggtatcacggggttagaaaacatattcnabatcantttttngggttacctggtttttttnggggacctggcttgtattcaacaattacttgctcggtctagatgatgatggaatttttaacttttgctgttgtaaccccataaatttagtatgattgtssatggtaactctgcaactgagagaccttccattctcaaaaa

SEQ ID NO: 5938 - protein, 60 aa, Zea mays
  misc_feature: Ceres CLONE 326289-F
  misc_feature (36)..(36): Xaa is any aa, unknown, or other
  misc_feature (38)..(38): Xaa is any aa, unknown, or other
  misc_feature (40)..(40): Xaa is any aa, unknown, or other
  misc_feature (46)..(46): Xaa is any aa, unknown, or other
MPMMSETFFGRECAGTNAGTQLFCKMGITGLENIFXIXFXGYLVFXGDLACIQQLLARSR

SEQ ID NO: 5939 - DNA, 249 bp, Zea mays
  misc_feature: Ceres CLONE 326313-F
ttaagtgtaagggcgagagactccaatttgtggagattcctcgcaagtgggataaagataagcaaagcaaaacatcgtggtattcaagtgggtctttggaccgcttgagaggggttgattgcaaccctcgtccgctgggacgccacaacgtgagtaggcaagcgttggtcttggccgaaccacgggataaaaaaaaaaaacaacgagaaaaaaaaaaaaaaaaaaaaaaaaaaaaaaaaaaaaaaaraa

SEQ ID NO: 5940 - DNA, 475 bp, Zea mays
  misc_feature: Ceres CLONE 326359-F
  misc_feature: Encodes the peptide sequence at SEQ ID NO. 5941
atactgtttggtttccatccctggcagatctcccactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtcctgtggtcgaccgccttcttgctggtgcgggcgctgttccccaagcgctcctacgacttctgcaaccgcgccgtctccaccatgcacgccgtcgcygccgtgtgcctcgcctgcctctccgtcgacgactggtcgtgccccgtctgcccgctcgccgccgcatcctcccctcgccagatgaaggcgctggcggttacsstggcgtacatggtgtacgacgcggcggtgctgccacctcaacggcgacacgcggcttggacaacgccgtgcaccacct

SEQ ID NO: 5941 - protein, 124 aa, Zea mays
  misc_feature: Ceres CLONE 326359-F
  misc_feature (99)..(99): Xaa is any aa, unknown, or other
MATAAAAAAAAMEEPDVVNGRDVVSWVASGVVLWSTAFLLVRALFPKRSYDFCNRAVSTMHAVAAVCLACLSVDDWSCPVCPLAAASSPRQMKALAVTXAYMVYDAAVLPPQRRHAAWTTPCTT

SEQ ID NO: 5942 - DNA, 439 bp, Zea mays
  misc_feature: Ceres CLONE 326370-F
  misc_feature: Encodes the peptide sequence at SEQ ID NO. 5943
agaaaccctaacactcatcacgccgccactgatctgctctgttgctggtgactaggagcagtagcrgagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttgggtacctggaatttaa

SEQ ID NO: 5943 - protein, 60 aa, Zea mays; identical to SEQ ID NO: 1569
  misc_feature: Ceres CLONE 326370-F
  misc_feature (3)..(42): Pfam Name: Ribosomal_L29e Pfam Description: Ribosomal L29e protein family

SEQ ID NO: 5944 - DNA, 423 bp, Zea mays
  misc_feature: Ceres CLONE 326391-F
  misc_feature: Encodes the peptide sequence at SEQ ID NO. 5945
  misc_feature (345)..(345): n is a, c, t, g, unknown, or other
  misc_feature (348)..(348): n is a, c, t, g, unknown, or other
  misc_feature (410)..(410): n is a, c, t, g, unknown, or other
  misc_feature (418)..(418): n is a, c, t, g, unknown, or other
gtgaggtgtgagcctcagcacgacgggattgcgcccacacgcgacgccaaacgaaacagctagccagcccccattcttctccggctccggtgcattccgtgtcctgtcctgtcctgtcctgatggaagcagcaatggctgscacgtcctccctactccttgcctccggstccaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaccgccgtctcgtcgtcgtcgtcatcggaaanatnggttctcgaccctgcaggagacggtgactggcgccacatcggctacaaagtcgcgcgccctngggcatcnagata

SEQ ID NO: 5945 - protein, 96 aa, Zea mays
  misc_feature: Ceres CLONE 326391-F
  misc_feature (3)..(3): Xaa is any aa, unknown, or other
  misc_feature (71)..(71): Xaa is any aa, unknown, or other
  misc_feature (72)..(72): Xaa is any aa, unknown, or other
  misc_feature (93)..(93): Xaa is any aa, unknown, or other
MAXTSSLLLASGSRRWPATLPPSPWPQQQRLVFCLAARTRPLDSKRGSWRRSSSATGGRSTAVSSSSSSEXXVLDPAGDGDWRHIGYKVARPXASR

SEQ ID NO: 5946 - DNA, 390 bp, Zea mays
  misc_feature: Ceres CLONE 326408-F
  misc_feature: Encodes the peptide sequence at SEQ ID NO. 5947
  misc_feature (180)..(180): n is a, c, t, g, unknown, or other
aggagaaaaccaggaatcccataaagataaaggtttcagtttcggaagccaagccactcccacacccccacgctcgagcgaagggagccagcaatggcgcgtcgsggggccgtgagagacgggaacaagaatggctgccatggtgcgcgggccggcgatggcctctgcggctgggccggngtgcgacgtcggcggctgctgcggccgcggcggaggagatgcggtggcggcactagacagcggcgtgasscggttgtcgttcgggttcgtggccaccgccatactcgtgtccatgttcctcgccatggccatcctcgagcacttcctccgccccacgacgtcgacccacgcgccgccccggggccgggcttccctccgccgcctccgcct

SEQ ID NO: 5947 - protein, 86 aa, Zea mays
  misc_feature: Ceres CLONE 326408-F
  misc_feature (17)..(17): Xaa is any aa, unknown, or other
  misc_feature (40)..(40): Xaa is any aa, unknown, or other
MAAMVRGPAMASAAGPXCDVGGCCGRGGGDAVAALDSGVXRLSFGFVATAILVSMFLAMAILEHFLRPTTSTHAPPRGRASLRRLR

SEQ ID NO: 5948 - DNA, 489 bp, Zea mays
  misc_feature: Ceres CLONE 326410-F
  misc_feature: Pfam Name: 3_5_exonuc Pfam Description: 3'-5' exonuclease
  misc_feature (129)..(129): n is a, c, t, g, unknown, or other
  misc_feature (479)..(479): n is a, c, t, g, unknown, or other
atataaaccgaccccaacgcatccattatattcagcttcttgatctcacacgaaggcatggcgacggagatccagggctactacgatgacggcaccgcskgggtgtcgttcgacgtgcacaacatcganaccacgctgacgaacttgggcagcgtgtggagtggtggctgggygagacctatcgcctccaccaccgcggccacatcccggcctcgacgtggagtggcgccccgctcgcgtgccgggccccgtccccgtcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggccgggtacaggctcgggggtggcgagcgccgtggacctgcgcgttctcgctgccgacacgctggaggtncccgagctgc

SEQ ID NO: 5949 - DNA, 413 bp, Zea mays
  misc_feature: Ceres CLONE 326424-F
acttgtgacagtttctcatacatcacagacaatgaataccaagaagaatgttgttctttgctgccttcttttcgtgctcgttctgcatgcagatcacgctctagccaagtgtggctatacaactcctttaattccattctgcaaagcgtggatgtgcaaggcggagtgttggacggaggctaagttaactggaggcaaagtcacgcaacagaagtgcatgagaggcgggatcaagggctggtgttactgcgaattctgcatttrattttgcaaaggagaaggatcaccatttctttgcttggtcttgccttggtcaataacttagtgtaataatgctagttaagtctctaggcagactaggctagatcgagttgtttgttgttggtagctaggcattgctagcgtctgctatt

SEQ ID NO: 5950 - DNA, 268 bp, Zea mays
  misc_feature: Ceres CLONE 326457-F
  misc_feature: Encodes the peptide sequence at SEQ ID NO. 5951
gagaactcagtctggagacgacccaacgtcccagctgctggccaactttcgcctttcttcgccatcatcgcctcctctcccattcattccttccttccttccacacgagagcctgcctttttcccgatccgcatcgtcatcaaatgggccatcttttcctcctcctggtagccctcctcctactcacctccacgcgtgccgccgccgccgtccacgccaaagcttcggtcattgaggaggcgagtttcgctggcatcagaggcgtgat

SEQ ID NO: 5951 - protein, 41 aa, Zea mays
  misc_feature: Ceres CLONE 326457-F
MGHLFLLLVALLLLTSTRAAAAVHAKASVIEEASFAGIRGV

SEQ ID NO: 5952 - DNA, 412 bp, Zea mays
  misc_feature: Ceres CLONE 326462-F
  misc_feature: Encodes the peptide sequence at SEQ ID NO. 5953
  misc_feature (204)..(204): n is a, c, t, g, unknown, or other
gattcttcttcttcttcttattcagacattatcaagaagttgccaccagcagcagcggcagtagccatgggcatcctggaccacctgtcgcatctgtgcagcatcacggagacgaaggaggcgctcaagctcaggaagaagcgaccgctgcagactgtgaacagtcaaggtgaagatggactgcgaagggtgcgagcgccgckngaaagagcgcggtgaagtcgatgcgcggcgtgacgagcgtggcgttgaacgcaagcagagcaagtgcacggtgaccggcaacgtggagcccgccaaggtgctggagcgcgtcaaggccaccggcaagaacgccgagatstggccctacgtgccctacgcgctcaccacctacccctacgtcggcggcgctacgacaagaaggcgccgc

SEQ ID NO: 5953 - protein, 79 aa, Zea mays
  misc_feature: Ceres CLONE 326462-F
  misc_feature (10)..(10): Xaa is any aa, unknown, or other
  misc_feature (56)..(56): Xaa is any aa, unknown, or other
MDCEGCERRXKERGEVDARRDERGVERKQSKCTVTGNVEPAKVLERVKATGKNAEXWPYVPYALTTYPYVGGATTRRRR

SEQ ID NO: 5954 - DNA, 492 bp, Zea mays
  misc_feature: Ceres CLONE 326500-F
  misc_feature: Translation starting site: 136
  misc_feature (131)..(131): n is a, c, t, g, unknown, or other
  misc_feature (272)..(272): n is a, c, t, g, unknown, or other
  misc_feature (406)..(406): n is a, c, t, g, unknown, or other
  misc_feature (445)..(445): n is a, c, t, g, unknown, or other
  misc_feature (483)..(483): n is a, c, t, g, unknown, or other
aaagtaaattctgttgctccaattcggacgaggagatgccgcggatccctctgatcaggttccccaagcggaatctcaaagccccatctccatccgcgccagsgttcgcaacccgcagaccagcacgcgancctcatgttccggttaggggctaaagcagaggcaccatcttctggagagattaaaaattaccgctttagatctgatgtgccttgcccaccttctcatactgccgtagaggttccagcttcactccttcctaagcgcaaacnytgactgaagaagagattgaggctattatgctggggggctccatctgatatcacctcatatgaattggaaattctaggaacatcaataagattgtatgcctgagcttatkgcctttgacctctgaaagagtgtntattgaagccatgtcgatatggaagtgtttttttaaatncagtctggaagttggctgttgagacatccatttccagnactccgcac

SEQ ID NO: 5955 - DNA, 482 bp, Zea mays
  misc_feature: Ceres CLONE 326504-F
  misc_feature: Translation starting site: 95
  misc_feature (434)..(434): n is a, c, t, g, unknown, or other
ttcgcttccgtcagtcgggtccgcagcctccccctctcgcagatccccacctgctcctccgccggccaccgcgttgctcccctcggcagccaggatgacagaagtaccatttctgccgcgtgagaggctcttcaagcagcaacattacttccagaacttgaccaagcacacctacctgaaaggcgctacgacgtgatcacctccgtcgccatcccccttgcactcgckgcctccagcatgttcatgattgggcgtggagtttacaacatgtctcatggggttgggaagaaagagtgatcttccactggttaactattgtttctgcttggcatggaagtcataccgtcgagactgcgaagtcctcttcctttgcaaaataatacggccaaataacaattcgactacattttcgcatcaattttctgtttgtattngtgggtgtgaagtggcagtaacttgaaaatcagcactgtcactgtttt

SEQ ID NO: 5956 - DNA, 486 bp, Zea mays
  misc_feature: Ceres CLONE 326542-F
  misc_feature: Encodes the peptide sequence at SEQ ID NO. 5957
  misc_feature (387)..(387): n is a, c, t, g, unknown, or other
agtccactcacaagcgacaagatatatcttagacattttcagtttgataatggatccaagatatgttactttattcatcttcttagtacttgccttacatggagatactactttggcagaaacttgcaggcagtttgttaaagtgcatccattctgctttaaagcaatgtgcaaggcaaattgtgctatagagggaaaattctctgatggttcctatgtaaaggattacagatgtgaatcaggtggatttcactcggtgtgtgtttgcattttgtgcaaacattagttatctaaagacaagcggagatatcttcttgtattcctatatgttatttaggagtattgtccaaataattatacggtagcttagttaactagctagtttgnttatttatagatatatgtagcactagttaactagttgttatttcttctcagctatataccaggwaacatgttttcagcgcttcaataatatatctttgt

SEQ ID NO: 5957 - protein, 78 aa, Zea mays
  misc_feature: Ceres CLONE 326542-F
MDPRYVTLFIFLVLALHGDTTLAETCRQFVKVHPFCFKAMCKANCAIEGKFSDGSYVKDYRCESGGFHSVCVCILCKH

SEQ ID NO: 5958 - DNA, 365 bp, Zea mays
  misc_feature: Ceres CLONE 326570-F
  misc_feature: Encodes the peptide sequence at SEQ ID NO. 5959
  misc_feature (195)..(195): n is a, c, t, g, unknown, or other
aatatttccatcctccattcacgcatcacaagctggaaggcactkttgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcgncggssccaccaacggcacctgggaccgcatcgtcctgccggagtgcgcgccctcggaccgcatcgtccgtctctcccccgcgcttcgctgggagcaggcgcgcgasscgctgcacgccggcgtcgacgtgggcaacgttctcggcgtcgggcccggcatgcccttcgcgc

SEQ ID NO: 5959 - protein, 103 aa, Zea mays
  misc_feature: Ceres CLONE 326570-F
  misc_feature (47)..(47): Xaa is any aa, unknown, or other
  misc_feature (49)..(49): Xaa is any aa, unknown, or other
  misc_feature (82)..(82): Xaa is any aa, unknown, or other
  misc_feature (83)..(83): Xaa is any aa, unknown, or other
MALLTLQQPAIPFLLLLLLLPAASARLPGGRTLVFILAGQSNMSGRXGXTNGTWDRIVLPECAPSDRIVRLSPALRWEQARXXLHAGVDVGNVLGVGPGMPFA

SEQ ID NO: 5960 - DNA, 332 bp, Zea mays
  misc_feature: Ceres CLONE 326584-F
  misc_feature: Translation starting site: 79
  misc_feature (10)..(10): n is a, c, t, g, unknown, or other
  misc_feature (103)..(103): n is a, c, t, g, unknown, or other
  misc_feature (168)..(168): n is a, c, t, g, unknown, or other
  misc_feature (233)..(233): n is a, c, t, g, unknown, or other
  misc_feature (255)..(255): n is a, c, t, g, unknown, or other
  misc_feature (317)..(317): n is a, c, t, g, unknown, or other
  misc_feature (323)..(323): n is a, c, t, g, unknown, or other
agggaatcanggaagtgaactagcggtccacgatactccgacgcccactttgctacctcggaaccctagccgccgcccatgssmtatcgccggagaccggscncggtagcgatacgcaaaaggagtggtacgttctttgaccttgtttattgctgcgcccgaggsstntggcgcggggggagcaggaaggayaggggaagwwcagawggggaaggcgggcggggccgcggatntcggtgcggatcaaggcggttntagaccggttcgtgaaggagctgcaggaggcgctggacgcggacatccaagaccgcgtcatnaaggancgcgagatg

SEQ ID NO: 5961 - DNA, 738 bp, Zea mays
  misc_feature: Ceres CLONE 326595-R
  misc_feature (1)..(1): n is a, c, t, g, unknown, or other
  misc_feature (356)..(356): n is a, c, t, g, unknown, or other
  misc_feature (359)..(359): n is a, c, t, g, unknown, or other
  misc_feature (360)..(360): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (370)..(370): n is a, c, t, g, unknown, or other
  misc_feature (374)..(374): n is a, c, t, g, unknown, or other
  misc_feature (379)..(379): n is a, c, t, g, unknown, or other
ncgattgggtaccgggccccccctcgaggtcgacggtatcgataagcttttttttttttttttttacccaaacaaagagcaccttgcattccatatttatacaaacagcccggcgcaactatctgagcccacctacagctaccacacacgacacacgtcgcaaaccagccctgaagctaccaggctaccagcacactacgctaggcgttcgacttgggcgcgcccgcgcccgtgcccgcgccaccgcgcgccgccacgacccggcgccgcaccacggcgtacgcaacgccgatagccaccagcgcggcagctgccgcgccgacgaacacgcccgccacttggtgggggccgtggcnccnntnnntatccncggncgccncgcccccttcttcccggtcggccttggccacgcttgccgacgatgttcctcctcggaccgcggactctctcagctgctgctgctgcccgcgaggcgcgagcgccggcgccggcgccggggcgacgccgcgatctcgacgggcgcgcgcgctggggtggaagaagtcgtaagcggccggagacagcgcgagcgggctctcgaaggggagcccgtgcgggtgcgccgcggtgggcctcctctcctcgccgcgcccgacgggtagagtcgtaataagcaggagagcgatcaccgccaccgctgcccgcattgcggcggtctttgccatggctccgggtttttcgattaggatgttctaggta

SEQ ID NO: 5962 - DNA, 456 bp, Zea mays
  misc_feature: Ceres CLONE 326678-F
  misc_feature: Encodes the peptide sequence at SEQ ID NO. 5963
  misc_feature (2)..(2): n is a, c, t, g, unknown, or other
angccttccgttttgggaaggcgaggagaggggaacccggggagagttgggggatcggcggcggaggagatggaggagcgggagaagctcgtgtgcctggccaagcttgccgagcaggcggassggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggttgactactaccgtta

SEQ ID NO: 5963 - protein, 124 aa, Zea mays
  misc_feature: Ceres CLONE 326678-F
  misc_feature (4)..(125): Pfam Name: 14-3-3 Pfam Description: 14-3-3 protein
  misc_feature (18)..(18): Xaa is any aa, unknown, or other
  misc_feature (19)..(19): Xaa is any aa, unknown, or other
MEEREKLVCLAKLAEQAXXYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKG

SEQ ID NO: 5964 - DNA, 269 bp, Zea mays
  misc_feature: Ceres CLONE 326732-F
  misc_feature: Encodes the peptide sequence at SEQ ID NO. 5965
  misc_feature (171)..(171): n is a, c, t, g, unknown, or other
agcataggaccaagatcatagtgccgtccctgccggcagagagcaagatggtctcacactcactctcagcatggctcatgtcctcggcgccgcgcgggtggattcgccgccctggtcgccgtgggcatgtacacggcgctgcgktccgccgccaccttcctggcgtggctncaccgcgcgttcctgcggccaggccgggacctggcggggcggtacgggacgtgggcggtggtgaccggggccacggacggcatcgggcgcgcggtggc

SEQ ID NO: 5965 - protein, 47 aa, Zea mays
  misc_feature: Ceres CLONE 326732-F
  misc_feature: SWISSPROT Homolog: EC 1.1.1.62 Estradiol 17-beta-dehydrogenase
MYTALRSAATFLAWLHRAFLRPGRDLAGRYGTWAVVTGATDGIGRAV

SEQ ID NO: 5966 - DNA, 454 bp, Zea mays
  misc_feature: Ceres CLONE 326735-F
  misc_feature: Encodes the peptide sequence at SEQ ID NO. 5967
actgctatatatatagaatccagaccattggtgttgctcacgcttccactacaacagcatcatcgatcgccgagcgtgcgtgctctagctctagcaatagcagcgaggagacggtcgaggatggatcagaacaacagcaacaggcagcagcagcaggcgccgccgccaccacccgcgggctacccgacggcaggcgcggassagcagggaggcagcggcaggaagcagggacgccgggggaagacgacctcgcgcggggagaagggcttcatcgaaggatgcatcgcggcgctctgctgctgctggatctgcgagatgtgctgcgactaggcagcccccccttccctccgccgccassttttgagcctttgacaggaacggagagatctgctccacccatagctgcagttgtggctgcacgtacttgttggagctgttgtgttgtgtccatctc

SEQ ID NO: 5967 - protein, 69 aa, Zea mays
  misc_feature: Ceres CLONE 326735-F
  misc_feature (27)..(27): Xaa is any aa, unknown, or other
  misc_feature (28)..(28): Xaa is any aa, unknown, or other
MDQNNSNRQQQQAPPPPPAGYPTAGAXXQGGSGRKQGRRGKTTSRGEKGFIEGCIAALCCCWICEMCCD

SEQ ID NO: 5968 - DNA, 137 bp, Zea mays
  misc_feature: Ceres CLONE 326748-F
  misc_feature (73)..(73): n is a, c, t, g, unknown, or other
acccctaatttttctccagccgccgcgctcctgatccttatctctgcgcgcgctgcatcggcgcccgccgggnaggattcccgcccgcytcgtccatgttgtgggtccgcaatatccgccgcttcgtcgacacgggc

SEQ ID NO: 5969 - DNA, 515 bp, Zea mays
  misc_feature: Ceres CLONE 326763-F
  misc_feature: Encodes the peptide sequence at SEQ ID NO. 5970
tgaaaggaaggaagatgatgaaaggaaggaagaggatggaagcaagtctctcagctctgaagagaaaccacagcagacaagtacggctaccgatgaagaacctgcaggaagcaaaggaaccaccgaggatcagatggacgtggacagcgggaatggagatggtggagttgtaggccctgtcccaccagcaccagacactgaagggggtaatgacgaakatcggttcaagagatcagtgaagcccagcccttgccttgaagacggcgctcctttcccttaaagccccgctttcttctcccgcacctggtgatcttcacgatgttgttgttgcacagcaggtccggactgagtatttcctatttggttctatttttagtgcactataatatcacaagcgackaccaattggttgtgagctatattggcatatccttcccmtttgtgtattcccttgaacaatgaatcagaacaactgtttaccaattttctaaaggatcgactggcttatgtactca

SEQ ID NO: 5970 - protein, 92 aa, Zea mays
  misc_feature: Ceres CLONE 326763-F
  misc_feature (73)..(73): Xaa is any aa, unknown, or other
ERKEDDERKEEDGSKSLSSEEKPQQTSTATDEEPAGSKGTTEDQMDVDSGNGDGGVVGPVPPAPDTEGGNDEXRFKRSVKPSPCLEDGAPFP

SEQ ID NO: 5971 - DNA, 219 bp, Zea mays
  misc_feature: Ceres CLONE 326879-F
aactgcaaggcagcacccaagacacgcagcgcaggcgcasscagccagattcgacccgagttcacgacgagagcacgagatggcgatgcgaaccgcgctgacctccctccccgcgcgcctgcgttcccttgcgscccccgcggcgacgggcggccggcgctcccttcagcgacgkgaaggggcgcgtgcycagcgaggaggagcgckccaaggagagcg

SEQ ID NO: 5972 - DNA, 385 bp, Zea mays
  misc_feature: Ceres CLONE 326905-F
  misc_feature: Encodes the peptide sequence at SEQ ID NO. 5973
acgcatgttctcctgcctccgctccgccgccgcaacaaccatttccctcctctagccgccgcctccgatcccctcccgaggctacagaaccagttcatccaggcgcgaatggcggcggcgaggagcctgcttctgaggcacctccgcttggcgcggccccgtcagcggcgtccgtgagccgacgsgtcgttgcatgaggccctgtggggcagcggtggatgtcttcggaggatgccaagggctctttcctggataagagcgaggtcactgaacgcatcatcaaggtcgttcaagagctttcccgaagatcgatgacccctccaaggtgacaccagatgcccatttcaagaatgatcttggssctagacagtttggatgcagtgga

SEQ ID NO: 5973 - protein, 36 aa, Zea mays
  misc_feature: Ceres CLONE 326905-F
MSSEDAKGSFLDKSEVTERIIKVVQELSRRSMTPPR

SEQ ID NO: 5974 - DNA, 503 bp, Zea mays
  misc_feature: Ceres CLONE 326908-F
  misc_feature: Encodes the peptide sequence at SEQ ID NO. 5975
aaaaaatcgcaagaaaaaggaaatcaaaacaaagtaaagtgggggggaaagcatggcgatasstcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgcttttgggttgggaagctcgccggcgttgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcacgccaggaaaaccgtttgcgccaagagatagaagacctggagaaagatacagggtacaaactgcgagttcttgcacaaaattatcc

SEQ ID NO: 5975 - protein, 99 aa, Zea mays
  misc_feature: Ceres CLONE 326908-F
  misc_feature (4)..(4): Xaa is any aa, unknown, or other
MAIXLLPSVRLLPQSLSRRPPPTSSPLSVRRPRPRALPLPRVHCRAGRTPDPLTAAREAAAFGLGSSPALCHGRPRSPAWSPSPSPSPALLVWPMPELG

SEQ ID NO: 5976 - DNA, 400 bp, Zea mays
  misc_feature: Ceres CLONE 326914-F
  misc_feature: Encodes the peptide sequence at SEQ ID NO. 5977
gaaaatttggcgccattccaggaatcgcgaaaagaaaaggtcctacctcgtatcgcgtccaattgctttgctcattctcgtgctcggcaggggaacggtgcgamggaggagcggcgatgcagatccgggtgcagtgcgcgtgcggcgagtcgtcgtgcccggaatgggccgtcgtggagctgcagggcgtggtgcagccgcasscttccttcgccggcgacatccggggactccacatcggccgcctcttgctcctccccttccccagcctccgcctcgtccaaggcagggttcaccttcacggtggggtacacgagytcgccggcacaaaggtgacgctcaagaagcccctgctggtgctcaggaagaagaaggttaatgctggtactcaggaagaaga

SEQ ID NO: 5977 - protein, 94 aa, Zea mays
  misc_feature: Ceres CLONE 326914-F
  misc_feature (29)..(29): Xaa is any aa, unknown, or other
  misc_feature (30)..(30): Xaa is any aa, unknown, or other
  misc_feature (68)..(68): Xaa is any aa, unknown, or other
MQIRVQCACGESSCPEWAVVELQGVVQPXXSFAGDIRGLHIGRLLLLPFPSLRLVQGRVHLHGGVHEXAGTKVTLKKPLLVLRKKKVNAGTQEE

SEQ ID NO: 5978 - DNA, 304 bp, Zea mays
  misc_feature: Ceres CLONE 326953-F
acccacaagaagctagggaaaccgggggagaaacggaaggccggggcgcctctggtttcgtcgtctccgcccgtttgtttccccctcttccatggcgtggcaggcagggtcatctcggcacctggctggctataagtagctcacctggctgcatccatcactgcaatcaagcacgcatccacgaaatccaagagcagcagcagcagaccaagatcgagggagtgaggaagacagacagacagacagacagagagatggagcggatgagctcgtcggtgcagtcctgggtggaggaacacaagct

SEQ ID NO: 5979 - DNA, 468 bp, Zea mays
  misc_feature: Ceres CLONE 326994-F
  misc_feature: Encodes the peptide sequence at SEQ ID NO. 5980
cccagacttgcgcgcgcctccgctgctgcgacggcgagcccaagaaaaatttcctttacgagcgcatggaggtgtccgctgggctccggctgccgcccgtcgctgcggcagcgtcgctccttggctgtcggtccgcgtcggtgccgccgcgcgcggcttcccattcggtgcggtccgtgtcccgcgctgttaagatcagagcagctgcaattaacggcctccaaagaaacagaagtaatttcgaatcattattccgctacgacaaatctgtccccgagcaggacattggagaaccatctggtctaaatctggaaaagaagaatgtcggggacaagcctccctgctcaagctgtgaagctaaaggtgccttgctgtgtgcaacgtgcgctggttcaggcttgtacgtcgactcgatactagagagccagggaaatcatcgtgaaagtccagatgcctagggttgcggtg

SEQ ID NO: 5980 - protein, 130 aa, Zea mays
  misc_feature: Ceres CLONE 326994-F
MEVSAGLRLPPVAAAASLLGCRSASVPPRAASHSVRSVSRAVKIRAAAINGLQRNRSNFESLFRYDKSVPEQDIGEPSGLNLEKKNVGDKPPCSSCEAKGALLCATCAGSGLYVDSILESQGNHRESPDA

SEQ ID NO: 5981 - DNA, 531 bp, Zea mays
  misc_feature: Ceres CLONE 327011-F
  misc_feature: Encodes the peptide sequence at SEQ ID NO. 5982
ccacaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggcctttggcggttccgcggggctgcctggcgccaggccgggggcgtgggccgtcgccgccctggtctctctcgtcgccttcctcgtgaactgagggtgtgggcatcgtgctgcgcagcgcgggagatgggagggacgaatcctgcgatctggatcgctgggagaggagagggggatatttatgttcgttctgtttgttctagggtgctctcttttgcctgtataagagaggatcatgaa

SEQ ID NO: 5982 - protein, 75 aa, Zea mays
  misc_feature: Ceres CLONE 327011-F
MAASTKTVAVLLAAVLLALVASAAASRKLEEEDALLGSLAPAPAPAFGGSAGLPGARPGAWAVAALVSLVAFLVN

SEQ ID NO: 5983 - DNA, 496 bp, Zea mays
  misc_feature: Ceres CLONE 327025-F
  misc_feature: Encodes the peptide sequence at SEQ ID NO. 5984
ataatcgactgggctggccgtcgctggctcgctgctacttcggccccttcgccagcgaacgataacccaccagttatccgagggaaaattttctatgtgctggttggaatggcgagtacagcatgctttgtaattgtcagtaagaatgatatcccaatctacgaggcagaagttggatctgcacccaaaaaagaggatttgtcttatcaccatcgagtttatcctgcatgctgcgttagatgttgttcaggacgtagcatggaccacaaatgcaatgtccctgaagtcagttgatagattcaatgaccttgtggtgtctgtttatgtaactgctggtcataccagattcatgttgcttcatgactcacgcagtgaagatggaataaaaggcttttttcaagaggtccatgagctttacgtcaagatattcctgaacccgctttacctgcccggctctcgcatcacatcctctcattttgataccaaggagatggtg

SEQ ID NO: 5984 - protein, 117 aa, Zea mays
  misc_feature: Ceres CLONE 327025-F
  misc_feature (1)..(114): Pfam Name: Sedlin_N Pfam Description: Sedlin, N-terminal conserved region
MISQSTRQKLDLHPKKRICLITIEFILHAALDVVQDVAWTTNAMSLKSVDRFNDLVVSVYVTAGHTRFMLLHDSRSEDGIKGFFQEVHELYVKIFLNPLYLPGSRITSSHFDTKEMV

SEQ ID NO: 5985 - DNA, 520 bp, Zea mays
  misc_feature: Ceres CLONE 327089-F
  misc_feature: Encodes the peptide sequence at SEQ ID NO. 5986
ataatcgactgggctggccgtcgctggctcgctgctacttcggccccttcgccagcgacgataacccaccagttatccgagggaaaattttctatgtgctggttggaatggcgagtacagcatgctttgtaattgtcagtaagaatgatatcccaatctacgaggcagaagttggatctgcacccaaaaaagaggatttgtcttatcaccatcagtttatcctgcatgctgcgttagatgttgttcaggacgtagcatggaccacaaatgcaatgtccctgaagtcagttgatagattcaatgaccttgtggtgtctgtttatgtaactgctggtcataccagattcatgttgcttcatgactcacgcagtgaagatggaataaaaggcttttttcaagaggtccatgagctttacgtcaagatattcctgaacccgctttacctgcccggctctcgcatcacatcctctcattttgataccaaggtcaggccctcgcgaggaagtactctaatacacgg

SEQ ID NO: 5986 - protein, 137 aa, Zea mays
  misc_feature: Ceres CLONE 327089-F
  misc_feature (9)..(133): Pfam Name: Sedlin_N Pfam Description: Sedlin, N-terminal conserved region
MASTACFVIVSKNDIPIYEAEVGSAPKKEDLSYHHQFILHAALDVVQDVAWTTNAMSLKSVDRFNDLVVSVYVTAGHTRFMLLHDSRSEDGIKGFFQEVHELYVKIFLNPLYLPGSRITSSHFDTKVRPSRGSTLIH

SEQ ID NO: 5987 - DNA, 515 bp, Zea mays
  misc_feature: Ceres CLONE 327150-F
  misc_feature: Encodes the peptide sequence at SEQ ID NO. 5988
atatttaacgataacgaaggtaaagaagccgataactctgagataggaggtgggattgcagagtcacgcgtcagttcgttccctcctctgtgtaccggccagtaaaatccgaacccacagcgagaaatggcggcggcagcgctccgtccggcgatcctccgccgcatccgcctctccccctcccctttgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctggggctcgacagcctggacaccgtcgaggtggtcatggccatcgaggaggagttcaagctcgagatcccagacatggaggctgacaagatcgactcactccctctggccatcgagtacgtcgctaaccaccc

SEQ ID NO: 5988 - protein, 129 aa, Zea mays
  misc_feature: Ceres CLONE 327150-F
  misc_feature (59)..(126): Pfam Name: PP-binding Pfam Description: Phosphopantetheine attachment site
  misc_feature: SWISSPROT Homolog: EC 6.1.1.13 D-alanine--poly(phosphoribitol) ligase
MAAAALRPAILRRIRLSPSPLLALAAAGTGASHPHALGRWLARPMSSHDAHLTRDEVIDRILDVIKSHPKIDPSKVTPEAHFEKDLGLDSLDTVEVVMAIEEEFKLEIPDMEADKIDSLPLAIEYVANH

SEQ ID NO: 5989 - DNA, 521 bp, Zea mays
  misc_feature: Ceres CLONE 327191-F
  misc_feature: Encodes the peptide sequence at SEQ ID NO. 5990
cttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcaccctgtctccaatacctagaggatgataaggcagctgtctatctgtgttgcgcttcactaagtgtgattgtaacagtggtacctcttgtgttctggtgttccgcgatgttgcagttggttgcttgatcgaaagatgtttcaacctcccatctgctagctatgatacagatggtcccctgataataatgatgacatattctgtgatggatg

SEQ ID NO: 5990 - protein, 62 aa, Zea mays
  misc_feature: Ceres CLONE 327191-F
  misc_feature (1)..(62): Pfam Name: TMA7 Pfam Description: Translation machinery associated TMA7
MSKQGGKAKPLKAPKADKKEYDETDLAYLQKKKDEEKALKELKAKAQKGAIGGSGLKKSGKK

SEQ ID NO: 5991 - DNA, 542 bp, Zea mays
  misc_feature: Ceres CLONE 327202-F
aaccctaataacttttcctactcctgccgcatcagactagcgagccaagccaccgacggccgacgtcgagcctccgcggccgagcctccgcctagcaccaactccgtcgtcgatcgtcctatgcgaccacgccctcgtccgccttccgtctcctgcctccactgagtcgcgggcgcgacatcggggaacgccaaggctgagcttcgcccagacgcttaccgccctgttatgccccgaaccgccgtgctgaggtccgcccaggtcgggccaggagcttctcccggcagacccacccccgcccaacggagctccatgcctccgcctagggccattgtccgagctacgccccacgctcctgtccagtgccctggccacttagatggttctgctcagtcatggtatttgtctggttcaacaacttcaacttcaaccaagggacgcatctatcacaagacgtatggttgccaaatgaatataagtgacatggagattgtgctttctatcatgaaaaatgaagcgatacgggtctgccatctctatat

SEQ ID NO: 5992 - DNA, 516 bp, Zea mays
  misc_feature: Ceres CLONE 327256-F
  misc_feature: Encodes the peptide sequence at SEQ ID NO. 5993
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcscgctctcgtccatcacccacctcgtgtacgtctcgtcgagcgaggcgcgc

SEQ ID NO: 5993 - protein, 143 aa, Zea mays
  misc_feature: Ceres CLONE 327256-F
  misc_feature (10)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (127)..(127): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGXLSSITHLVYVSSSEAR

SEQ ID NO: 5994 - DNA, 551 bp, Zea mays
  misc_feature: Ceres CLONE 327263-F
  misc_feature: Encodes the peptide sequence at SEQ ID NO. 5995
  misc_feature (313)..(313): n is a, c, t, g, unknown, or other
ttcaacctctagctgattgatctctggtttaccactctttccttccctccttcaattctaaataccacaaatcaaagttgctttgcgatgtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacayaactgtgacgacccggagctcaaggagagagctcaccagactctgcaagwycgacgaccgtgaggactcggnacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggbgcggcgcgctctcgtccatcacccacctcgtgtacgtctcgtcgagcgaggcgcgcttcccgggcggcgacctgcacctggcgcgcgcgct

SEQ ID NO: 5995 - protein, 76 aa, Zea mays
  misc_feature: Ceres CLONE 327263-F
  misc_feature: SWISSPROT Homolog: EC 2.3.1.74 Naringenin-chalcone synthase
  misc_feature (47)..(47): Xaa is any aa, unknown, or other
MSDEILKNYPELAQEGLPTMNQRLDISNAAVTQMATEASLSCVRSWXGALSSITHLVYVSSSEARFPGGDLHLARA

SEQ ID NO: 5996 - DNA, 510 bp, Zea mays
  misc_feature: Ceres CLONE 327276-F
  misc_feature: Encodes the peptide sequence at SEQ ID NO. 5997
aaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctcgctgtgtgtcggagtaccgctttagttttgccgatccgggcacgagtccccgctg

SEQ ID NO: 5997 - protein, 134 aa, Zea mays
  misc_feature: Ceres CLONE 327276-F
  misc_feature (32)..(128): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDGYSPIYNEDDWSPTGDVYVGGTTGLLIWAVTLAGILGGGALLVYNTSALSLCVGVPL

SEQ ID NO: 5998 - DNA, 472 bp, Zea mays
  misc_feature: Ceres CLONE 327278-F
  misc_feature: Translation starting site: 209
  misc_feature: SWISSPROT Homolog: EC 2.7.10.2 Non-specific protein-tyrosine kinase
  misc_feature (393)..(393): n is a, c, t, g, unknown, or other
actcttccatagcatagcagagcakgcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggcagaaggacgcctatgtaggtgacgaggcacagtcnaaaagaggtatcttgaccttgaagtaccccattgagcacggtatcgtgaacaactgggwtgatatggagaaaatctggc

SEQ ID NO: 5999 - DNA, 452 bp, Zea mays
  misc_feature: Ceres CLONE 327318-F
  misc_feature: Encodes the peptide sequence at SEQ ID NO. 6000
cccgttcacttctctttggcccgaaaccgagagctagtgcttgattcggtcgtttttgggcaccgaacacgttcttgggaccgccgccgcgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccattcaatcctttaccgtgtcattcaggacccatcttcttctgctgatgcactgagaacaaaagaagttgcaattacaaatcttacaaactacctcactaaagaaaacagagctgaggagctgcgtaatcttttgacccagctcagaccattttttgcagttattcctaaggcaaagactgcaaaaatt

SEQ ID NO: 6000 - protein, 46 aa, Zea mays
  misc_feature: Ceres CLONE 327318-F
MSSSMESSYLPATTESLAQAQEAKDASESIQSFTVSFRTHLLLLMH

SEQ ID NO: 6001 - DNA, 528 bp, Zea mays
  misc_feature: Ceres CLONE 327327-F
  misc_feature: Encodes the peptide sequence at SEQ ID NO. 6002
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgctttcccgggcggcga

SEQ ID NO: 6002 - protein, 148 aa, Zea mays
  misc_feature: Ceres CLONE 327327-F
  misc_feature (10)..(146): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGRR

SEQ ID NO: 6003 - DNA, 533 bp, Zea mays
  misc_feature: Ceres CLONE 327335-F
  misc_feature: Encodes the peptide sequence at SEQ ID NO. 6004
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcggcgacctgca

SEQ ID NO: 6004 - protein, 149 aa, Zea mays
  misc_feature: Ceres CLONE 327335-F
  misc_feature (10)..(149): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGGDL

SEQ ID NO: 6005 - DNA, 641 bp, Zea mays
  misc_feature: Ceres CLONE 327380-R
ccgattgggtaccgggccccccctcgaggtcgacggtatcgataagcttttttttttttttttttagcaaacagccgcaattcatttatatgaaaagattgcgtggtacaaacacacacacagcttgatacattggcatgcgacatcagtctcgtcgcgcctctcgcaactacgggacgacaaagaaaaaaagagagaaaaatacaaaattacagagaaatcaacagcacgttcagacaccacgggactgcagagaccgtggagggagtgggaagaattccattcctcaacctcctcctcgtcttctggcaccgcctctcgccaaagcccggatgcatgcaacgccacctcccgaaggccgaagcccgaagcacgccttcgatcacgctcccagctagctgtaatttaaggttaataattcaccaaggagcggtacgtccctccggccttccagctggccgggatgacattgctggcgacgaggaccttgccggagtcggaggtgaggcggagcgagaagggcgcgctcagcgccttgccggagttggagttgtagcgccacagcgcgccccagttctgcaccatcggggtccatgtgccgcacccggcctccatgaggtcgacggcgctgaggtcgccgt

SEQ ID NO: 6006 - DNA, 518 bp, Zea mays
  misc_feature: Ceres CLONE 327410-F
  misc_feature: Encodes the peptide sequence at SEQ ID NO. 6007
actcccacaccacgctcgagacgagagccagctctcccagcacacgagcacatggcgtccaccaccctcctcgctgtcttcctgctcgtggctgcgtccgcagcgccggcgcggtcttgctcacctcgcgacctgcaggcgctgttgagcgtgaagcaggcgctagggaacccggcaacgctgtcgacgtggaccccagcgtcgcccgactgctgctcgtgggaccacctccggtgtaacgacgccggacgcgtgaacaacgtgttcatcgacggcgcggacgacgtgcgcgggcaaatcccgtcggcggtgggcgggctgacggagctcatgtcgctgaccctgttccggctggcggggctgacgggccccatcccggcctgcctggccgcgctgtccaacctgcagttcctgaccgtctcccacaccaacgtgtccggcgccatcccggagtccctggcgcggctgcgcggcctcgactcggtggactctccagcaaccagctgacgggcggcatc

SEQ ID NO: 6007 - protein, 151 aa, Zea mays
  misc_feature: Ceres CLONE 327410-F
  misc_feature (24)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MASTTLLAVFLLVAASAAPARSCSPRDLQALLSVKQALGNPATLSTWTPASPDCCSWDHLRCNDAGRVNNVFIDGADDVRGQIPSAVGGLTELMSLTLFRLAGLTGPIPACLAALSNLQFLTVSHTNVSGAIPESLARLRGLDSVDSPATS

SEQ ID NO: 6008 - DNA, 535 bp, Zea mays
  misc_feature: Ceres CLONE 327411-F
  misc_feature: Encodes the peptide sequence at SEQ ID NO. 6009
gtgtcttccatcgctccccttcctcgtgtgcggtgagcgtcgtggggtcgtgcgtcgtggccttgtagacgatttcgagggagagaggcaaagaaacggagcgcgtgcggcgttcgtcggcaacgttggcgtccatggagagcaccgcgggtccgagaaagaggcagaaggccgcctcggcctctggatccgtggccccgtacttgccccaggatctcgtacggaacatcctcctccgcctgccttccaggtccgtcctccgcttccgcgccgtttgcaaggactggctccggatcgtctccgaccgcgagttcgcggccgaccacaaccgccaccagccggcgatgcccctcgtctccttcctccgcagcgccgccggtagcaagagggggcagacggactgctgcgtcgacgcatttgacctcagcgccgacagtttccggccgtcttccggttcaccgacaaggggacgcggtgcggcagcttcgacatccacggctcctgcgasggtctccttccttctcagcttcgatgc

SEQ ID NO: 6009 - protein, 133 aa, Zea mays
  misc_feature: Ceres CLONE 327411-F
  misc_feature (19)..(66): Pfam Name: F-box Pfam Description: F-box domain
  misc_feature (125)..(125): Xaa is any aa, unknown, or other
MESTAGPRKRQKAASASGSVAPYLPQDLVRNILLRLPSRSVLRFRAVCKDWLRIVSDREFAADHNRHQPAMPLVSFLRSAAGSKRGQTDCCVDAFDLSADSFRPSSGSPTRGRGAAASTSTAPAXVSFLLSFD

SEQ ID NO: 6010 - DNA, 228 bp, Zea mays
  misc_feature: Ceres CLONE 327490-F
  misc_feature: Encodes the peptide sequence at SEQ ID NO. 6011
ccgtctcggaacagcgcggaccaccagagcgtgcgcgtccgtgcccccacccctccctctctatccatggcggtcccccgcgggtgcctcggcctccccctggtcgccgtgctcctcgcgtccctctgccgcgcccaggcggcggtgagggagctcaaggtcgggtactacgccgagacgtgcccggaggckgaggacattgtccgtgagaccatggcgcgcgcgcgc

SEQ ID NO: 6011 - protein, 54 aa, Zea mays
  misc_feature: Ceres CLONE 327490-F
MAVPRGCLGLPLVAVLLASLCRAQAAVRELKVGYYAETCPEAEDIVRETMARAR

SEQ ID NO: 6012 - DNA, 1154 bp, Zea mays
  misc_feature: Ceres CLONE 327552
  misc_feature: Encodes the peptide sequence at SEQ ID NO. 6013
gcacagcttcaccagctagctgaaactactagccccaacagcccccgcctctactcctcgcttccggcacgtgtcccgtcgcttctgcttgcgagttgcagacggctcgacgacccatcgatcgatcgaccgtgtcttcttcttgccggcggcggagacgagcgagctgctgtcaggtcggctgctagctgctagctgctgcaggcggcagcatggcgcacgggatcatcgggagccactaccactccatgttggcgtcgcgcgtgggcatggtcgcgcacgtgctgttcctgaccaccgccgtgctcatgctcgtctggctgctgcactaccgcggcggcatcaacatacagtccgaggaccccgagcagattttcaatgttcatccatttgtgatgtcctgggggttcattcttctgattggagaagcaatcctggcatactcgacgatccctgcgcacatagaccaccggacgcagaagatggcgcacatgctgatccacctggtggggctcatcctggccatcttcggcgtgtacgcggcgttcaagttccacgacgcggccgtggcgccggacctgacgagcctccactcgtggctcggcatcgccgccgtcgcgctcttcggcctgcagtggctgttcggattcgtcaccttctggctgcccgccgcgcacgccgacacccgcgccgccgcggcccccgcgcacgtcatggccggcctggccatcttcatgctcgccgtgtgcgccgcgcagaccggcctcgtggagaagagcgccgcggccgcctccgccgccgagctgaagctcatcaacgtcacggggatcttcatcctcctctacgggctcactgtggcgtccgccgttcgcgctgcgcaaggccttctttgtaggcggctgtttgctcggtcggcgctccgcatctcgctggcgcgcgttccgccgttgacgtgacacggttggtgtttccctcgtacacgcgggagatggtttgtgggtggttcgctcgtgtaatgttgtgcatattgcgtgagttttctgcgggctgcggctagtcggctaccacctgttgtatctctattctttccatgtcttcatcttttcttcttaaaaaacacgcacttgagtttgtctttaaaaaaaaaaaaaaaa

SEQ ID NO: 6013 - protein, 247 aa, Zea mays
  misc_feature: Ceres CLONE 327552
  misc_feature (19)..(231): Pfam Name: Cytochrom_B561 Pfam Description: Cytochrome b561
MAHGIIGSHYHSMLASRVGMVAHVLFLTTAVLMLVWLLHYRGGINIQSEDPEQIFNVHPFVMSWGFILLIGEAILAYSTIPAHIDHRTQKMAHMLIHLVGLILAIFGVYAAFKFHDAAVAPDLTSLHSWLGIAAVALFGLQWLFGFVTFWLPAAHADTRAAAAPAHVMAGLAIFMLAVCAAQTGLVEKSAAAASAAELKLINVTGIFILLYGLTVASAVRAAQGLLCRRLFARSALRISLARVPPLT

SEQ ID NO: 6014 - DNA, 410 bp, Zea mays
  misc_feature: Ceres CLONE 327565-F
  misc_feature: Encodes the peptide sequence at SEQ ID NO. 6015
aatttttccccgcatccgcagctcacatcgctcccccgaacccaaacccaaatcccaagcaaccacttcgtcgaccatggggcagggcactccgggagggatgggcaagcagggcggcgccggcgaccgcaagccgggggacgccggcgaaaagaaggacaagaagttcgagccgccggccgcgccctcccgcgtcggcaggaagcagcgcaagcagaagggcgccgaggccgccgcgcgcctccccaacgtcgcgccgctctccaagtgccgactccgcctcctcaagctcgaccgggtcaaggactacctcctcatggaggaggagttcgtcgccgctcaggagcgcctccgcccccaggaggacaaggccgaggaggaccgatccaaggtcgacgacctccgaggca

SEQ ID NO: 6015 - protein, 111 aa, Zea mays
  misc_feature: Ceres CLONE 327565-F
MGQGTPGGMGKQGGAGDRKPGDAGEKKDKKFEPPAAPSRVGRKQRKQKGAEAAARLPNVAPLSKCRLRLLKLDRVKDYLLMEEEFVAAQERLRPQEDKAEEDRSKVDDLRG

SEQ ID NO: 6016 - DNA, 490 bp, Zea mays
  misc_feature: Ceres CLONE 327608-F
  misc_feature: Encodes the peptide sequence at SEQ ID NO. 6017
agcccgcagtaggagtgttgaccgctgttgccacacttctcaccaaggcagggagggactgccgtctggggagagttgccagcaaagtgccaaaggaaaggggaatcgccatcagctcctccaactccgacccacacccacggcacggcagtcggcagcagccagcgtcgagcgcagtgccctcttgtctgctgcctcctacctccccgcccgctgccccgcgcccagtctcactcacacactcacacggtccgatcggagggggctgaggagatggagccagattcggcgacgacgaggctcgcattgctggcgctgcttctcctggcggcgcccgcccgcccggcctcggcggctccggtggaggatggcctgctcagcaatggtgactttgagacggcaccagccggcggtttcgtaagatctgcgtctgttgctgagggtgcatcgtcaatccctggttggacaatcaatggcacagtcgagctca

SEQ ID NO: 6017 - protein, 72 aa, Zea mays
  misc_feature: Ceres CLONE 327608-F
MEPDSATTRLALLALLLLAAPARPASAAPVEDGLLSNGDFETAPAGGFVRSASVAEGASSIPGWTINGTVEL

SEQ ID NO: 6018 - DNA, 490 bp, Zea mays
  misc_feature: Ceres CLONE 327643-F
  misc_feature: Encodes the peptide sequence at SEQ ID NO. 6019
gacctctcctgctcctccgaatcctgaaaccaaccagatcacacgaaccaaaccaccgcctcctcccccgaccggagaggagcctcaccgccggcgcccatggcgacacgctacttgatcgtgtcgctgcccgtgcagtcgcccggcgccaccgccagctccctgtggtcgcgcctccaggactccatctcccgccactccttcgacaccccgctctaccgcttcaacgtcccggatctccgcgtcggcaccctcgactcgctcctcgcgctcagtgacgacctcgtcaagtccaatgtcttcgtggagggcgtgtcacacaagatccggatgcagatcgaggacctcgagcgcgccggaggggtcgagaccgggaccctcaccgtcgacggcgtccccgtcgacacctacctcactaggttcgtgtgggatgagggcaagtaccccacaatgtcccctctcaaggagatcgtcggcagcatacagtcac

SEQ ID NO: 6019 - protein, 130 aa, Zea mays
  misc_feature: Ceres CLONE 327643-F
  misc_feature: SWISSPROT Homolog: EC 3.6.3.14 H(+)-transporting two-sector ATPase
MATRYLIVSLPVQSPGATASSLWSRLQDSISRHSFDTPLYRFNVPDLRVGTLDSLLALSDDLVKSNVFVEGVSHKIRMQIEDLERAGGVETGTLTVDGVPVDTYLTRFVWDEGKYPTMSPLKEIVGSIQS

SEQ ID NO: 6020 - DNA, 483 bp, Zea mays
  misc_feature: Ceres CLONE 327723-F
  misc_feature: Encodes the peptide sequence at SEQ ID NO. 6021
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagattgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtytgataatgagactccatacactattatgtttggtccagataaatgtgggtcaa

SEQ ID NO: 6021 - protein, 140 aa, Zea mays
  misc_feature: Ceres CLONE 327723-F
  misc_feature (24)..(140): Pfam Name: Calreticulin Pfam Description: Calreticulin family
  misc_feature (123)..(123): Xaa is any aa, unknown, or other
MMGGRALLLLLVSALLVQIRASDPLLYEPFDEDFEGRWIVSKKDEYQGVWKHAKIDGHEDYGLLVSDKARKYAIIKELDEPVTLNDGTVVLQFEVRLQNGLECGGAYIKYIRPQDAGWDAKEXDNETPYTIMFGPDKCGS

SEQ ID NO: 6022 - DNA, 496 bp, Zea mays
  misc_feature: Ceres CLONE 327813-F
  misc_feature: Encodes the peptide sequence at SEQ ID NO. 6023
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctytcgtccatyacccacctcgtgtacgttc

SEQ ID NO: 6023 - protein, 137 aa, Zea mays
  misc_feature: Ceres CLONE 327813-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYV

SEQ ID NO: 6024 - DNA, 508 bp, Zea mays
  misc_feature: Ceres CLONE 327839-F
  misc_feature: Translation starting site: 117
  misc_feature: SWISSPROT Homolog: EC 1.3.1.33 Protochlorophyllide reductase
gcgtagaggagaggagaggaagaagaagaacccagccaawtcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgccgtctggcaagaagaccctccgcaaggcacagcggtcatcaccggcgcgtcgtccggcctcggcctcgccacggcgaaggccctcgcggagacaggcaagtggcacgtcatcatggcctgccgcgacttcctcaaggcgtcgcgcgcggccaaggcggccggcatggac

SEQ ID NO: 6025 - DNA, 351 bp, Zea mays
  misc_feature: Ceres CLONE 327889-F
  misc_feature: Encodes the peptide sequence at SEQ ID NO. 6026
ggggcggtggcgctgcctccctctctctctagcccagccgcctccccaacggcccaacctcaccgaggagagagagaccgatacagagagagagaccaagaggacacgggagagaggacgttcatttccgcgtcgtctccgcccgcagccggcagccccaccacccaccacatggccgccatgccgggtggggcccacggcgccggcgccgcggacccgatgcaggtggaccagccgctcccccctgccgccgcaggcacagcacacgcccccgccgacgccaagcatgctggttctatgattgaagggagtgatccggtcacaggccatataatctcgacaaccattgga

SEQ ID NO: 6026 - protein, 60 aa, Zea mays
  misc_feature: Ceres CLONE 327889-F
MAAMPGGAHGAGAADPMQVDQPLPPAAAGTAHAPADAKHAGSMIEGSDPVTGHIISTTIG

SEQ ID NO: 6027 - DNA, 326 bp, Zea mays
  misc_feature: Ceres CLONE 327892-F
  misc_feature: Encodes the peptide sequence at SEQ ID NO. 6028
tccttcctctcgctcctcccctcccttccccgctcctcctcctcctcctcctcctkccctttcattcctacctccgctcgcgccactctcctccgaccgaggggcagggaccggtgcccgtccgcccgccatgggtctcctgagacggcgcagcgcgtcctggctgtcgtcggcgtcgcgctcctcgctcggcgccgccgtcggcggggaggccaaggtcacgccggaggcggatccggcggcgcagcatcgacgagcccgacaggagcgctggtcgcgcctgctgccggagctgctcacggagatcatgcgccgcgtggacgccg

SEQ ID NO: 6028 - protein, 65 aa, Zea mays
  misc_feature: Ceres CLONE 327892-F
MGLLRRRSASWLSSASRSSLGAAVGGEAKVTPEADPAAQHRRARQERWSRLLPELLTEIMRRVDA

SEQ ID NO: 6029 - DNA, 356 bp, Zea mays
  misc_feature: Ceres CLONE 327903-F
  misc_feature: Encodes the peptide sequence at SEQ ID NO. 6030
aaacccaaacaacagagagagatttctgaactatgagtgcggagctgaagagggactacgagataggcgcggagatcggtcgtggccgcttcggggtggtccaccgctgcacgtcccgcgccaccggcgaggccttcgccgtgaagtccgtggaccggtcgcggctgggcgacgacctcgaccgcgagctcgcgtagctcgagccgaagctggcgcaggtcgccggtgcgggcaacccgggcgtggtgcaggtgcacgcggtgtacgaggacgaggcgtggacgcacgtggtgatggacctgtgcgcggggccggacctgctggagtgggtgcgcatccggcgcggcgcgcccgtg

SEQ ID NO: 6030 - protein, 54 aa, Zea mays
  misc_feature: Ceres CLONE 327903-F
  misc_feature: SWISSPROT Homolog: EC 2.7.11.1 Non-specific serine/threonine protein kinase
MSAELKRDYEIGAEIGRGRFGVVHRCTSRATGEAFAVKSVDRSRLGDDLDRELA

SEQ ID NO: 6031 - DNA, 422 bp, Zea mays
  misc_feature: Ceres CLONE 327915-F
  misc_feature: Encodes the peptide sequence at SEQ ID NO. 6032
attttttcattctttgtttgtttcagcctttcacggaagaggggcggagtacgtaaggtgaacccggtcgtctgaagagaagcgagcacgacgtaggagaggggaggacagcgagatggccggcgggtttggcggcggcggggcagccgccgggagggccgagctctacgagggcaagatcaccggctacttcatcctcgcttgcatcgtcggctccttcggcggatccctcttcggctatgacctcggagtctccagcggcgtgacttccatggacgacttcctggtgaagttcttcccggacgtgtaccggcggaagcaggcgcacctccacgagacggactactgcaagtacgacaaccaggtgctgacgctcttcacctcgtcgctctacttcgcgggcctcgtctccaccttcggcg

SEQ ID NO: 6032 - protein, 102 aa, Zea mays
  misc_feature: Ceres CLONE 327915-F
MAGGFGGGGAAAGRAELYEGKITGYFILACIVGSFGGSLFGYDLGVSSGVTSMDDFLVKFFPDVYRRKQAHLHETDYCKYDNQVLTLFTSSLYFAGLVSTFG

SEQ ID NO: 6033 - DNA, 522 bp, Zea mays
  misc_feature: Ceres CLONE 327980-F
  misc_feature: Encodes the peptide sequence at SEQ ID NO. 6034
aaaaaaaccgcaaatatcttcttaccccaacgccggcacgccgcccaaaaacccttgcggcgtcgcactcacactagcgaccaacccccaasscccagaccttcctctccggcggcggcggcgcgcgcgcgcgagggagatggaccgcccttccggcacatcgtaccagcgctttccccgcgttcggatccgcgagctcaaggacgactacsccaagttcgaactccgcgacaccgacgctagtcatggccaacgccctccgccgcgtcatgatcgccgaaktcccaactgtcgccatcgatctcgtagagatcgaggttaactcctccgtcctcaacgacragttcatcgcccaccgtctggggctcatcccgctcacctccgccgccgccatgcaaatgcgcttctctcgggactgcgacgcttgcgacggcracggctcctgcgagtactgctccgtcragtttcacctctccgtgcacgccaccractctgaccagacgctcgaggtcacatccacga

SEQ ID NO: 6034 - protein, 92 aa, Zea mays
  misc_feature: Ceres CLONE 327980-F
  misc_feature: SWISSPROT Homolog: EC 2.7.7.6 DNA-directed RNA polymerase
  misc_feature (13)..(13): Xaa is any aa, unknown, or other
  misc_feature (33)..(33): Xaa is any aa, unknown, or other
  misc_feature (64)..(64): Xaa is any aa, unknown, or other
  misc_feature (73)..(73): Xaa is any aa, unknown, or other
  misc_feature (82)..(82): Xaa is any aa, unknown, or other
MANALRRVMIAEXPTVAIDLVEIEVNSSVLNDXFIAHRLGLIPLTSAAAMQMRFSRDCDACDGXGSCEYCSVXFHLSVHATXSDQTLEVTST

SEQ ID NO: 6035 - DNA, 492 bp, Zea mays
  misc_feature: Ceres CLONE 327994-F
  misc_feature: Translation starting site: 141
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaatcggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcmaagaagctctctctgt

SEQ ID NO: 6036 - DNA, 367 bp, Zea mays
  misc_feature: Ceres CLONE 328095-F
  misc_feature: Encodes the peptide sequence at SEQ ID NO. 6037
aaaaagtgtgctctctcagaggtgggctggcttctcctccccctcttaccaagtcctcttcgggttagggttacttagggytttgtggaggggsgatggcgscggctgatgtggagtaccgwawgcttcgtcggcgggcttgcctgggccaccagcaacgagtcgctggakaatgccttcgcctcctacggcgagatcctcgactccaaggtcatcaccgaccgggaracggggaggtctcgcggcttcggcttcgttaccttctcctccgaraactccatgctsgacgctatcgagaacatgaacggcaaggagctcgacggccgtaacatcaccgttaaccaggcccagtcccgtggcggtggcg

SEQ ID NO: 6037 - protein, 86 aa, Zea mays
  misc_feature: Ceres CLONE 328095-F
  misc_feature (6)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (5)..(5): Xaa is any aa, unknown, or other
  misc_feature (6)..(6): Xaa is any aa, unknown, or other
  misc_feature (21)..(21): Xaa is any aa, unknown, or other
MWSTXXFVGGLAWATSNESLXNAFASYGEILDSKVITDRETGRSRGFGFVTFSSENSMLDAIENMNGKELDGRNITVNQAQSRGGG

SEQ ID NO: 6038 - DNA, 438 bp, Zea mays
  misc_feature: Ceres CLONE 328118-F
  misc_feature: Encodes the peptide sequence at SEQ ID NO. 6039
gcatcacacactcgactctcctctctcgcatccgcagcctctcgagctctactccactccctcgatctacgaatcgtagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgttgtccggcgtca

SEQ ID NO: 6039 - protein, 114 aa, Zea mays
  misc_feature: Ceres CLONE 328118-F
  misc_feature (31)..(104): Pfam Name: Histone Pfam Description: Core histone H2A/H2B/H3/H4
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGV

SEQ ID NO: 6040 - DNA, 465 bp, Zea mays
  misc_feature: Ceres CLONE 328139-F
  misc_feature: Encodes the peptide sequence at SEQ ID NO. 6041
acaactcacatcgaggtctcagcttcaggaaagggaaggaagcatgttcgggcaccaccacggccacggcgggcaccaccaggccccgccgccgcacgagcagacgctgttcaggatcttctgccgcgccgacgaggcgtactgcctcaccgtgcgtcacgacgccgtcgtcctcgcgcccaccaacccccgcgacgagtaccagcactggtacaaggacatgaggcacagcacgaaggtgaaggacgcggagggccagccagcgttcgcgctcatcaacagggccaccggcctcgccatcaagcactcgctcggccagtcccatcccgtgaagctggtgccctacaacgcggagtacctggacgagtcggtgctgtggacggagagccacgacgtgggcaagggcttccgctgcatccgcattggtcaacaacatccacctcaacttcgacgccttccacggcg

SEQ ID NO: 6041 - protein, 140 aa, Zea mays
  misc_feature: Ceres CLONE 328139-F
MFGHHHGHGGHHQAPPPHEQTLFRIFCRADEAYCLTVRHDAVVLAPTNPRDEYQHWYKDMRHSTKVKDAEGQPAFALINRATGLAIKHSLGQSHPVKLVPYNAEYLDESVLWTESHDVGKGFRCIRIGQQHPPQLRRLPR

SEQ ID NO: 6042 - DNA, 365 bp, Zea mays
  misc_feature: Ceres CLONE 328145-F
  misc_feature: Encodes the peptide sequence at SEQ ID NO. 6043
aaaaaaaacgaggtttggtggaccctgttctcagcacggcaggcacggctgagcgaacgctcctccttccaaacccacgccgacaccgatgccgagagccggggtgtccagcagcgggagtagccgccgtggcgccggggcgttaagaaccctctccgaagatcgtcgcatcaccgtattctgctccgacggtcgcctctaccaagtcgattacgcgtggaacgctacgaagctggcgggcgtcacctccgtcggggtgcgtgggaccgactccgtatgcgtcgtcggccagcggagggcgaacacgcacgcgcccaaggacaaattgctggacatgaccagcgtttcgcgcctgttcccgatca

SEQ ID NO: 6043 - protein, 92 aa, Zea mays
  misc_feature: Ceres CLONE 328145-F
  misc_feature: SWISSPROT Homolog: EC 3.4.25.1 Proteasome endopeptidase complex
MPRAGVSSSGSSRRGAGALRTLSEDRRITVFCSDGRLYQVDYAWNATKLAGVTSVGVRGTDSVCVVGQRRANTHAPKDKLLDMTSVSRLFPI

SEQ ID NO: 6044 - DNA, 440 bp, Zea mays
  misc_feature: Ceres CLONE 328188-F
  misc_feature: Encodes the peptide sequence at SEQ ID NO. 6045
agttttttttttgggtgtgtttgtgactccagagtctgaaatcacaaatcagagctgtatagggagcaggtgatgactgagtgactgacaaacgtggggaagatggagacaaagaaacgcaagcctgtggtctactaaagacgggggcatcgccatcgagggcaaacggaggccacaggattagcagcttctccgaactcccctctcgtgctgctgcgtctcctcctcatcgtcctctccagtgtccagctcggccatggcgttcaccgtctccttctcccccgccaacgttcagatgctccaggctaggagtggccacggccacgccacctttggaagctgttccgccgtgccaagagccgggccaaggctgcgctccacggccgtccgggtcagcagcgagcaggaggcggcggcggccgtcagggcgccgtccggga

SEQ ID NO: 6045 - protein, 61 aa, Zea mays
  misc_feature: Ceres CLONE 328188-F
  misc_feature: SWISSPROT Homolog: EC 4.2.1.24 Porphobilinogen synthase
MAFTVSFSPANVQMLQARSGHGHATFGSCSAVPRAGPRLRSTAVRVSSEQEAAAAVRAPSG

SEQ ID NO: 6046 - DNA, 405 bp, Zea mays
  misc_feature: Ceres CLONE 328195-F
  misc_feature: Encodes the peptide sequence at SEQ ID NO. 6047
atcatcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgag

SEQ ID NO: 6047 - protein, 101 aa, Zea mays
  misc_feature: Ceres CLONE 328195-F
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPE

SEQ ID NO: 6048 - DNA, 348 bp, Zea mays
  misc_feature: Ceres CLONE 328224-F
  misc_feature: Encodes the peptide sequence at SEQ ID NO. 6049
accgtatacggcatcccctcgcctctgccaccgccggcccagtccctcatggacacgccgccgccctctctcccgccgtctgccctcctctggccggacctcctcgcgggcgcggcgtcctccacctgccgcctcgtcgccgcgcattcccgtcacttcctggccctatcctctctcctccttctgccgctcgccctcctcctactcgccctcccctgcccgttcttctctgcctccgcctcctccgccgcctcccctcccgtacatctccgggtcccgcaggatccgtcgaggtacccactacccatcccgctgccgctgctcccttgccgccgcactcctctacct

SEQ ID NO: 6049 - protein, 100 aa, Zea mays
  misc_feature: Ceres CLONE 328224-F
MDTPPPSLPPSALLWPDLLAGAASSTCRLVAAHSRHFLALSSLLLLPLALLLLALPCPFFSASASSAASPPVHLRVPQDPSRYPLPIPLPLLPCRRTPLP

SEQ ID NO: 6050 - DNA, 521 bp, Zea mays
  misc_feature: Ceres CLONE 328228-F
  misc_feature: Encodes the peptide sequence at SEQ ID NO. 6051
agaaaccttttgccgtcttgcggcggccttctgctccgccgctcgttctcatatcttgcggcggcctggggaaaaagaggagagatcggagatgaaggcgtgtgcgaaggctgcgggggagaggctgccgctggtctgtgctccgtcaactaggcagcctctagctcggagctttgttaaggcaagaagattaccctctcaacatgagacgaagtcacaagtatcctgctcggttagggtgtcagaaaacacagctcacagaatagatgccacagcagaaaatattttcccagcaatgaaagatcatgtcttgaaagcaactgatgcaatcaacagaggagaagtgattgcggtgcctactgataccatatacgggtttgcatgtgatgcatgctctgcaggagcagttaatcgtatttatgagatcaaaggacgcatacaaacaaggcctctggcaatttgtgttggtgatgtctcagacatatcacggtttgctttagtggaacactttgccacatggc

SEQ ID NO: 6051 - protein, 143 aa, Zea mays
  misc_feature: Ceres CLONE 328228-F
MKACAKAAGERLPLVCAPSTRQPLARSFVKARRLPSQHETKSQVSCSVRVSENTAHRIDATAENIFPAMKDHVLKATDAINRGEVIAVPTDTIYGFACDACSAGAVNRIYEIKGRIQTRPLAICVGDVSDISRFALVEHFATW

SEQ ID NO: 6052 - DNA, 644 bp, Zea mays
  misc_feature: Ceres CLONE 328254-R
  misc_feature: Pfam Name: NAD_binding_1 Pfam Description: Oxidoreductase NAD-binding domain
  misc_feature: SWISSPROT Homolog: EC 1.18.1.2 Ferredoxin--NADP(+) reductase
tcgaggtcgacggtatcgataagcttttttttttttttttttacaaaccgcgtgcttcattttattcaccatttggagcagaagcttatgaatccaagtctacaatgttacattacatcgcagccacagtcgttcaatcatacatccagtttctcagctcagtagctaaacaatcacaatccttgccatcttatagcctagtaaacctcgacgtgccactgcttgttctttttcagctgtgacagcttctggtcccagctctcgcctctttgctcagccaccttcttgagcgtgtcctggatccccggcatcatccccttcaaaccacagaagtagatgtgcgcaccgccatctagcagtctgaagatttcatcgctgtactcctcgatcttgtcctgcacgtacatcttcccgccgctcttgttcttctgctccctgcttagcgctttgtcgtacctgaaattgtctggatactgctgaaagtagtttgtgaactcttcatcatagagaaggctgtcagagttcgcaacaacaaagaaagagccaagccagaacacccaaattttgaaagttgggaacatcttcccatgaaacatgcgaccgaagggtagcccccggtaaggaaaaaaaactcggggcccccg

SEQ ID NO: 6053 - DNA, 519 bp, Zea mays
  misc_feature: Ceres CLONE 328264-F
  misc_feature: Encodes the peptide sequence at SEQ ID NO. 6054
gaaaaagagactagtgctttgttcctagagaccatagttcgaatcccagtgggggtgcctttttgatatttcgtgatattttgctgagcgtgtgagaaactttggcaacgcgcgtggaggagggcgcgtggaggaggggagcggttgcatcgagcgggcgtaccaagggagaaacttccgttttatattagtagagatgtttatgaagcaagcattgattttttccttcctgatcccagaataacttcagcttatgctctgcaggtacaactacatgcggatgaggaaacttaccgatcaatgggtaaagagcatgcactcgtcatatcaaatcatcgaagtgatattgattggcttattggatggatattggcccagcgctcagggtgccttggaagtacgctcgctgtcatgaagaagtcatccaagttccttccagtcattggctggtcaatgtggtttgcagagtacctctttttggagaggagctgggcaaggatgaaaagacactaaagtggg

SEQ ID NO: 6054 - protein, 70 aa, Zea mays
  misc_feature: Ceres CLONE 328264-F
  misc_feature: SWISSPROT Homolog: EC 2.3.1.51 1-acylglycerol-3-phosphate O-acyltransferase
MGKEHALVISNHRSDIDWLIGWILAQRSGCLGSTLAVMKKSSKFLPVIGWSMWFAEYLFLERSWARMKRH

SEQ ID NO: 6055 - DNA, 472 bp, Zea mays
  misc_feature: Ceres CLONE 328293-F
  misc_feature: Encodes the peptide sequence at SEQ ID NO. 6056
actcaacgccacgaccgaagaggagactcagtcaatctcgccctgctctcctcttcgacccgtcgtcggttcctgggatcagcatcgacgagaaggatttttccggctgtggaggattgctgctgcttgacaaatccgagcgcaaaggttgcttcctgacgcgttccccatggcacgagcaggagaaggcggctagaaggttcctgctcccgggcgtgacctctcacacggcatggtcgttgcttcgccggggaggcgcagcggggatggtcgataggagcagggccgtgctcatcggggtcaccgccggcgtcgcggccgcgctggtcgcggcggcgggcgtgcttctggccgtctggctctaccgccggcgggccagcgtcgccgcacggacgcgctccccggagtcgccctcggcgacsctgcgggcccggcggcgccggtcgcgccagcctcgactccagcgtctccg

SEQ ID NO: 6056 - protein, 68 aa, Zea mays
  misc_feature: Ceres CLONE 328293-F
MVDRSRAVLIGVTAGVAAALVAAAGVLLAVWLYRRRASVAARTRSPESPSATLRARRRRSRQPRLQRL

SEQ ID NO: 6057 - DNA, 398 bp, Zea mays
  misc_feature: Ceres CLONE 328294-F
  misc_feature (198)..(198): n is a, c, t, g, unknown, or other
aattagtgacaatattgtttagatataaatttgagatgtcggaggaagctgcagaaaaaggtaactttatctctggggctaagcttcaattcgacattcgcccattcttcagtattaatgtcgttgcgcgagtacaatagtgattccscggtgcatccacaccaaggatttcatcaccaccagccccatcaacgattnacaatggtgaagagtttgtcttctactctacaaggaagtaccgtgccaaaaaactcaataatagagtatcacagcaaccaaaatggctaattgttgccactagagagaatgtatagcctattatgtctggcacttagtgaatcgatagctttaagggcaagttatgcactcgagtgactacaatagggaagggaggcttc

SEQ ID NO: 6058 - DNA, 663 bp, Zea mays
  misc_feature: Ceres CLONE 328298-R
tcgaggtcgacggtatcgataagcttttttttttttttttttggtaccagcactgacagtctatgcgttgataagagaaacagttttccatcggtgtacaaagatgcctctgaagcacatgaaaaaaaaagcaacaacagatctggatgctcaccagttcagacctctgaaacacttggtagtgagtgactgactccaggaccaaacggtggccaaaagagaggaacagacctcaaaaaaaaaccccgagacggacagaaacttcagaaaaatacacaaggctcttcttagttccgatgcagaaaaaacttgaggacccaggttcgctagcatcacagcctggatatttttgcgtgcgttctgtgtttccttaaaacatggagaatgtatcaaccctccatgtcgacatcgtcgttacccttggatgcttcacctccagttagttctgatgtccacaatgctaagttgtccttcagaagctgcatcataagtgtgctatccttgtaaactccctcaccagaatttatctcagtaagagcctcatcaaatgcttgttttgccacttggcaagctctctcatgagagttcattatctcataaaagaaaaccgactaattgagggcaagcccaagccggattggttgagcaggtgagagctccctg

SEQ ID NO: 6059 - DNA, 452 bp, Zea mays
  misc_feature: Ceres CLONE 328300-F
  misc_feature: Encodes the peptide sequence at SEQ ID NO. 6060
atcgattcatccagcagaagcaagcatcacacaaaaccgatcaatctcgcagagggagaaccaaccaatccatcatctgtctcgactctctcgcgtctccgccggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtcgcggcagcgggtccaggccgaccgcgccggcggccgcaaccctacctggaacgccacgctccgcttcgccgtcccggcaaccggcgcctcctcctccctccacatcctcctccgcgccgagcgcgccctcggcgaccgcgacgtcggcgaggtccacatcccgctctccgagctcctctccggcgc

SEQ ID NO: 6060 - protein, 101 aa, Zea mays
  misc_feature: Ceres CLONE 328300-F
  misc_feature (7)..(92): Pfam Name: C2 Pfam Description: C2 domain
MATTRPLELTLISAKDLKDVNLLSKMEVYAVASLSGDPRSRQRVQADRAGGRNPTWNATLRFAVPATGASSSLHILLRAERALGDRDVGEVHIPLSELLSG

SEQ ID NO: 6061 - DNA, 454 bp, Zea mays
  misc_feature: Ceres CLONE 328301-F
  misc_feature: Encodes the peptide sequence at SEQ ID NO. 6062
acagaaccccccacggaaatgcgtcgcccaatcgctttcgaacccctccccttccagctcgttgcgagctcccatttttgaccttcaccagcgccaccttccacgccaaggctacgacgacaatggtggcgaggagcccgaacgccaagccggacaggcagaaggctgcagccctcgccgcggctgccgcgctcaacccggctctcctcagggagacgctcaagaaggttgaccgatgcatggcacggctgcaggagctgcagtacacggtagccggcggcgccaaggtcgtctccggcgtcagtctcagcccccgcagcacgcgcgggtacctccggaccagcctccggtgcaagcaggagaccgtcaggatgaggggcggcgcgtcggcgcasaaraggatccccaagcggcaagttcgggggcggcgtcygcggagarggcgcgcagtggc

SEQ ID NO: 6062 - protein, 110 aa, Zea mays
  misc_feature: Ceres CLONE 328301-F
  misc_feature (91)..(91): Xaa is any aa, unknown, or other
  misc_feature (104)..(104): Xaa is any aa, unknown, or other
  misc_feature (107)..(107): Xaa is any aa, unknown, or other
MVARSPNAKPDRQKAAALAAAAALNPALLRETLKKVDRCMARLQELQYTVAGGAKVVSGVSLSPRSTRGYLRTSLRCKQETVRMRGGASAXKRIPKRQVRGRRXRRXRAV

SEQ ID NO: 6063 - DNA, 496 bp, Zea mays
  misc_feature: Ceres CLONE 328303-F
ataccaccagggagtaaaggttaggatgttgttgtcgtgcttgaacctggaagcatgctccaccgggacctgggttcggtcgagcaacaactagtccgctaatgacgccagtcgccggctgctgttcggaggctagcaaaagggcgagagggtttgctagtacgtacagagcgtgcgcgagtaagtggctgggagcccgccgttgtcaagagagaagttgcgaggggcagaggatcatggcgctagaacttgtcgatgcgcagggagttcgccgaagggcgttaaagagcaccgaagccttggcgagtttcctccatactccgaaatttgtcgtcgtgccgttacagcgtgggtcgacgtcactgcggtctcgttgccggtcaagaacaggtaccgcaggatgaggcgcatggaggatgctgtggcgagttcgcgagaggtctaggtcgtcgtctcccagtcaactttgggttgctggacgttgtctctgaaaggg

SEQ ID NO: 6064 - DNA, 480 bp, Zea mays
  misc_feature: Ceres CLONE 328375-F
  misc_feature: Encodes the peptide sequence at SEQ ID NO. 6065
ctagtcaaattttacgtaacttgcgtggttctcttcctgcgacggaagcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttgatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatg

SEQ ID NO: 6065 - protein, 92 aa, Zea mays
  misc_feature: Ceres CLONE 328375-F
MADGEDAAAARRRAAITDYRKKLLNCRELESRVGTVRESLKTAKKDFTKTEDDLKSLQSVGQIIGEVLRPLDNERFDREGQQWSPIRGRLPK

SEQ ID NO: 6066 - DNA, 483 bp, Zea mays
  misc_feature: Ceres CLONE 328385-F
  misc_feature: Encodes the peptide sequence at SEQ ID NO. 6067
  misc_feature (380)..(380): n is a, c, t, g, unknown, or other
acacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccnaaccggccgccgaggcggaggctgctgctcctgctggtccgaggagactcctgcggtcgagcaggaggcagccgccgaggaggaggctgctgctgctcctcct

SEQ ID NO: 6067 - protein, 111 aa, Zea mays
  misc_feature: Ceres CLONE 328385-F
  misc_feature (78)..(78): Xaa is any aa, unknown, or other
MATAEVQTPTVVAAEEAPVVETPPPAVVPEESAPAEAEAEAEAAAPADPEELPAAEQQAAAEAEAAAPAGAEEPVAAXPAAEAEAAAPAGPRRLLRSSRRQPPRRRLLLLL

SEQ ID NO: 6068 - DNA, 655 bp, Zea mays
  misc_feature: Ceres CLONE 328438-R
  misc_feature (621)..(621): n is a, c, t, g, unknown, or other
ccgattgggtaccgggccccccctcgaggtcgacggtatcgataagcttctcgtgccgttttttttttttttttttggttttttttttttttttttttttttttttttttttttttttttttttttttttttttttttaaaaccccaaaacaacattttaaaaaaatcatccccctcctctaattaattggacacatccccattagcagcttataaaaattaatcgaccaaaacagcactcaagccccctagcttagcttacaacagatccagcccataacacccaaaaaacacggggaaactgaactgaacacaacacaacacaaaagaaagcacatcgaacccccccaattacccccttaattaattgaggaacgacaacccccacgacaacaacaatttgatgaagcatggaaaccaagcctaccaacattaaaaagggagctgcagccccagctgcagcgggacaaattggtaccccctaaccatcccatctcgcggggggacgaactattatccccaaaaaggggggtcaagccgcggccgtctccctgggaacgggggggcgtaccttggggggcctgccccggccccccttggccgggggggaaccctcccccncaggggcaggggcaagggacggggaccgggaccc

SEQ ID NO: 6069 - DNA, 516 bp, Zea mays
  misc_feature: Ceres CLONE 328449-F
  misc_feature: Encodes the peptide sequence at SEQ ID NO. 6070
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttc

SEQ ID NO: 6070 - protein, 144 aa, Zea mays
  misc_feature: Ceres CLONE 328449-F
  misc_feature (10)..(144): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARF

SEQ ID NO: 6071 - DNA, 476 bp, Zea mays
  misc_feature: Ceres CLONE 328485-F
  misc_feature: Encodes the peptide sequence at SEQ ID NO. 6072
gtttagaaactctttttttaactgtttgccggagccggaggcggtttcgactttggagccctccgaggctcttcagaaagaaacaagaaaatctgcaaacgaattgtttgtccaggagaaggcccccgacgggattattctttctccccgcgtgctctctatctctcccctctttctctccctctgcccgacgactaggccgccgccgccacggccccgccgccgccgccgtgcccaggtctttgtcggtccttgtccggcaacgagcaccctacagatggctgggaggcacaccattattctgatgcagccatctcaaaatagggcttctagaacatttatggattacaattcgattaatcatgcattggatggaatctgtgggctttatgaaaggaaaattagggatatcaacccaatgatcccaaacataacttatgacatcagcgacctctataacttcattgatggcctag

SEQ ID NO: 6072 - protein, 66 aa, Zea mays
  misc_feature: Ceres CLONE 328485-F
  misc_feature (3)..(66): Pfam Name: ER Pfam Description: Enhancer of rudimentary
MAGRHTIILMQPSQNRASRTFMDYNSINHALDGICGLYERKIRDINPMIPNITYDISDLYNFIDGL

SEQ ID NO: 6073 - DNA, 498 bp, Zea mays
  misc_feature: Ceres CLONE 328502-F
  misc_feature: Pfam Name: DUF561 Pfam Description: Protein of unknown function (DUF561)
  misc_feature (191)..(191): n is a, c, t, g, unknown, or other
gtcgctgcgtagtgtagtgtcatcttatctcttcctcctaccttcactctcaaaatcttcagggagccgtagaggagcagcaggtgcaccaaaaggatggcagcgcaggctccctgssgacttctccaggccccgtccttcgctgcggccaagtgccagccggtgggtggccgggcatccgcgcggcgagncacggccactgttcgccgtgcgcgcctcggctgctgacgccgccaacagggatgccgtgctcaaggccttccgcgagaacagggctctcaagataatttccgggcttcagaactttgacaggagcagtgttgcatctgttgtcacagctgcagataagggaggtgcaaccatgttgacatagcatgtgacaaagacttagtaaagcttgccatggatcttaccaatcttccgatctgtgtctcatctgtagatccttcagcgttccattctgcaggtacaagcaggasctaaaatggttgagatcgg

SEQ ID NO: 6074 - DNA, 209 bp, Zea mays
  misc_feature: Ceres CLONE 328503-F
  misc_feature (81)..(81): n is a, c, t, g, unknown, or other
  misc_feature (201)..(201): n is a, c, t, g, unknown, or other
atattttacgcgaggacggataggacattcggcgttcctaggtaccccgctgcttccgtgctcacctcgcctgcaggsscncagccgctggaagaacacgaagacgacgggagtgcggggtggcgtcgcgctggagcaccagctgtagccgccggtaggcctccgcgccgctctccgtggccaacgcgccgtcatgctbsncggcgtcg

SEQ ID NO: 6075 - DNA, 129 bp, Zea mays
  misc_feature: Ceres CLONE 328508-F
  misc_feature (80)..(80): n is a, c, t, g, unknown, or other
acctgattccttccgccttgtcagcgcmstgccagacccacccgagccaacaacccatggccgccgcgacgccgtgtcknctgctcgcggtcgcggcctcaccctcgccgtcctcgccgccgcggtctc

SEQ ID NO: 6076 - DNA, 499 bp, Zea mays
  misc_feature: Ceres CLONE 328516-F
  misc_feature: Translation starting site: 304
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaagccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtg

SEQ ID NO: 6077 - DNA, 497 bp, Zea mays
  misc_feature: Ceres CLONE 328535-F
  misc_feature: Encodes the peptide sequence at SEQ ID NO. 6078
  misc_feature (442)..(442): n is a, c, t, g, unknown, or other
ctcgcgggcagaaggcaaacgcggctgcgagcgvcggcgcccctctcccactccccagccgccgccagcccgcacacccctccctcgcgcgctcagggtttcggaatggaagccgaggcggcggccaagaggacgcgggagagcggggaggacgccgccgcgsggggatctccgccgttcatcccgggatggttctccgagatcagccccatgtggcccggtgaggcgcactctttgaaggtggagaaggtgctgttccaagggaagtcagactaccaaaacgttatggtctttcagtcctctacgtacgggaaggtgctcgtccttgatggagttattcaggttacggagagggatgagtgtgcgtaccaagagatgatcactcacctgmccctttgctccatcaaagatcccaagaaggtgttggttattggagggggtnatggtggtgttctgcgtgaggtttcacggcattcctctgtggaacaaattgacat

SEQ ID NO: 6078 - protein, 130 aa, Zea mays
  misc_feature: Ceres CLONE 328535-F
  misc_feature (28)..(130): Pfam Name: Spermine_synth Pfam Description: Spermine/spermidine synthase
  misc_feature: SWISSPROT Homolog: EC 2.5.1.16 Spermidine synthase
  misc_feature (20)..(20): Xaa is any aa, unknown, or other
  misc_feature (96)..(96): Xaa is any aa, unknown, or other
  misc_feature (113)..(113): Xaa is any aa, unknown, or other
MEAEAAAKRTRESGEDAAAXGSPPFIPGWFSEISPMWPGEAHSLKVEKVLFQGKSDYQNVMVFQSSTYGKVLVLDGVIQVTERDECAYQEMITHLXLCSIKDPKKVLVIGGGXGGVLREVSRHSSVEQID

SEQ ID NO: 6079 - DNA, 499 bp, Zea mays
  misc_feature: Ceres CLONE 328550-F
  misc_feature: Encodes the peptide sequence at SEQ ID NO. 6080
cttcctcatccagtgttctgtcctagcgccgccgccgccccagctcgccttgcgtgactgagagctcgtcggcttccgtccacgcgtgaasssagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagattgcagttttgtttatcttggttgaaagtgcaattggtgttgagacatggttatccttgctatattatctataaracgacgcatgcattgaatg

SEQ ID NO: 6080 - protein, 65 aa, Zea mays; identical to SEQ ID NO: 5504
  misc_feature: Ceres CLONE 328550-F
  misc_feature (1)..(65): Pfam Name: Ribosomal_S28e Pfam Description: Ribosomal protein S28e

SEQ ID NO: 6081 - DNA, 484 bp, Zea mays
  misc_feature: Ceres CLONE 328564-F
  misc_feature: Encodes the peptide sequence at SEQ ID NO. 6082
acaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgcctggcgccaggccgggggcgtgggccgtcgccgccctggtctctctcgtcgccttcctcgtgaactgagggtgtgggcatcgtgctgcgcagcgcgggagatgggagggacgaatcctgcgatctggatcgctgggagaggagagggggatatttatgttcgttctgtt

SEQ ID NO: 6082 - protein, 75 aa, Zea mays
  misc_feature: Ceres CLONE 328564-F
MAASTKTVAVLLAAVLLALVASAAASRKLEEEDALLGSLAPAPAPAVGGSAGLPGARPGAWAVAALVSLVAFLVN

SEQ ID NO: 6083 - DNA, 519 bp, Zea mays
  misc_feature: Ceres CLONE 328586-F
  misc_feature: Encodes the peptide sequence at SEQ ID NO. 6084
aaggccgcaacgcctccgctttcattcttctcttcccctcgacttcgagggttgtttttatttctttctttcctttttccgttttttattttctttttttcttttttcgttacttttctcgttccccccgttggggttttgagctccgacgaaccctaataatcgccggggaccggcggacgatcgcccgccggcatgcaccatcagcagcggatgaagcaggcggcggcggccgcggccgcggcgcagcagcagcagctgatgcagcaggcactgctcctgcagcagcagcagcagtcgcaggcgcagccgcccttgttccccgggcaccacccgcaccccggcctcctcgccgcaccacagatagagcccatagtcagtggaaacctgcctcctgggtttgattcaagtacatgccgcagcgtgtatgttggcaatatccatcttcaagtgacggacacagtactgcaggaagtcttccaaagcattggtccagtagaagggtgcaagctcatcaga

SEQ ID NO: 6084 - protein, 108 aa, Zea mays
  misc_feature: Ceres CLONE 328586-F
MHHQQRMKQAAAAAAAAQQQQLMQQALLLQQQQQSQAQPPLFPGHHPHPGLLAAPQIEPIVSGNLPPGFDSSTCRSVYVGNIHLQVTDTVLQEVFQSIGPVEGCKLIR

SEQ ID NO: 6085 - DNA, 439 bp, Zea mays
  misc_feature: Ceres CLONE 328591-F
  misc_feature: Encodes the peptide sequence at SEQ ID NO. 6086
acaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgcctggcgccaggccgggggcgtgggcgtcgccgccctggtctctctcgtcgccttcctcgtgaactgagggtgtgggcatcgtgctgcgcagcgcgggagatgggagggacgaatcctgcgatct

SEQ ID NO: 6086 - protein, 73 aa, Zea mays
  misc_feature: Ceres CLONE 328591-F
MAASTKTVAVLLAAVLLALVASAAASRKLEEEDALLGSLAPAPAPAVGGSAGLPGARPGAWASPPWSLSSPSS

SEQ ID NO: 6087 - DNA, 513 bp, Zea mays
  misc_feature: Ceres CLONE 328620-F
  misc_feature: Encodes the peptide sequence at SEQ ID NO. 6088
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgcycgtggggcggcgccgctctcgtccatcacccacctcgtgtacgtctcgtcgagcgaggc

SEQ ID NO: 6088 - protein, 142 aa, Zea mays
  misc_feature: Ceres CLONE 328620-F
  misc_feature (10)..(142): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (123)..(123): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRXWGGAALVHHPPRVRLVERG

SEQ ID NO: 6089 - DNA, 462 bp, Zea mays
  misc_feature: Ceres CLONE 328627-F
  misc_feature: Encodes the peptide sequence at SEQ ID NO. 6090
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctccgtggggcgg

SEQ ID NO: 6090 - protein, 126 aa, Zea mays
  misc_feature: Ceres CLONE 328627-F
  misc_feature (10)..(126): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSVGR

SEQ ID NO: 6091 - DNA, 516 bp, Zea mays
  misc_feature: Ceres CLONE 328659-F
  misc_feature: Encodes the peptide sequence at SEQ ID NO. 6092
agacatacagaattacagagtcgaagtgcgctgtggactctcccctccccaactccggcgaagggagcagaaacgttggcgtgttggttgggtggcgtcggcatggacgaggcaacgaagaagaatgtggaggctacggtgctggagatcctccggggctccgatatggagtccgtgacggagtacaaggtccgcgccgctgccagcgaccgcctcggcatcgacctctccatacccgaccgcaagctcttcgtccgcggcgtcgttgaggaatacctactttcactctcctccaaggaggaggcgaaggcggaggaggagggcgtcactggcagggagagcaagggcaaggaacaggaggaggaggacgaagatgatgacgatggggaggaggatgaaggtaagggtggcgggaagagagagtacgacgaccaaggtgaccttatcctgtgccgcctttcgagcaagaggagggtgactctatcggagtttaagggcaggtcgttggtgtccatc

SEQ ID NO: 6092 - protein, 138 aa, Zea mays
  misc_feature: Ceres CLONE 328659-F
  misc_feature (5)..(60): Pfam Name: DEK_C Pfam Description: DEK C terminal domain
MDEATKKNVEATVLEILRGSDMESVTEYKVRAAASDRLGIDLSIPDRKLFVRGVVEEYLLSLSSKEEAKAEEEGVTGRESKGKEQEEEDEDDDDGEEDEGKGGGKREYDDQGDLILCRLSSKRRVTLSEFKGRSLVSI

SEQ ID NO: 6093 - DNA, 492 bp, Zea mays
  misc_feature: Ceres CLONE 328724-F
  misc_feature: Encodes the peptide sequence at SEQ ID NO. 6094
aacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtg

SEQ ID NO: 6094 - protein, 114 aa, Zea mays
  misc_feature: Ceres CLONE 328724-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEEAAAAPPAG

SEQ ID NO: 6095 - DNA, 211 bp, Zea mays
  misc_feature: Ceres CLONE 328750-F
  misc_feature: Encodes the peptide sequence at SEQ ID NO. 6096
aaccatttcgctagctccatagcacttgttccagctagctaggaaaaargaasctttggtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggc

SEQ ID NO: 6096 - protein, 45 aa, Zea mays
  misc_feature: Ceres CLONE 328750-F
  misc_feature (4)..(33): Pfam Name: zf-RanBP Pfam Description: Zn-finger in Ran binding protein and others
MNRKPGDWDCRACQHLNFSRRDACQRCSEPRGVGDRSGGGGDLGG

SEQ ID NO: 6097 - DNA, 519 bp, Zea mays
  misc_feature: Ceres CLONE 328765-F
  misc_feature: Encodes the peptide sequence at SEQ ID NO. 6098
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttc

SEQ ID NO: 6098 - protein, 144 aa, Zea mays; identical to SEQ ID NO: 6070
  misc_feature: Ceres CLONE 328765-F
  misc_feature (10)..(144): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6099 - DNA, 480 bp, Zea mays
  misc_feature: Ceres CLONE 328829-F
  misc_feature: Encodes the peptide sequence at SEQ ID NO. 6100
acttgcacctcgccgccgtcttcttcttcttcttcttaccagtctcctccggtgcgggcgagggagacgacgacggcgatggcctggctgaggcggacggagacgctggtgctgctgctcgtggtgcttctggcctccgcttcaacccccgcggcggcggcggcggcgggagaggaggaggaaagagtgatcaggctgaagcgctgtgatggtggttattcttataaccatactctggctcatattcttgtcgaatacgcgtctgcggtgtacacatctgacttgacatcacttttctcatggacctgtccaaggtgcaaaggccacacaaagggatttgaggtgatagagatcatagtagatgtggagaactgcttvcaggcgtttgttggagttgcacctgaccctcgatccataatcattgcttttagaggcactcaacagcacagtgtctcaaattggatcgaagatcttttctgg

SEQ ID NO: 6100 - protein, 134 aa, Zea mays
  misc_feature: Ceres CLONE 328829-F
  misc_feature (100)..(100): Xaa is any aa, unknown, or other
MAWLRRTETLVLLLVVLLASASTPAAAAAAGEEEERVIRLKRCDGGYSYNHTLAHILVEYASAVYTSDLTSLFSWTCPRCKGHTKGFEVIEIIVDVENCXQAFVGVAPDPRSIIIAFRGTQQHSVSNWIEDLFW

SEQ ID NO: 6101 - DNA, 500 bp, Zea mays
  misc_feature: Ceres CLONE 328866-F
  misc_feature: Encodes the peptide sequence at SEQ ID NO. 6102
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactctgtacgtggtgatgtcggatgagatcctcaagaactacccggagctggcgcaggaggggctgccgacgatgaatcagcgtctggacatctcgaacgcggcgcgtgacgcagatggcgacggaggcgtccctgtcgtgcgtccgctcgtggggcggcgcgctctcgtccatcaccacctcgtgtacgtctc

SEQ ID NO: 6102 - protein, 137 aa, Zea mays
  misc_feature: Ceres CLONE 328866-F
  misc_feature (10)..(135): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTLYVVMSDEILKNYPELAQEGLPTMNQRLDISNAARDADGDGGVPVVRPLVGRRALVHHHLVYV

SEQ ID NO: 6103 - DNA, 496 bp, Zea mays
  misc_feature: Ceres CLONE 328895-F
agttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatcggaactccactacataaacactggatttccatacacaatcacgagagcttcatggatttctttgagggtctcacttttgctcatgctgactttgctctcacggatggct

SEQ ID NO: 6104 - DNA, 522 bp, Zea mays
  misc_feature: Ceres CLONE 328901-F
  misc_feature: Encodes the peptide sequence at SEQ ID NO. 6105
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacstcgtgtacgtctcgtcgagcgaggcgcgcttcccgggc

SEQ ID NO: 6105 - protein, 146 aa, Zea mays
  misc_feature: Ceres CLONE 328901-F
  misc_feature (10)..(146): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (134)..(134): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHXVYVSSSEARFPG

SEQ ID NO: 6106 - DNA, 516 bp, Zea mays
  misc_feature: Ceres CLONE 328907-F
  misc_feature: Encodes the peptide sequence at SEQ ID NO. 6107
aacctctagctgattgatctctggtttaccactctttccttccctccttcaattctaaataccacaaatcaaagttgctttgcgatggtgagcagcagcatggacacgacgagtgacaaacgtgcgtcatccatgctgtctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttc

SEQ ID NO: 6107 - protein, 144 aa, Zea mays
  misc_feature: Ceres CLONE 328907-F
  misc_feature (10)..(144): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLSPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARF

SEQ ID NO: 6108 - DNA, 522 bp, Zea mays
  misc_feature: Ceres CLONE 328980-F
  misc_feature: Encodes the peptide sequence at SEQ ID NO. 6109
atatatatacccctcgaccccgacaggggagggaacatagcgaacaaacatcgagtacagccggctaggtaatctggtacgacgacccacgacgacatggcggcggccaccaccaccagcagcagcaagaagtcgtcgtcgccgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagctgccggccaagtgcggcctcgccacgccgcccgactgctagccaagccaagcaggaaggcccccggcattgctagctgtacgtgtgtgttgtgtgcatctgcagcag

SEQ ID NO: 6109 - protein, 119 aa, Zea mays
  misc_feature: Ceres CLONE 328980-F
  misc_feature (45)..(119): Pfam Name: Tryp_alpha_amyl Pfam Description: Protease inhibitor/seed storage/LTP family
MAAATTTSSSKKSSSPSSSSSAQRAAAAALLVAVSVLVVGAAAVCDMSNEQFMSCQPAAAKTTDPPAAPSQACCDALAGADLKCLCGYKNSPWMGVYNIDPKRAMELPAKCGLATPPDC

SEQ ID NO: 6110 - DNA, 449 bp, Zea mays
  misc_feature: Ceres CLONE 328989-F
  misc_feature: Encodes the peptide sequence at SEQ ID NO. 6111
gcatgtgctagagctagacagaagtcagtctccttcccctctctctagtgctcgccggctctttccgtcgccatggacgtcctcctctgctgctgcctgctgcttctcctggcctccgccgcgtccgccggcagcgagcggtgcgtgcggcaggggaaggcggcctactcttcctcgctctctccggcccctcacggtagcagcagcggagcgtgcgggtacggcgccatggccgccgagatcaatgggggtttcctcgccgccggcgggcccaggcagcaccgcgggggcctcggctgcggccgctgtttccagatgagatgccgagacgcaaggctgtgcagcgccgggggagtgcgggtggtgctgaccgacttccacaggagcaaccgtacggacttcctgctcgccgggccggcgttcgcgggcctagccaagcccgggatggc

SEQ ID NO: 6111 - protein, 125 aa, Zea mays
  misc_feature: Ceres CLONE 328989-F
  misc_feature (62)..(123): Pfam Name: DPBB_1 Pfam Description: Rare lipoprotein A (RlpA)-like double-psi beta-barrel
MDVLLCCCLLLLLASAASAGSERCVRQGKAAYSSSLSPAPHGSSSGACGYGAMAAEINGGFLAAGGPRQHRGGLGCGRCFQMRCRDARLCSAGGVRVVLTDFHRSNRTDFLLAGPAFAGLAKPGM

SEQ ID NO: 6112 - DNA, 480 bp, Zea mays
  misc_feature: Ceres CLONE 328991-F
  misc_feature: Encodes the peptide sequence at SEQ ID NO. 6113
accacccatcgccaccaccaatcaatccatcacgttagctgcacctgcgcctctccttgaggtcgcgcagccagcaatggcgtgctccaaagcggtgctgctcgccgcgctcctagccgtcgcaggagcgctctcctccgctgcggtgtgggaggactacgaccaccacatgtaccacaggtgctacaggtcctgcatgaggaagtgcgacgacgacgatgccgatgatgcattgaagaatagcatcagccccgttgccacctccgtgtcggatgatcatgaccacgaccatgacgaccaccacgatgatcacgaccacgaccacgaccacaaccatgacgaccaccacaatgatcatgaccacgaccacgatcatgacgaccaccacaatgatcatgaccacgaccacgatcataacgaccaccacgattgatcacgaccacgacccatgataatcacgaccacgaccatbayaatcac

SEQ ID NO: 6113 - protein, 118 aa, Zea mays
  misc_feature: Ceres CLONE 328991-F
MACSKAVLLAALLAVAGALSSAAVWEDYDHHMYHRCYRSCMRKCDDDDADDALKNSISPVATSVSDDHDHDHDDHHDDHDHDHDHNHDDHHNDHDHDHDHDDHHNDHDHDHDHNDHHD

SEQ ID NO: 6114 - DNA, 430 bp, Zea mays
  misc_feature: Ceres CLONE 329134-F
  misc_feature: Encodes the peptide sequence at SEQ ID NO. 6115
agatctctccgctttatataaaccctagggcctgccatatgcaaacacagccaaaacaagccaagtacaagccaatcgagtctccactccagactcctgcaaaaggcatagcatcaagagggctgtgtaaaatttgctgtgtccctgcaaaaggtcatgtcatctcccatggccaccataacggctagtgccagtccagccatgcaacaaaccagcaacaaggctacgacgagtgccactgtcgcctcgccggcgccagtgcgctaccggccgtcgctcttggtcatattaagtgcctgcctcgtcctcatgggcgcaggcggcccgctccttctccgcgtctacttcgtccacggcggggagcgcctgttcctgtccgccatgctgcagatctccgggtggcccctcctcctcccgcccatctgcgtct

SEQ ID NO: 6115 - protein, 87 aa, Zea mays
  misc_feature: Ceres CLONE 329134-F
MATITASASPAMQQTSNKATTSATVASPAPVRYRPSLLVILSACLVLMGAGGPLLLRVYFVHGGERLFLSAMLQISGWPLLLPPICV

SEQ ID NO: 6116 - DNA, 423 bp, Zea mays
  misc_feature: Ceres CLONE 329135-F
  misc_feature: Encodes the peptide sequence at SEQ ID NO. 6117
tccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggctacggcaactccgacgggaactggaggaactgagcggtgggg

SEQ ID NO: 6117 - protein, 103 aa, Zea mays
  misc_feature: Ceres CLONE 329135-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGYGNSDGNWRN

SEQ ID NO: 6118 - DNA, 506 bp, Zea mays
  misc_feature: Ceres CLONE 329136-F
  misc_feature: Encodes the peptide sequence at SEQ ID NO. 6119
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcagsactacgtcgtcgacggcttcatgaasaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcga

SEQ ID NO: 6119 - protein, 140 aa, Zea mays
  misc_feature: Ceres CLONE 329136-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (42)..(42): Xaa is any aa, unknown, or other
  misc_feature (50)..(50): Xaa is any aa, unknown, or other
MVSSSMDTTSDKRASSMLAPNPGKATILALGHAFPQQLVMQXYVVDGFMXNTNCDDPELKEKLTRLCKTTTVRTRYVVMSDEILKNYPELAQEGLPTMNQRLDISNAAVTQMATEASLSCVRSWGGALSSITHLVYVSSS

SEQ ID NO: 6120 - DNA, 529 bp, Zea mays
  misc_feature: Ceres CLONE 329165-F
  misc_feature: Encodes the peptide sequence at SEQ ID NO. 6121
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctccgtcgagcgaggcgcgcttcccgggcggcgac

SEQ ID NO: 6121 - protein, 148 aa, Zea mays
  misc_feature: Ceres CLONE 329165-F
  misc_feature (10)..(145): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSVERGALPGRR

SEQ ID NO: 6122 - DNA, 483 bp, Zea mays
  misc_feature: Ceres CLONE 329187-F
  misc_feature: Encodes the peptide sequence at SEQ ID NO. 6123
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcaaccca

SEQ ID NO: 6123 - protein, 133 aa, Zea mays
  misc_feature: Ceres CLONE 329187-F
  misc_feature (10)..(133): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSINP

SEQ ID NO: 6124 - DNA, 492 bp, Zea mays
  misc_feature: Ceres CLONE 329204-F
  misc_feature: Encodes the peptide sequence at SEQ ID NO. 6125
aaaaaccctaacactccaccgacgcccagatctgttccttctctcttccacgccgccgccgccgccctcgaattttcgaatcctcagcaacaatcggcctgccgccatgagggagatcctccacatccagggcggccagtgtggcaaccagatcggtgccaagttctgggaagtggtgtgcgcggagcacggcatcgacgccaccggccgctacggcggcgactccgacctgcagctcgagcgcgtcaacgtctactacaacgaggcctcgtgcggccgcttcgtgccccgcgccgtgctcatggacctagagcccggcaccatggactccgtgcgctccggtccctacggccacatcttccgccccgacaacttcgtcttcggccagtccggggccgggaacaactgggccaagggccactacaccgagggagccgagctcatcgactccgtgctcgacgtggtgcgcaaggaggccgagaactgcgactg

SEQ ID NO: 6125 - protein, 128 aa, Zea mays
  misc_feature: Ceres CLONE 329204-F
  misc_feature (45)..(128): Pfam Name: Tubulin Pfam Description: Tubulin/FtsZ family, GTPase domain
MREILHIQGGQCGNQIGAKFWEVVCAEHGIDATGRYGGDSDLQLERVNVYYNEASCGRFVPRAVLMDLEPGTMDSVRSGPYGHIFRPDNFVFGQSGAGNNWAKGHYTEGAELIDSVLDVVRKEAENCD

(The sequence listing continues in the following parts.)

What is claimed is:

1. An isolated nucleic acid molecule comprising:
   (a) a nucleotide sequence encoding an amino acid sequence comprising SEQ ID NO: 36020; or
   (b) a nucleotide sequence comprising SEQ ID NO:36019.

2. The isolated nucleic acid molecule according to claim 1 comprising SEQ ID NO: 36019.

3. A vector, comprising:
   (a) a first nucleic acid having a plant regulatory region; and
   (b) a second nucleic acid having a nucleotide sequence according to any one of the nucleotide sequences of claim 1, wherein said first and second nucleic acids are operably linked.

4. The vector of claim 3, wherein said regulatory region is a promoter selected from the group consisting of YP0092, PT0676, PT0708, PT0613, PT0678, PT0688, PT0837, the napin promoter, the Arcelin-5 promoter, the phaseolin gene promoter, the soybean trypsin inhibitor promoter, the ACP promoter, the stearoyl-ACP desaturase gene, the soybean α' subunit of β-conglycinin promoter, the oleosin promoter, the 15 kD zein promoter, the 16 kD zein promoter, the 19 kD zein promoter, the 22 kD zein promoter, the 27 kD zein promoter, the Osgt-1 promoter, the beta-amylase gene promoter, the barley hordein gene promoter, p326, YP0144, YP0190, p13879, YP0050, p32449, 21876, YP0158, YP0214, YP0380, PT0848, and PT0633, the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, ubiquitin promoters such as the maize ubiquitin-1 promoter, ribulose-1,5-bisphosphate carboxylase (RbcS) promoters such as the RbcS promoter from eastern larch (*Larix laricina*), the pine cab6 promoter, the Cab-1 gene promoter from wheat, the CAB-1promoter from spinach, the cab1R promoter from rice, the pyruvate orthophosphate dikinase (PPDK) promoter from corn, the tobacco Lhcb 1*2 promoter, the *Arabidopsis thaliana* SUC2sucrose-H+symporter promoter, and thylakoid membrane protein promoters from spinach (psaD, psaF, psaE, PC, FNR, atpC, atpD, cab, rbcS, PT0535, PT0668, PT0886, PR0924, and PT0585.

5. A plant cell comprising the isolated nucleic acid molecule according to claim 1.

6. A plant cell which comprises a first nucleic acid molecule according to the isolated nucleic acid molecule of claim 1 operably linked to a second nucleic acid molecule that is heterologous with respect to said first nucleic acid molecule.

7. A transgenic plant comprising the plant cell of claim 6.

8. A transgenic plant comprising the plant cell of claim 5.

9. Transgenic progeny of the plant of claim 7, wherein said progeny comprises the first and second nucleic acid molecules.

10. Transgenic seed from the transgenic plant according to claim 7, wherein said transgenic seed comprises the first and second nucleic acid molecules.

11. Vegetative tissue from the transgenic plant according to claim 7, wherein said vegetative tissue comprises the first and second nucleic acid molecules.

12. A food product comprising the vegetative tissue of claim 11.

13. A feed product comprising the vegetative tissue of claim 11.

* * * * *